United States Patent 9,328,346 (POLYCOMB-ASSOCIATED NON-CODING RNAS) - sequence listing, part 26

SEQ ID NO: 4358 - RNA, 118069 nt, Mus musculus
agucgcgcugacguccucccggcuacccacaagccucuguaccccggugcgggcaggaagagggcaaccggguccaguggcugcccgggagaucggggugccuucuguugcuggacgcggacugcccggcaacccccgggcacacuggcggcuaccggucucucucccggggaaggagacugccccggcucgggcugucguccuaacgugcuggcccgugucugggacgccggggccagggcgcucugcugacagcugucaggcugucagugacucccgggcacuccccggucugcgucaccgcguaccggucaucagguucuuccuaacaucuaggaaugguagcgcagggccacucgaguaccauauggcgucuaguacgugcugccguuuaguaaguauuagccucgcaggcccgaccuggcugccccuccgcaccagcccuuccugucccucugccucaucgccugcggucucgcgucugcuccagacucucgcgcgccccuccucuccgcggcugacgagccucuuccuccuucgcucucagcgccgagcuccggacugcauuucccggcaggcgccgcggccaguagccaauaggagaccuaggauuuggcggcggcggcgccgaacggggcgggggggcuuugugcgcggaggcggcggcggcggcggcgacggcggcgggagcuggcggcgcggagauccggacggaggccgagaccggggcuggguugccgggugucugcugggagaggugugcagcuuucgaucagaacccugggacccugcugcccuucggggccgccagccuccggcuccucuccggcaccagcagcuacgcggcgacccccguccggccgccuccccuucgcuccgcgucgcccgcagccuuccgucugcccgcaaaacgagcccggccggccgggccguggccguccucagugccggccgccauggcaggggugcucggcgcgggggaaaucuaguccgaggauuucaugcggccuagcucgguuccgucuccugcgcccgcggucccggcagcugccggcaacccagccccacuucgggccucggugucucuccugugaucgcacugacacggcagggggguuagaauggaacaaacugaagguaaagugcuuguguauguguguguugcgcgucagggcugaggaggcuccuuggggugggggcgaccuaagacccaggcacccauaaggagugagacccuggaagagaaggggccgcggauggccugaaaggguucugggaaggaagagcagaugguaagguggguguggaaggaauugggagguggggcagguaggcuugggauaugauguaguggugcugagcugggaauugggaguagaggugggaugggggcggggauaaggauggaaacgggggagggguaggaaaagagaagaguuagauuuggacauuagagaccuaaugcaaaugaggauaggucuggaauggaguguggaaacuagaagaguuggggggaaagggauaggggugauggagaaucgaggcuucuucugggaaucaaggagagaaacuagugaaucaaaguggaggaaaagauaagauuaggaaauagggaugaaaaaugauugugucaggaugcaagagcaggauaggaaauagacgcaggaaacugaaagacauacgauugggcuagggaaggacauuagcugaguguuggaaaggaugagaauuaucgaccaggcgucacagagugugaggaaaaggauggggauuauugaaguguuagaagggaaagccuuuuguuccuauguuuguguguauucugucuuguauuucaaggcuagagaaauagagaagcuagugguuaugggguugugauuguugugaaaugagggagguguggguguuacuguucugagagaagaggagauguguuuguguuaugguagggaggcagggaaagacauggccauaauuugaugguuuuggugagggaguaaagacuauucagauuuaaagggggcaggggcagccauguuuguuacccggcacugcaguguaaauaaauuccuuuuccucuccgacaucugcgugaaucuggaaccggcaguucacauuguuacaccuccccuucuacucaugaacuucucuuaccucuugggucauuugcaauuacucauaaccacggaaggacgcggcgauguuucccaucuuguguguuuugcugccucuuccuuucuuucccccuuuccuucuaguugcaaaaaaaggcauacugauaaaccgcaguguacauuuucacccuuuuuuauaaauuuaaaauuagauuuuuaaaaaaaacuaacugaagaaaucauugcuaucauauuucaagcuugauugugaaaagucuuaaauauugauugguuuccgacaccucagaagcaagucaacauuuuuuuuuuccaauucuuuaaguaaacaaggaaacugcauugguuauuuuacuuggggcgcguugagaaagggguggggaagaucagccuguuguagcucaucugcuugcuggacuuagggucuuggaaaauuagaaauguuccaggugauaugcauguuguuaugaauaaugcuuuuuuauuagcuuuuccccucucuucccuuugcuuucauguagcuaguucaauacagucuccaaaugccaguucagcagcgugaucugugaaguaggcauguaguccuuagauccucacugaguugucagcuuuugagggguggguggaggggaaguucugucacucccaggaaagcgccaguaauucuuuaaugcauucaaaucuaacuacuugugugaucuaaauuuagacuaagggucuaaguccugacaaaguagauaaauugguauugggugaaauuuauuuucuauucauauugaaaaggauucaguauucaccuuacuuaaaauaauuguaauuauggucauccaaacuuuagccauguguuaguauugaaacuguuuucuaacaccagcaaggccugcuaacuauacagugggcuugguccauuuguacuacauacaaaucuuaauaguaauguucucucaguuuuuguagaguuugguggaaaacuuaaauuuaauguuguuggaaugguacuaucugagauuagacuuugaauaaaugucagauuuauaacuugguguauuuugguugauaauauauagccugaaagaaguuuuuuuguuuuuuuuuuuaauucuaaagauaaauuuuauucaaagucauucagcauguauguggaauuuaucuaauuuguagagauauuuuauuuguauugcucuccugguugacauauuauuuguagcuaguagacuuacuuucauugacugucagugccaucacuuuuaggaaaaugagcaacuguauauuacagcagagaguaucuauuuggaagcuugaaugagcccucuuagaguguugugucuggguuccuuggacagguauccauucagugaggaaggcuacuguauuuaucaaacacuugaaacccaaaucugcugugguugcugcugugcucaucaucugcccacaugauguuuaaaaacacuuuuaaaaauuauuuuccuuagugucugaguguucuuaccuguauguauauauguaugucugugugccacauguggacgucagaagagcgcaucagguccccuggaaugagaauuauggauggcuguaagcuaccauauggguucugggaauugaacccaaguucuggaagagcagccagugcuuuuaaccacugagcugucucucuaacccugauaccuuuuuuaaaaaauuauuuauugagacagggucucauauaucccauucuggccucaagcuuucaauauagcugaggcugaccuugaacuccugauuaugcguccaucuucugagcaugcugauacgugcuagcauugccuggguuauggagugcuuggagucccaccuagggaacaacuauacuacaucccucuccccgccacuccccccuccuuuuauuuugagugacaaauuaacaguuggucuuguaaugauuagauuaaaagaguuuggaaugaaggaaacuuauugcccacaaaaugguuauuuuuggcccaacucuccaaagugacucuaaagacaauagcuucuggaauuuuaaauaauaaucauaauguaaagaaacagcuaauaguuacccccuugccguauacugugcuaaguguccugcauguaaaauuccuuuuuuuuuuuuuauuuucccagcaguuuucuaagacuucauuuuuaacugcuuuuugcaaauggaaaaaaagguuagauaacauuacaaauguuauuaaauauuuaaauaacaaagcugguauuugaguguaggucuuuuaaguuauagaacccagagaagcgaauuguuucuguuagcuucuucuaauauaacauaaaaauaacacaugccuguuauuuuaaaauauuucaaaagauuaguguccccaguacaccaguguaacuaguuagaaguguccugaguguccucaacaguuucuguggauuuacuuagauccauagaauggacucacacuaauucuagaacccaggucuguguagagcuaaaccuuggccuuucuuacuuuauuuggaguuguugucuucuugcuuuagucuuccauguguuugagauucuguguacacagccagcucugacuaguguuucguuuuacuuagcaggcaugugggccucuaacuuuuauuugagaaucagguagaauacuacaacuuuaacuaacccuuuguuugaucauuuuuguuuuuuguuuuugaggcaggaucucuguuaaguagcucuggcugggccuguagucacagccaucuugccucugccuccugagugcugugacuaauuaaagguccagcuaaaucaaacucuuuuuuuucuguuauaagaaugauuuugccuacauuccuagcgguuuguuugaauggaagauaaaugcuccaaucgaacuuauuuuacagaagagaaaaaaacccugaggucuauagaaguuaaguacaagcaaggcuuuggugccaaacugguuacuucuuggaucucaagaccauguuacuuuacuuccuuacuaugaacguauuugagcuguucuuucaagcucaaggugagugggaugugcugaggccaggcagggugguauacccaguuccagggaguugcaaugaggcaagccguccugcugagguguuuuucauucucugacaagcagcauaugggcagaguguuuuuaugugugacuggauuauauccagccuaucuuggaguuuguguuugguguaauggaauagguguuggcaaaauuuccccccucauaauaaaauugucaaugagauaguuagcaaugagggagaaaaauaucaguaacccagcccuggccccagaguaaaauugagacacuggugacgacgacuucuucuucuucuucuucuucuccuucuccuucuccuucuccuucuccuucuccuucuccuucuccuucuccuucuccuucuccuucuccuucuccuucuccuucuccuccuccuccuccuccuccuccuccuccuccuccuccuccucuuccuccuccuucuucuccuacuucuuuuccuccuccuccucuuacuccuccuucuccuucucuucuucuucuucucccuuuuuuuuuuuuuuuuaaugagcugaaaaauaccuaauuaaaaacaauaguuuuaaaacauuucagguuggacauggugcuucaugcuuuuaaucccaguccuuuggagguggagguggguggaucucuaugaguuugaggccagccuggucugcauagugagugaguuccaggacagccagggcuauauaaagagacccugucucaaaauaaaaaaaaauaaaaaacaucucaggagacacuguugauuuacuuaauuauguuuuccuauaaaaaaaaauagguuaccucaaauuuauaugaaaugauucacuugaacucacuguguagccuaggccagcauccuuaacucgugacuuucucuaccuuaaccucucaucugcuagcauuacaguuuugugucacuaugcugaacuuauugagucucuuaaaacaaaacgaggguggguaggggaaugguggggggaccguaugggggacuuuugggauagcauuggaaauguaaaugaggaaaauagcuaauaaaaaaauuaaaaacaaacaaacaaaaaacaaaacgagagucucaccuguuguagacacaaaagauauuaaaauuauuauuuuuaaaauuuuuuuuggagauuucaauuuuauguguaugcacauuugccugaauguaugucugugaacuuuguaugugcagggcccauggagggcagaugaugauggguguccugagacuggaguuacgaacaguuguuagucuccaugcgagugcugagaacugaaccagauccucuggagcagcagcuaagugucuuaacugcugagccaucucuucagccuggacuuacccuaccuuuucucaaagguuauaaaaagccacagcgauuauauuuuauuggcauaaaguuagaugaguggacuagaguccagaaauggguaauuaucaagaaguguuguuaaauaugaagccaaaagugguaaaaccuagaaucccaccacuuaggaggaauucagguuugagggcaaccugauaaaaacagacuaucucagaaaacaucgcauguguuuguagcucaccccccacuccuacuguguuacauauauacugugcuacauguacugauaauauuuaaaaaggaauaaauuauaaacauaccauggaugaaucuugaaauaauucuaagugaaucuagacauauauauauauauauauauauauauauucuaugauuccaaauaaaagucuuauaugcacacuaccccauagugacaagcaagccagucccaagaaauuaaaguuauuaaagcuuuaaaagcuuuagaaguuguuauucacaaaaaucuauuuuucacugcaauccuguuuuuaauuuuaauuuagagaaaaaaguauuuuugaagaagcaacucaaaugguuuauuuuuuguuaaaaacacaucugccuuuugagauuuuaaauaacuaaugagcuuuaguucuuuagaauaaucuuuucauaaauauuuauaagauggggccuguggcugagauggcucagcagguaaaggcucuagccaccaagucugaugccaccccaauuagaucccuuggaccuaaaugguggcaagagagaacugacuccugcaaguuguccucugaacuacacagacacaaaugaauuuaauuuuaaaaaaugaaaagauuuaccagcuaaauguccuaaagugcccuaauuuuuuaaaaugucgcucuugugugaguguuuaucugugcaggugcgguuguaugugggaucagaggaacccuugcagggugugugugugugugugugucuaucugucugucuguuuucuguccuuccguagucagucagucagucaguucuggcagucaggcuguuuaggcagcaucugacccuuugaacaaacuggcugcuaguauuuuuaaaaagcuuacaguuucauuuucaguuuuacugucaaccuuaggaaauacauauaguaaguuccuuaaaugcuaugguauguauaauaccuauauagugugacaugaaaaaguaaaaaaacguaucuaacauuuugugagugagauaauguuguuacaggauguguguuguuaguccucugguacaucugccauuaacaagacugaaagagggcucuuagcuuaccuaaaaauuauagucagggcuuuguuuuguuuguuugguuuugguuuugaagauggggucuccaguaacccaggcuggcuuccagugaacucccuacguaacagggagugaccuugaacaguuaacccuuugccucuacuucccaagaucuucuauaggcaggcaacacuacacggaacuagaucuggaucuuuuauuuauuuaucuauuuaucuauuuauuuccuuucuaucugagacaggcuggccucagcccgucauauggaggagucuggcagugcugggguuugcagacauucauccccaaagcugcccuagauguggaucucagucaucauuaagauauguugagaaagcaaaugggaaaaugaaaaagaauuauguacauuauaguuuguauuuaagcuguaugauaacauuuuacauggugccuuuuugguuguuuuauaaauacccacaccauaacuccauuuguuaaaauuaaucugaaagcacaguaauuauuuaccucaauaaugggagauuuugaaauuuccccaaugccuaagacuaaaaagacuaaucaucuaacauaaauuaauuuuuuuggauuucagucuacuuccaaauuacuacuucaaaauuuauuuuucaauuuuaugugcauugaucauuuugcuuacauaugugucugugugaggacguuggguucccuagaacagacaggugugaacuaccauguaggugcugggaauugaaccuugauccuccggaagagcagcugugccaucucuucagccuaaaauuauuauuuuuuuaaugcugggauuaaaggcgugugccaccacugcccagcgagccgaaauuuuuguuuauuucuugcacuuggaaugcuuuuuggugacauucuugaccugauauuguuugcuauagcccuucaaagaaaaugacauucaguuuacuuuuguaguucuuagaacuagugaacuuuuaacuugaaguuuuaauagcuuuucaacauugcaauauucuagucaauucuguggaccauaagggcuuuccuugcucuucagacuggugauauggcaucagcacugccagcuuuugcugaauguccacagagauguguucagauaaguaggucaguuggcuggcucuuacggcaagucagcuugcuugcuugcuuauuuguuuguuuguuuguuuguuuguuuugaggcaggguuugugccuuuagggcuggcuguccuagagcugguucaguagaccaggcugauccuccugccucugccuccacaguguuggcaucaaaggcacauuuaucuuuucugagacaggguuucuugguguauguaacccugguuguccuggaacucuguccucucucugcucuccaagugcaggugaagugcuguuugccauaguucuagauacuuugaagucaaagacagaaggaucccuuccuugacuauaggaucugacugagcccagcuugggcauuuuaggaagagcaugucuuaacaaacaaacaaacaaacaaacaaacaaacaaaaggaaugcuggcaggacauagugguccacacauuuuuuuuuuuuuuuuuuuuuuugagacaggguuucucuauagcccuggcuguccuggaacucacuuuguagaccaggcuggccucgaacucagaaauccaccugccucugccuccuaagugcugggauuaaagguaugcaccacuacgcccugcuggucuacacauuuuugguuucucuguguagcccuggcuguccuggaacucccucuguagaccagacugaccuagaauucacagagaucugccugccuugguacgugcgcaugcacacacacacacacacacacacacacacacacaccccagugcugggauuaaauguguacaggugcaggguaauggugguguacucaggaggcagaagcaggcagauaucugugagcuguuuggcuagcaguuuggucuacacagugggcucaggccaacaaagacuacacagugagacccugucucuggaaaaacaagccugaguagcuggcuuauaggguaaagguauuuuccacccagccugauaacuugaguucaaucccuggaauuccacauggugaaaaggagcaacggauuuuccucaguuguccugugaccucuacagaagugcugugguacgugcauguuucugccuccgaucuacacagagauaagcaauuaaaugagcaaaguaaaguguuuugauucagauuugauuuauaaucaccuuauuuuuaaaaauguacgauggacaguguguucuacccaccuauuucacuguaagauuugcuuugaucuaaacugaccuuuuuccuaguauuuguucugcagguguguuuacuuugagccaguuuagcaaacuguguguguauugggggguuggucugugcgcauguguguaugcacuuaugugcauaagcacagaguugcuggguaucuuccucuacuacucccuaccuguuucuucuaaagcagggucucucccuguaucuggggcuuguauucuuuuuuccuacuaggcuauuagccaacaagccuucaguaucuuccugugucugcccccacaggacugggguugcaaacacacauuugugagaccacgccuagcuuguuaugugggugcugugaucuaaagucaugguugugcagcaggugcugucaaccacagagucaccucuccaacucccuccucuuagauugggugggcacuggacuugaaaggccuauguugagaucugaguuccuaccaccauuuuaccuuaccauggaagguuaaugcuuuuguugaugaauagaaaagaguacuuagaguuguagaacuuuaaacugaaguguuaaaguaccagacuuuagcaccaaguaagcauguacuugguaauucacacucccuaaaaacagaaauaaagaaguagagguugagggugaggcucaggaguagaauacuuuucuauauauaaagaggcccuagauuugauuuucagcuuuaaaaagagaagaagaaggaaaagggaaggaaggaagaaaagguugucugcaaaugagguugucuuuaauugcauguuuaguagaugaagaaaugaacucacuuggcugccucaacagaaguuaagaaauguuggagcagcaucuuugcauaggcuguguggguguucucaguaagagauucauguuaguacaaguaugaacaagaaguuaacuuccaguccaaacuuacuuucacuguaguuacgguaacaucaugcgucgaacugcaccagugcuuaguguucugaugaagcaaguacgugaugaaaagcuuggauagaaugagcuugacauccugaaguuauaaaacuagugaagcaaaacagaaaacaaaacaaaacuccagaaaacacccaaguaucuuuagagguuauuaaaaacuuaguuacgggcuggugagauggcucaguggguaagagcacccgacugcucuucugaagguccagaguucaaaucccagcaaccacgugguggcucacaaccaucgguaacgagaucugacucccucuucuggagugucugaagacagcuacaauguacuuacauauaauaaauaaauaaaucuuuaaaacaaaacaaaacaaaaauaaaaacuuaguuacagguuuuaguuugauacaguauaccuuaaaaugccuauuauuuuugucauaauuauuuuuuuuacuugaggcuaacagagaauccaaaguauaagaaaguaaaauuugaacauuuauaaaaccuaagaaccaacuggauguggugacucacuuuuaauccuagauucgggaggcugaggcagggguucucugugaguucaaggccagccuggucuacaugguuccaggauccucaaggcuacauugugagaccgucucaaaagauauaaaaauaaaucucuuaagaacuaauuucagaaacuaucuuauuaucauuuacuugauuucaaagagaguagagcaaggugacugauagagagguuggcuuaguuuggggccagagagauggcucagugcuuaagagugcuuacugcucuugcagaggaccuaaguuugcucucuaaugcucacauggcucacaaucgcuuguauaacccaguucuaggggauccuguacccguguguuacacacacagcauauauaacacacucgggugcacacacaugcacauacaauagauuuuuuuuuuuaaagaaauagcuuacuuuguaguaacuuuugguaugagccaguacccuugugguaagaaacuggacaaaaaucuaauauacaucuugaagugguaaccauguuuguuguuguuugguauagucaagaacaaaguaagaacuguggaggugaaacugggagaauagggaaacagcauuuaauuaguaaucauuguauuguuacaagguggucaagcaguaaugugguuuagucaggaaaaaacugaccuauaaucuaaaaugcugaauaauuuaaugaaaugauaaucaagugaaaacagauugaauuuaauaacaggguuuauggauacgugaaauacaacguagguuuaaauuuuucucauuaauuaauuaauuauguuccaugucaugcaagucacuauccugacacaggauacuuuaaucucuuugagaaucaauuuuuuucuaacaccuugauuuguuugagauggggugguggugguggugguuucaccauuguagucuaggcuagccuccaaauucugagugcuacauuacaggacuguagcacacuguaagugggaaauuuaaaguggaaauuuuaggagauacuuaagguaacagcaacacagcuaaccagauuauggagcagcacaguuauacuuaaaaauguuguuuguucuguuuauacuuuugaaaauguaaaaaggaaaauuagaaaaaaaauauacauuucuggacaugcuuugcuuacugagaaaaugucgugaagucauggugauuuuauaucuguaaaagcuuauauaucuaagcauuggauguaaauuucauuuaauguuugauguuacaagugaaagucauuaaauaauguuaagacuauugagacuuaaaguuaaaccaaugucaaaauaaaagccuaagcuauacauuuaucuauagacauccagagggauggcaucuccuuucacucuuuggugucauuucagguauagcaucacuugguuuaaucuccacaucucagacaguaaaugaguucgauagcuccgugguuacgaccugggugugauucccagcacgcacuuggugagccucagcugucuguagcuccaguuccagggaacccaauaccuucugguuucugaggguaccaggcaugcacaugaugcacagacacccaugcaggcaagucacccauacaagccaaauaaagcccuuugaaaaucuccugacucacaauucaaguuacaugguuguaagccaauauuaccaguacgugcuucuacucugaacauucugcuugucucuggguucaccugucacuuagcaugaguaugauugcuuaaauguucauguaggugauugcccuucuuuuuccuuccuuccuuuguuccuuccuuccuucccuuucuccuucuucuuguucuccucuucuucuucuucuucuucuucuucuucuucuucuucuucuucuucuucuucuucuucuucuucuucuucuucuucuucuucuucuccuuuuucuuuuuucuuuuuucuuuuuuucuuugagauacaaugucuccauguagaccagacuggcuuugaacucacagagauucacuugccucugcuuccugagugcugggauuaaagguguguggcaccaugccaggcugauuucuuucuugcaucacaguauuugcccauuucuucaaaguucaugacuaaccucauuuccauaagcauguuaagauuuucaugaggucguuuggaggacagucgugcuuugagguggucgaaagaauugaauuucccuuugagguagggucuccagcccaggcugcccccaaacuugcucugugugaacuucugacuacagccacccagccacgcaccaccaacagcagcuaaggauuggcugcugcugcugcugcugcuuuuuucccccuagaguuuuaaagacuuuaaaaguuuguauugugugcguucuaugucuuuguguggagauguguaugaagaugcugaauaggccagaagagggcaucuggagccagagagauugugagccaccagacaugggggcuguaaucugaacucugcucuucucuaaggacagugaacucuuaaucacugagccguuucuccagcccaggauacuuguuuuguuuugcuuuguuuuugauguuuugagacaggguuucucuguguagcccuagauguccuggaacucuuucuguauagaucaggcuggucuugaaugcauuuauuuuauuauuuuguuugguugcuaugccuacauauauguuugaaugucacacgcaugcccagugccagcagaggucagcaaaggccagcagaggccagcagaggccagcagaucucccagaacuggaauuaccgguaguugugagccaccaugugguccugggaacaguggaccucuucaagagcaaccagugcucuuacccacugaaccaacucuucaguucuccuagaaaucuuuuuuuuuaauuuaauuuaauuuaauuaauuuauuuuuuuaacuuauucccgcucacugccuucuucccugucauucucucccucaauccuucccuuaugccccuccccuucuccucugagcaggugggggccccucuggguauccccucacucuggcacuuuaaaucucugugagacuaggcacuuccucucccacugaagccagacaagguggcccauagaauucuauuaguuaguagacuuaacaguauauagacugcuaagcaauaaaaugauuuuuguuguuguuguuguuuguuuguuuguuuuucaagacaggguuucucuauauagcccuggcuguccuggaacucacucuguagaccaggcugaccucgaacucagaaaucugccugccucugccucccacgugcugggauuaaaggugugagccaccacugccuggcuaaaaugguuuuuuaaauuuguuuuuuguuuguuugcuuguuuguuuuguuuuguuuuguugaaucaggguuucucucuguaauccuggcuguccuggaaccuguucuguauauauaccaugcuagccucaaacucagaagcaacaauagaaugcuuuaauuguaaagcacuugccuuuguguugguauauuuuggacuagugcaugcuuauaaccccugcacuugggaaguggaagcagaaggagcugaaguuugaguucgucuucaguuagaagcuguguuagaagacagcucacguuacaugagaccuuuucuuaaagcaacauuaaaaaccaagcaaacaguccacauaaucuguguggaaagaaggacuuugucucuucucaccuaucccuggccacuugcuuuuauuuucuuccucccucaggagcucacuauguagacaagaauguccuggaacuucugauccguuuaucucuaccuccccagugcugggauaauugauauaugccaccacacccaguuuuauagguuacugaggcucaaaacuaggguuuucuguguguuagucaggaacuaccaacugagauaaaucucuagucccccauaaaaaauuuuaaaaauuauuauuuuaugugcaugaguguuuugucugcauauauauguguguguguguguguguguguguguguaugugugugugugugugucuguauauuugucugucuucuugucuaccauguacuugcuccucaagaucagaagagggugucaguccugugggguuggaguuacagaugguuguaagccaccauauggcugcugggaauugaaccuagauccucuacaaaaaucacagugcucuuagucacugggccaccucuccagcuccauauauucguaaaugaugaagcaguuacauaaaaugugaguuuuguuuuuuuuuuuuaaucgaggggacuugcucauaauugugugucucuggguauguguucauguguguugguuccucucacuuguaggugcauauagaguccagaggcuagugcuacaaugccuuucaucaguucaccacgguuuuuaaagauuucuuuuuguaugugagugcuuucccugcauguaugucucccaugugcaugcggugcccaggcaggcaggaagccuggguccggucgccuggcacuggggucggagaugauggugagcuccuggauagaggccaggagcuaagccagggccugugcaagagcagcagugcuccuaaccgcugagcugccuugccaggccucccucuugcaccuuauuuuucugaaacaaggucucacuauauguagcugacugaccugaaacucauggagaucugccugucucugucucccucugcugggauuaaaggugugcacaaccauaccuggcuccuccuucccuguuuaaagucagcagcauaguugguuaucuucgguguucuuccuaccccuccuccgugcaccacuuuguucauagcauccuugugaugacugaggcccagcugagugagacaggacguguauuugcguggucguuuccugcucucugaacucauucagcagcuucuggauuccucugugguccugggcaugggggaugcagacacgggugcaacacagcaccagcugggcuucugcuggcugguuugcuucacuauacagcccugucuuaaacucacagagaucugcuugccucugucucccccuccugacugcugagauuaaaagcauaugccacccuguguagcucuaacaagaauuucugucagaguugcuucuuuuccauaauagaagguacugccacaauuuacuuuggauguuaaagacaucaaaacuuguuggucuuggugucgaacacuuuuaauccuaguucuugggaggggaaaaacagaggcaggaagaucucugagauacugucuugaggaaaaaaacaaacaagcaagcaugaauuugagauaucuaaacuggccaguaugucaacagugaagcugcacaaaagacacuucaaaugcauaugauauuugguguuuaggacaagauuuguauuaaucugucguuaauaucaaaaagucauuuuucggggcuggugagauugcucagcgguuaagaacacugacugcucuuccaaagguccugaguucaaaucccagcaaccacaugguggcucacaaccauuccuaacaaaaaucugaugcccucuucuggagugucugaagacagcuacaauguacacauauaauaaauaaaucuuuaaaaaaaagucauuuuucuuuuuuugggggggggucacuuuacuagaggucaagauucuaauauuuuuaugagugauaauauuaugacaguuucugguaaucucauuaauagugacucaaaguuguauauacagauauagaagauagaacuucauaauguacucaguaugaauuguagcacacucucagaaguucauauaugcuuguaguuauuagaugcaugauagagaacaucagguuauguaagauuauauaaguaguuaauauuucuuuaaaaggcuuuuuagucagggacucuuagaugacauauauacuguguguuuucagcauuuuuuuuuuuuuuacauuuauuuauguguaugugcgugcuguuguacaugaguagagcucggaggcuagccuuugguaguugauugucucuuccauguggcuucuagggacugagcgcagucaucaggguugguggagagcaccuguuuucagcagucaguaaaagccuucugauuuuauuauuuuuuaaaauuuacuuauuuauuuuuauguacauuuugguguuuugccuacacauauguguaugggagggaaucagauccacuggcacuugagcuguagacagucaugaaccaccaugugggcgcuaggaauugagguuaccuggguucucugaacuccugagccaucucuccagucccccccaccccaccccaccccaccccgaauuuuaucuuuuuagugaaaguauaaccagcuaaaauaagauugcauauuacaguuacuggaagguugaaaagccugggguaagccuuaguuguuuuccuagcgaccugaguccugcugcugggcuuugugcugagcaugagagaacgcugcagaugcugucugagcuucuucacaaguccuuuuagaaagaaaguaaaucuccccaggcacgguggugcaugccuuuaguuccauacucaggaggcagggccaggagaacucugugagcuuaaagccagccugauauagugaguucuaggacagccaaagcugcguagugagacccugucucaaacaaacaacaaaaagcaaaccugguacuggcucaauugguaaaguguuugccacacaaauguggagccuugaguuuggauuuucgguaccgacauaaaaaaccaagaccaagauauagcaguuucaccugugacucugaaacuggggaguagacaggugggauuccuuggagcucauuggccagccaggcucaaugagagacccugucucaaaagauaaaagguagaguaauauaggaaggcgucuagucucugcaggcaugugcacauagcaaaccaguaacaucaguugugauucauguuacaagcaucuaguggcauaucgguaacacacuuaaugguaauaagauauuuuaaugguuaauccagcccugugucccuuuaguguuuuucuaucagaauuaauuuauuggcacugugccagaugcugcaguuagcuguggaucuucacuccaguguuccuaaacacacuucauucuccccuuagcuucugguaccuacccuuccauccccaguuguguggugcguuuucauuaaaugcaucucguuugauuucacagcauuucaagaaaaaacauuucaaaagccaauuugguauuuauaauacugaggagcucugaaaauucuucauugaaguuuuuugaagugcuaucuacugucagcuuucagagaaccguuuggcucuucucagccuggacgugugugauaucccacauuucacugucuuagccuggauauuuacugccaggagggacugagucugucuuguuuaucuuuuaucucuagugcucaggacuugacauaaugcaggcacuccacaggaagcgcugcucucaucaggacugcucugggagcucugcccccaguguucccuguauugacuucucccgaauaguguaggcucuaggauuaugggaccuugucugagucuucaccucucuacuguuagacuuagcucagugucuaauaguaaacacuugcgcuauuagagaaaucugaauagauuggggcugggagggguugcuggguuguaacauuugguuucuuucccguuacaguaguaacagaaugggaaggaagguggagcuggcaugagucuucccuggaccuucucagacuagaaaggguaauugacagcagugggugcucagaauuauggagucaaguauucuaguguucuuucuuguguagauauuugagaucaugcuuacuuuacacacaaaaacauagacacacacacaccucuuuccuauacuauuuaguguugugauggaauguaaauguagaaugcucuguuaguggaggaggacuugaccuggcuuagagcacaugugauauggcauuuuaaggccacuuggaguguauuaacaccugaauggaaucauaagacugagugguggcugagagagaaaagguaacaugguggagggcaaaugggacccugcaggucucugacuacauaggcuggugccacaguaucaggggcuucagcuuuuuugauuuguucugaggcauacaaaggcuuauuaagguuaaauccugcucuguuuguuuguuuauugagauauguguauuuugccugcauguauguaugugugcaguauguaugccuuguaugcacagaggccagaagaggguauuugaucccuugaaacaggagcuaugguuguaagcuaccauguggauacugggagcccaacuauaggccuuugcaagagcgacaaaugcucuuaaccucugagccacaucuuucccgccuaaguuacauuuuuccccgugugguaaaauacuaugaccaaagguaacuuauggagguguuuauuuuggcuuaguuccagagggcaagcugucccugaugguuggggaagcauggagagaaaacugggaagcugguugaugacauaucccagacaggaaacagagagagcaagcaggaagugcggcgaggcuuuaauccucagagcccucucucuagcagugcucucuacccugaggugcuacuguacccuccucugaugccaccaacugggggccaguguugaaauacaagagccuugggggaacauuucuuagucaagccacacaugucuuuuugcuuacuguuuaugcuguaaagcauggucagagauggauaaugcuggaaauagcaccaugaguuaggaaacauguucugguuaagguaaggacucuuccagcauaagcagugagugagugggaggcaguggacagacuugggagagcgagcaggaggcacagccugcguugacugcagcuuaucuucucaccuguggcccucacugucacacucuagugaaaacucagacugacucaaguacuuauuugucuuacauugucuuuggguuuuguuucuuugagacaguaucuuacuauguaaugcuggcuggccugaacuaucuguguagaccaccauguuccuuugaccuugauccucagccuccagaaagugcugugaucauauguagcugucuccagacgcaccagaagaaggcacuggaucccaucacacacgauugugagccaccaugugguugcugggaauugaacucagguccucuggaaaagcagugugugcuuuuaaccauugagccaucuaucuccagcucccaacagagguucuuacuaaugccuagagaaugaaaagcagucuguuaguauucaagcucaggaggcagagggagguggauguuuauggguucaagaccagcuuggucuacauagagaguucaagccagucaggccacauagugagacccuauccaacaaaacaaagagacaaugaaaaucagaaagagggaaucuuuugcucuuccuaaauauucuuguuuuaccuuuuacaagauuuuaaauuuuauuuuauuauuuuauguguauuuugccugcuugugcaucuagguaccacaugaguguuggguguccaagaaaguagugagccaccaugugggugaugggaaucaaaccugggucuuucacaucacaugcucuuaucaccuagccaccucuucagccuuuguuuuaccuuuuauaauagcucuguagucuacaugguguaucauuuaucuguaugaugagaugucaccauuuauucauucauucauucauucauucauucauugagauagggccucucuguguagccuuggccauccuagagcuucuuguguagacaaggcuggccucaaacucacagcuauccuccugccucugcccccugagugcuggaauuaacugugugccacuauggccaguucagugcugccugucuucaucuacauggugaacaguuguuuccacaucuuucuuaccuggcugucccuugcucugcuaugcugccucaguccuguuacuuguacacaggcagacucugugacuguguucagauaucguuuuguucuagcccuuucugcuacuucaccuuuuaauuacuggaccucaacgauaaauguaagagauuuuguuuucagcacauuuaccauguacauugaaaccagcaauucuuuggauggauaauauaaauuuuauugugaaauauacauacuuaauuuuuuaaaagaaaaaugugucuaguugugggagguuuuuugagacauaauucaugcuuauuaaaacucaugcuuuuaaauuuuuaauuaauuuuuauuuuagacagggucucacuauauagcuguaguuagccuggaacucguuauguagaccaggcuggcuuugaacucacagaagucuucuuaucugccucuccagucucucacagaacagacaucaucuucuaaagcaugcacugucauaccuggcuaaaacuucucuuucaaaguguacaguggggugacuuuuaguauauuuacaggcuguacaaccaucauuucuauaucuagagcaucagucaggaggcuccaauuauuacacguaaaauaaaaacuuaaaaaaaaaaaccucucucaaagucugaggccuagugcugugguaguccagcuaucugagacugagcuagggggagagcuugugcuaggaucaggaaauccuaguuaguuggaacuucacuaacuagacaugauuuacaucuuugaaaagugaguaaagucacaugaaaaugugaagugaauaacuuacaggaauucguucucuccucucccccaaccuggauggaacucaggucaggcucggcagaggacaccguuauugucugagccaucuuuccaacccagcucuuauuuuuguuaauuuuuaauuguuuauuuuuugaagauuuauuuauuuauuuucuguauaugaguacacuguagcuguacagaugguugugagccuucaugugguuguugggaauugaauuuuuaggacuuccgcucacuucggucggcccugcuuucucaguuccugcucuguccggcccaaagauuuauuuauuacauauaaguacacuguagcugucuucagacgugccagaaaagggcaucucauuaugggugguugugagccaccaugugguugcugggauuugaacucagaaccuuccagaagagcagucagugcucuuaacccacugagccaucucuccagccccaguuauuuauuuuuuuaagccaguagguuuugcacuuaaacucagaaauuagucaucagcuuaguugguuuuuuuguuuuuuuuugaaaggcuaccuuggaaaguaccuuuagugaagauccacagauaaggcuacuaauacagaauguuaguucucuuaggaaaaggcuguagugccuuugugggauaauacuguuuuauuacaaugauugcuagaaagccauucagggaaaguuuccuauaagucaaagccuuuaauuuucauuuagccucaaccaaaaugauaggcacucguucauucuccccuucuucccuccucucugucucucucugucuugucucauuguguggcccuggcuguccuggaacucacuauguagaccagacugguccggaacucacagagauccaccuuccuccucccaagugcugggauaaaagucugugcuacuaacucuggcuugguagaaguuccuuucaaaccauaaacuuugauaucucaaaaugucucaaaaagccacaggagccgggugugguggcacacgccuuuaauccuagcacucgggaggcagaggcaggcggauuucugaguucgaggccagccuggucuacaaagugaguuccaggacagccagggcuauacagagaaacccugucucgggggggggggggggggaaagccacaggaaaacuuaaagauuacaaagugucuggaaagagagagugcuguuagauaaagguuuaaaugcguguuugcauuaccacaggguucacacauugagagaaaaugcccaaguuguaaucagaaaccagauacuuguacccagaguuuuguauaugcauauauaaaacgucacugaaaacaguucauuuuguuucuuggcaaaauaguaaaucuuauaaucuaguguuugcucucuuggggcagaaugaucaacagacaaauagaacagccacugccacucgaaaauuuguaguuaccacaaaacauuuucaaggaggaucuauucuguuugaaagauuggucuucuacugaaguuacugugccaaauuccgguauugccuuucaucucugggaaauagaugagaugcuuaucaauucuagcugcuuuuugugaagguaaacauuauuauucauuuccuucuuggugcugcggagguguggucagguucuuagaauccugugggguuuuauuauuuauucuaagagcuccaucaccauuuauagcuuaaugguaacacguuaaacucugaguagaaacaaccuacaagagccucgaagugggggcugaggcaggggaucuaacagaacuaaaaaccaaaagaccauaugaguuacagaagaagaagguuagcuuuugguguaauuuggaccgguagaacuugacuuucccuucuguuguuauuuauuagcugcuggguggcuucuaguuuuaaaauagguauaaagcaaaauagcacacuuccauuguccuaaacgcagguuuguuacauuaccaaguuaauuuuaaauuaugaaaucaaagugggcaauacaaaaguaguguauuacugcuacuacuacugcuacuacucuccuacuacaggcuuuucaagacaguuucucugugaaacccuggcuucccugaaacacguucuguagaccaggcuggccuugaacucagagaucugccagccucugccuuacccccaaccccuaguggugggaugaaaggccagugucacuacaccuaccuucaacauuuguaauuuagaguucuggauucacacuaaucauaucuguacagagauugaacacagaaccccaaaaggaugguagcucuguguacuucaaagauuucacacgguuuguuuuuuaaaggugacuguccauucuuucaaggcuagaugucgucgguucaguugcuuuuuauuuuugccauagugguggccaaauacuaagauugccugguuucugaggaucagcguaguagguucaauuccauaagcugcacacauuccauucuuguugcuguggaaagacuuuaggacuagauuuauuauaaaccuggagaaaugcucugugaaacaguucauaugaaaaacaucuugaauuuuuguuuuuccugauaaaauaaagggccuguucugaguaguguagagaauguguuagcauuggauacuuuagucauuauagugagguuauuuuaaauacacuggauuauaucugcuggaguaguucucauguucuugcugauuccauugacugacuguggaaacuguugugaguuucaguucuauaguacuaauaacaggguuuuaaaguagaugcauuuauacgaugguuuuuaagaugguuuuuugguuauauuaacuucucucuauaagcuuuuuuuuuuuuuuuuuaaggugggagucacccuuuuaugguccuaucuuuuuuuuuuuuuuaauauuuauuuauuuauuuuauguaaguacacuguagcuguccucagacacuccagaagagggugucagaucucauuacggaugguugugagccaccaugugguugcugggauuugaacuccugaccuucggaagagcagucggguguucuuacccacugagccaucucaccagcccucuauaagcuuuuuauaccauauuagaggacuuaaaauuuagggaacuuugguuagacuaaaaggaauauuggugguggcaagguaagcagcugucaaucaaauucauggaaaggccuucaacagcucuuuuuuuaaauuucuuuuuagguuuauuuauuuaauauauaugaauguuuuauguauguauauguaugugcaccauguauaugccuggugcccaacgaggucagaagaggauuguaggaucucauggaacuggaggugaggauggucucaaacucugcucauguagcgagcagucccugguucauuuuccagcauccacaugguucaguucuuucacucuagcugcagagaucugaugcccucuucuggcugcuuugagcacugcauacguguuguacacagacgcacaugcaagcaaagcauucacacacauaaaaguaaauaguaaaaguaagaaaggucgguggcuaauaguguguauuacucuucuagaggaccugaguuugauucucaggacacacauuagauaguuuacaguugcuuggauccucuggccuccucaagcaccucuaccacacacacacacacacacacacacacacacacacacuuaaaaaauaaauauuuaauaaguguuaaauaaauauuuuuauguuguguguguggauguuugucugcaugugugucuacuuaccacaugugugucagucacuaggaagccagucaggauacucuggaagaguagccagugcucuuaaccaccgaguuacuuuuccagaccccaaaauacacaaaucuuaagaaaacaaaauucacauaaauagauaguucaguguuucuucuaagaggcaugcacaggaacucaggagaguugcucagacuaacucuguuccuguagcuguuucuuuggagcacugucugaacucaagggguggguaaaguuaagaggaaaagagguguuuagggggcucacugcauguaggagcuuacauuaguuagggcacagaggugucaccugagaacugcaauccuaguguuccccugcuagagcagagagccuucagaguagccaaggaaggguaggccuugccuggagggucugucaccauauucagaccuucucuagguaguggggagccuaagaaggacuuugucuacaaagcaauauauuuagguuuacaagcuaacauacuuaaggauuaagaagugguuugaaacagaaaugggucaaguauauggcaucuuacggguacuucugauucugaaaggucuuaguggugaucaguagaaagacuuuugaagugcaaccaaauauaaagagaagagguuaacauugaaauaaaugaguauguauaugaucuagcauguaagucaguaagguagaguccagcaaauguacacacuaccaaagaagauuguccauccuguuggacaaucauuaguugucuuaacugugcauuuaacauguuaaugcuuaguugauacuuuuaucuuaaagcuguucauuuaaaauacauaauaugguuacuuucuuuuucuguuucucuaguuugacuuuagaaucugauccucuuucuuucugcuucuucuucuuuuuccccuucuuuugugagacggggucucacuauuuaguucugcuugucuuagaacuugcuauguagaccaagcuggccuggaacucggagggauccaccugucucugcacccugaguauugagauuaaacaugugaccuaccaucccuggcuugauauacuuuuuauuuuuuuuuuuauuuuuuuuuuauuuuuuuuuuuuaaagauuuauuuauuauuauauguaaguacacuguagcugucuucagacacaccagaagagggagucagaucuuguuacagaugguugugagccaccaugugguugcugggauuugaacucuggaccuucagaagagcagucgggugcucuuacccacugagccaucucaccagcccccagauauacuuuuuaaaauuguuacucuucccauaaauaaauugggagaaaaauaagaguuuacaacuuuuguugauaauuuucaacccuccuuccucuccccucuccuccccucccuuccuuucucuuuccuucucuuccuuucuccccaccccauccccuuuucucccuacugcucugaaacuguaugggcagcuguaacagaaaucuaaaaagccuuuaucaaguuucucuuuaaugcgagugcauguauguuugugugcaugugcauguuuauuuguuguaugugcaugugaaguccagaggucaauaauuagugucauccucaaugacccucccucaaaaaaaaaagaaacagggcgucccauagagcaugggacucaucaacucggcuagguuuuugggccagcaagaccuuggugucucucuguguucucccuagugugccgccaugcuuggcuucucacaugggucugugggcucagacucaggucucauguuugcccagcaagcccuuuacugacugagccaucuuuccagcaccuugccaucuuucaaaaauacuacauuuaucuguuuaaaaguacagauuacaggguuagggauguaggucacuuaguagaguacuuacuuagcauacacaaagcacaggguugauacccagcucagcauaaaauuaggguauggugggagguaggaggauucaaagucuaugguuuuucuugacuguagagcauguuugaggucagccugagcugugucagacccuaucuuaaaggaaaaucuaggugaagugaugcaauuguuuagucucccauggaacuguuaacucuaggaaggguguguguucgugagugugugugcgugcgugcgcuugugcaugugugcgcaugcgcgcgugcaguuuguggacugcuugauuucuucuuguuuuuuguuuuuuaauucacauauuuaugaauugggaaauaaaauugcucuuaaagagcugauguuauugagcaaaauuuguauuugaaaacuucacuguuuugggggggauauggucuuggcauuucauuugaaaaguguggguaauaguauuuuuauagagaaauauuugggguaggacuuaaauaauguaaugaauauaaaacauuuagaggaauauugauugauauagaguaaacugcuaaacuguuggugauauuaauuauuucuuuuuuuuguuuguuugguuuauuguuguuugagacaagguuucucuaauagcccugugugcccuggacucccuuuguagaccaggcuggccucaaacucagagagagaucaacuugucugugcuucccaagugcuggaauuaaaggcauguaccaccacgcucaacugauacuauuuuuuaaacauuuaaaaacauuuacuuuaugugucuaaauguuuuggcugcauguacauaugaagacuaccugugugccuggugcccauaggggucagaagaagucauuggauacccuacauuagaguuacaggugguugauuauaaguuaccaugugggucuugaaaaacaaauuggaguccucugcaaagagcaacaaguacucuaaaccacugaacuaucucuccaacccuggauucauuaacuauuuauaucaauauuauuauuacuauuauuauguuuaguaguuaaaaauuaagauuuguuugcauguauauacauaugcacaucuguauacacagacacacacauacacauagagcguugagauccaacccaugguguuguacguaccaggugaguacucuaccaccaggguacagccccauccuagguggacugcccuuaucuggguuuuauuuaggucacaaagaugucagaauuuuaagucaucucuacaggggguuugaaugcagagggugagaaacucccucggugccccagccugccuuuccugguuucagccccccccccccccuucacaugcuuucuuccucagugucuuuuuuaacaacaguggcaauacagugcgauuucugguccccuucugcuuacuucuuuugaauacaauauuguaccaaguaauagcgaagggguacugaaggcuaauuacaccaggcacuguucuaaguguuguguguggauuaaguguuaauuuuuccugcaacccugaauaagauaggcaaacagauucuagaaaagggaacuaaagauaaacuaaacuaacggcuuagggacauggggaaagcagucuaaaauccuaggcccagagcuggccuucuagcugggcagcgagcucaacagugugugucagucaacaaaagagacuggguccucuuuugugagguucuaaucauggcaucaauccauaugucugcugugggcucguccauguauaaaaaccacuauagaguaauauccuggguauagugugacaggcuucuaaucccaacacagggaggcagaggcagguggauuucagugaguuauguccagccagaccuacauaguguuacccugucaaaccaaaauaaaacaaaacugguucaugggcugccaggauggcucagcagguaaaggcacuuauuaccaagcuugacuugaguuugauccaugggacccacacaguagaaggagggagccaucuccugaaaguuguccucugaccuuccauguuuacauacaaaaggaaauauaaaacucaaaauauuuucuuaauuuuuacuuuaagaacuuuaaaacuuuuagaaaggagggcuguguauuguggcaucagccuuuaauuucagcacucuggaggcagaagcaaguagaucucuugaguucaagacuaaccugaucuacauaauguauuacuggccaaccaggacuacacagugggacccugccuugaauugggggacggggacggcaggaggagucugcugccaguuaaacugagcaggucccuuucuugauggggccugguaugcaguggccacaaacagcagugucuucgaagagcacguuuguugccugaaugggcugcccugagggguccuggggacagucuccuggcggcuguuccgguaugucugaucucagugcugucagccagacagcuccagacagguacgugggaugccuuuggggaagccccaggcacaauggccaggucauucuguccauccauaccaagcugcagaauaaggaacaugugauuaagauccuggauagaagcaacauaaagcuaguucccuggcugcggggucaaguacaaacucacucaugguguccuuuacaaguggcagacuccuaaucccagcacucgggaggcagaggcaggcagauuucugagugcgaggccagccuggucuacagagugaguuccaggacagccagggcuacacagagaaacccugucucgaaaaaccaagaaaaaaaaaguggcagagccuguacuccucagucaucuccugugcuguguccaccccaccacgucaugcuuagcagcgcaccuccuauccagucugccuuuccucagggcgagggauucuccuguaaguagcugcagcuggagguauagauaggggaguuauagagcauguguaaggcccuguguucaaccccagcaccacaaacaaaauuacaaaccaaaaagauugucuccuagaaaugacaagcugcaaccacaauaacacagcaguaugacugccuaaacaagacccaaacaaugcagguacugacaggcauguuaacaggaaggggaauucucaaagggcccuaccuuagaaaccaccuacaagcaaguacugacucucagaggaggagaaguagucucucccacagaugaacaccuacuggguuaucuagugcaacaacaaccaaaccaaacaaaauaaaaaacucaaaaccuugaaaucauguacaugaaagcagcacaguggacucaaagauugucugucaccuaucuguccauccauacauccauguaucaucuccuuaccuguuucuaucucuguaugucuauauagauauuaccuacacaugcauguauguguaguuagagguuuagagaucaggaggaaacaguggaaucaguuuuuuccuucaccuuucuguggauucugggggucaaacucagguugucaagcguacagagcuagcacuuuuaauggccaagccaucuuacaggcuccaugugucauuucuuucuuagauuucucuucuuagccuuggaaaaaauacuucagagcuuuuugccgugcuggcucaucacacucugagccauggguaucucacuguggucaauauuugcuaguaacuuguuuaaagugguagccguuauguaucucuggugauuugaauaagauccccgcgcaccucucccaacccccaguaagucuugcuacuugguuguuggaacuguuugggaaugacaagaagguguggccguauugaaggaggcuugucacugugguugggcucugaauuuucaaaacucuccaagcuacucuuucugccugcugcuuguggaucuaguuaggucucaucuguuccuguugccaugucuuugcuccacuauaauggacucuacccuaugagccauccaaccaguuaaaugacauuuuuuuuuaauaagucaugguguuugucaaauaauagaaaaguaacuaaggcaaucaucauuauauauauuucuguuuucuauuuuauuuaaaaauagaauaguaauaguagucuaggaugacuuuguuuaucuaucuauuuauuuauuuauuaaauauaugugaguacacuguaggugucuucagacacaccagaagagggaaucauauucuauuacagguaguugugagcuaccauguguuugcugauaauugaacucagggcuucuggaagagcaguuaguucucuuaaccccugagccaucucuccagcccccuaggaugacuuuaaaacuauuguuucaguugagaaaccuuuagugagccccuuaugucuucgaguaguaagaaauuguuccuaguauaaucaugguggcacauaccuggagcucuagcauuugggaggcugagggcugcacauacacacgaguuggagacaagccuauauguacaacagugugaaguucaccucucucaagcacauaaaacaaaccuagaacuaguuccugagauaaagcccauuguuagcugugcuuugaaaauauguucuccuugcuugucauuaaaaaaaucucuuugcuuuuuaaugauuuuuuuaaaagauuuauuuauuuuauguauaugaguacacuguggcugucuucagacacagcagaagagggcaucagaccccauuacagaugguuaugagcuaccguguaguuguugggaacugaacucaggaccucuggaagagcaguuggugcucuuaaccacugagccaucucuccagcccauucuuaaugauuuuuguuuuguuguuuuuaauuuuuguuuuuugagacuucacugugcauggcccuggcuguccuggacuccccuuguagaacaagcuggccucaaacucacagggaacugccugccuuuacuucccaguggagugaggcuggagaguuggcucauugguuaagaacacuaguugcuuuuccagaggacccagguucaguucucagcaccuauauggcaccuggcgauuuccuaugaucccagagugugccaagaaggaacauggcacauuugaaacaccaccgagaagccagugagugcagcagcagggagucuuggucgaugcugaggcuucauguuugagaggguauauucauuauggugagaagacauagugggagcacgaagugguuacuguucugugcuaaaggaggcggcaccagcaaagccauggcagguguggugaugcacccuuuagucccagcacuugggagguagagacacauagaucuuucugaguuggaggcuagccugguccauagaaugaguuugagaccagccaagacuauacagugagaccuugucuccaaaaaacaacaacaaaaccccaccaaaaacuaaacagaauaaagucccaucaucucucucccauugcaccuuugccguguagauagagcccagagucuugugcauauaggcaaaugaccacagccuucagcgugacauuuaugaguguuucauuguugauuguagcaauaguucauuuuccuuguuguguuaaaggauuuugaggggaauaaguugaaugauuggaguuucuuuuuagaggugacuagauguuauaaggaaaaacagacuacgaagaagcagaaggagguuagaaggugucuuguguuaaguuucuuuugacuuggacuuugagaggguauauucauuauggugagaagacauagugggagcagcuucugcuccugguggagagagcaugcagcagcugcguauuacaugcuuccagugagggaguagagggagacuccgaggcguggggaggaccaggggaggggugaugagaggacuagagaggaggggcagggaggauggguaguagggagagagagaagagacuagaugaaaugagacacucauccuccccaaacugacuuugcccauuucuaaaaaacucaaacaacuuaucaaaacaaggccaccuggggugaggcaaggauuuaaacacaugagcauugggguggggaaccauacuagcagcaguggaguaagcaggcugggagaucaucaagaggagaugcaacgacacuacaguuggaguuacauaugucagaaauaaacucgugaugucccaugaucuucaggcuucuugcuugggcagcuaacacgugugguugcuuuuggaaguacacauuuagauagacuaaaaacugaguuucagauaugggcauuuagauuccgggugguaucugggaagugagacgucuccacaguggaaacauugaaggauguggguucaggaaggagccuuggagaaaagcugagcuuucuguuucuuugggcuccagcuggcugcacugucgaagagcaaauccuauguggaguuaaucgagugcaaugugauagcgaguccacaguugaauacuguuuggcucuguggaugcucagaaaaacugguucguguacaugcaguuuagaccgagagaggaaaaggucauagaaaccuaggacaggccugggggagacuugcuauaucaugaagcuguacuguuucuaaguuuacaauuaggcuuauagaagucugauuucaagaacuauuuucuaacugcugugaagaaaaacauuagaugcaagacauauuuugauagcaagaugugguggccacugcucuuaaucucagcauuugggaagcugagacaggaagaucggcaugaguuaaguccagguuuacccaggcuacacucaaaacaaaacaaaagaccuaucuagaaaaucaauuacaauaguguagguuaauaguacugacggcuaguuuggguuuugaaauuaguauagaaaucaaagaauaaaucggauuuuaaaaggaaaaacugccagguguggugaagcacauuuuuaacuguagcacuuaagaggcagaggcaguuggauaucuguguuugaggcuguauagcaaguuccaggcuagccagggcaaccuaaggagauccugucucagaaaacaaaauguaacaagaagaaacuguaggcuuuguccaaacuaguuuuauggcuugagagaauaugagucugugcuuuguaauccggaagcuaugaaaaggguggagcccugacaaagaugaagaagcaaguugaauuagggaauguccugcuucagucccaagggugcgacuccugagguuaaaguauggcuguccucauguuaccagccucuauggcaaagacacugagaaagaauacaagaguagaaaucagaaaauuuagucuucaagccaacacuguggcccuggggaaaucuacaccucccguauucugugcaguuagcuaacaagugaagcuaaugcacagcugccuuggcagccuuccagaguugauuugcacaucaaauaaggaugcauaucagggucuggagagaugacugagagguuagagcacuuacugcucuuguggaagauccaucggagcucacagacccugcaguuucaguuccaggguaucuggauaccuccaugggcacuugaaucacauguauacacacauggugcacacacacacacacacacacacacacacacacacaguuuuuaaaaaugcuuacaguacuaggaauguagcucaggaguguacacaaagccuugaguguugucccucucacccucaguacguguacaaauacucuuguuacugcaauuccccauguaauuauagggcgguuauugcacuucucaguucaaacuaaaaauuauuuguaguuaggacuagagaagggaaaauaagaaaaaugucaaaaucuuuagcuuuugauuaaugaaaaguauagaaacuugagucugaguacaugcaucugaaaacuugguagacugauuugggagacucauuuggaaguuuguaucauaacagugaucacagcuaaaaaugcagguugcaucuuauuggaugugaccauuucacgugccuuuaggcggaaguaucuaugaagaguuuuaauuuuuaucugugugguaacaacuagaagucacccuuuuauagauugcuuuucuguuacggugaugacuaaaagcaacuuggcauggguggggaagguuuguuucuuccaucuuugaggaaaguugagcagggacauagaggcaggaacuguagggguugcugcuuauuggcuugccccucauuucugugcagcuagcuuucuuaaauagcacaggaccagcacaggaccagcacaggauaguacugaccagaguggacugggcaugcuguauuaaucgccacucaagaaaaugcucauagacaugcccacaggccagucugauugagcagccccccagugagccuccaacaacucugcggugugucuagcuaggagaauccucuaugccuguugcugugagcuagaugguuuugucaaggcucacauuucagaaauguuucugucuugcuuaccuccugauauauuauuugugacacuucucagcacugucagugagugauguacgugugcuagcgggggcacagguucucagcacugucagugagugauguacgugugcuagcgggggcacagguucuggagccaacugaguugaagcuuaacugucaguugacagaguuguguuuacuuaauucucgcugccucugcaucgccaucuguuacaagggauaaugucuggggaaaggcuauugagaggauuucauguugaacucuguauaaacauuagaguuagucauuacaauaguugcuaauuugacaguuguccaggaaugaagcacuugaacaaaaagaacgaauccgauagcugggaggaggagaugggcuuuagaggcagggcaugugagccugcauucagucuagagcugcccuuugcuuugugguucuggcagacugccccucacucagaccuucucgggguguuacaggagucauaguucaucacuaccuagcagguuguuaugaaggggagaugagaugauguagaaacaccuggcccagaagugcugcuaagaaagugaggcugcugcugacacccccaccccugcgacaucuguggagagagcacuucugagaauuagauuuuuguugucuuacaugguuuuugguuuuguuuuuuaauauuaauuuuuagugguucuuucauagcucugguuggccuggaacucacuguguagaucaggcuggccuugaacucacagagauuaaagaugugugcuaccacaacugguaacauuugccuucugauuaauuuguuggcaauuuuaaaaugccucagguuauuuguuugcuuacaguagagcagacagcagcuguaugaguggguggauaagauucaaaaaguacauuguuagguuuuguuucccucccugaucugcaguuuugaguuugguaaguacuagauacuacuuaaacaaagaagguagacacuguuaaccauagaauugucuguaugccucaaaagccuucacaauauuccaaacaucuaaaaucagcuucucagaguuaguacaguaauaaaaccuguuuguuuuauagaugaaaauguaaaaauaguaucugaacuauucauuaauguuuuaucuuggaugugaacuugcccaaguucugacaagacaagguggucuuauugcagaugugugucuacauuaaacauuguuaccuagugugggcauguucauagacuuguaguacaucgcauaauuguauaauaaauacagugaugaacuacagugaucuagcaaagaacuugcaucaaaauuagcugggauguggucuuaaaauacucaugcuuuaacccccuacacacagacuuuauuaaacuggaaucuucaagaguaaaauaccaggauaugcauuuaaaaaugauucugcuauauaugccacuuuaaaaacaacuagauaauggccaagaguauagauaacuagacagcuuuacacacuaguaauaugauuauauaaauugauagaguauggccaauagaacaauugugcagcuagauaaaaaguuuuaaaaucuuuccucuaugaauacacauaugcacagauuuauaguuugauuuuuuuucucuuugagacagagucuccuuacuuauugcucaguuugccuccagcucaagguuugucugucuccaccaccucagucaugcacuggcaggcgucugauaguguacccuggugaagggaacagucuucaagaguggcuauguaguagugcaugccgguaaucccagcacucaggggcagagguaggagagugaugacugugaggacaguguaggucacauggugguacccugacucaaaagguuuuuucuggagacauguuuguauacuaaaaacuuguaagcagcuaauugauuuauaguacacacaugguugaaucuauuaaauugauacuacaguuuacuauauaaccguuuaaagaauauaguauaaugccacagagguaguguauaccuuuaaucccagcacuaaggagguagaggcagacagaucucugugaguucgaggccagccugauccuuagggugaguuccaggacagccacagcuacacagagaaacccucucuaaaauaaaaaaaaaaaaaaaaaaaaaaaaaaggaagaaggaggaggaguaaaguauacaugugugaagauuacuuaugcauccuaaaguugcuauggaaguaagcaggacuuuuuucuggauguggugguguguuucuauaaucucaggaccugggaggaugagucaggagacuccccaguuuaaggacagccugggcuccauagcugaugcuaucugcuuuaugucagaaugauguagguuuaaugucugcauaucugaaugugaaaauuagguauaaagagcuuguauaauccuugguuggcuucuugccuauuagaauuuuaauacuuuuuaauucucuucaauuuuaggcucgaugagagaaagggaaaguuaaggaugcuggagcagaacaauggauuucucuuucucuuucaugcaagggaucaugggaaacacaauucagcaaccaccucaacucauugacucggccaacauccgccaggaggaugccuuugauaaccacagugacauuguugaagaugguggcccgacacccuuugaagcuacuuugcaacaagguuuucaauauccaccuacaacagaagaccuuccuccgcucacaaauggcuacccaccaucaaucagcuuguaugaaacucaaaccaaauacccgccauauaaucaguaucccaaugggucagccaacgguuuuggugcaguuagaaacuuuagcccuacugacuauuaccauucagaaauuccaaacacaagaccacaugaaauucuggaaaaaccuucuccuccucagccaccuccucuuccuccuccuccuccuccuccuccuccuccuccuucgguaccacaaacugugauuccaaagaagacaggcucacccgagauuaaacuaaaaauaaccaaaacuauccagaauggcagggaauuguuugagucuucccuuuguggagaccucuuaaaugaaguacaggcaagcgagcacacaaagucuaagcaugaaagcagaaaggaaaagaggaaaaagagcaacagacacgagucaucucgauccgaagagcggaggucacacaagauucccaagcuagagccggagggacagaauguaaguccaaauguucuguguagcuuugucgucucuguguuuacuggaaguugggaaucuuuuuuauguuuuucuuuucaaauaugaauauuucuagugaguucuugccauuggcaaggugccuggaaauauaaugaauaaauccuugaugagaagauaauaggcauuauuagugaggaaauaucuuuaacguuuuugacaccgagagucuugcuuccuuuucucuccucucaccuccuucuggggcuuccaagacaggcuuucucuguuuaaccucgcagucucagagcucacucugcacaccaggcugacauccugagauccaucuaucccugccccuugagaggcuucauuauuuucacuuguuuauaucaaacucuugguuuuggaagauggagacgaaagccgaaggaaaaggggauuuuauaucaggccagguuugcugcuggagccuagauauaagaugguucccacacguuugcuccucccggggcuggggcuugcaucuucaguucucacacucagaagcagaggcagaugcaggcagguggagggagcccagcaaauuccaggccagccagggcuacacagugagacccugucucaaaaauaaaauacaauuaagacacauuacuuaaacauauugauuagcucuucaaauggaguuuuuaucaaagcccauguauacugguggauuauuuuuuuuuuuuugguuauuaauuucuuuaguuuuuuuuaagcauauuuuuuuaaaagauuuauuuauuuaauauaugugaguacacugucacucucuucagacaccccagaagagggugucagaucucauuacagaugguugugagccaccaugugguugguugcugggaacugaacucaggaccucugggagcacagucaaugaaugcucuuaaccacugagccaucucuccagaccccucuuuaguuuuuuuaauccaaaggcaugagccagcaugcccagcucugguaaauuauuuuacuaucugagauuugauugugaauuucauggcaauaagauaauaauacuaaguauguaguagagcaguucuacuuauauuucuuuuuucuuuucuuuuuauuuuuuuccuuuucuuuuuuuguuuuuuuugagacaggguuucucuguguagcccuggcuguccuggaacucacucuguagaccaggcuggccucgaacucagaaaucugccugccucugccucccaagugcugggauuuaaaaaggcuugcgccaccacacccuacuagaucaguucuaccuugagugaaaaguuuaugauauaaacuauagauguuuccuagauaugcauuuagggagaaacaaauaaaugcuuacuuugugauaguuauuuaccuuuauguuuauuuaccuuuauguuucauaugccugaauagguuaauuuauugucuuuaauuuaaagaaagauuauuuaauugaacauuucuuagauagcuggauucuacuauuuaguaugacuaaaaugugauuggucuuccccccacccccucuugggauaaaagucacaguaagucuagguugucaugagucccacauguaguauuucauguauuucccuauauuuucugucauuuucuuauucauuuaacacauguugguugaauaucaugucagucacuguucuaagaauugaaaagguauaauugaaugcaaagcaaaagcuaucugcucacagguguuuauauuuuaguucauucucgugugaguguguguguguguguguguguguguguguguguuguaaguauguaaguauauggguguuuugucugaauguaugucuaugguaccacaugagugcagugccuguggaaacagaagagagcauuggaucuucugcaacuggaguuacaagcaguacugauccaccacaugggugcagggaauuuaacucugguccuuuggaacagcagccagugcucuuaaccaccaggcuauuucuccagccccucuuucccucccucucuuucuguuuuucuuucaguguuuuuuuuuuuuuaaucagcauacaaugaaauacucucugaaaugcuguuuuuaaagcugugugugugugugugugugugugugugugugugugugugcaugccauacagcauguguggcagucaggauaacuggagaguagaugcuccucguucaucauguugaucccaggaauugaacucagguugucaggcuuggcagcaggugccuuucucuuggagcuguuucaccaguccccucuuguguucucacgcauguucaugcaugugcaugcagcuauccauggaggccagaagagggucuuggguccccuggaguuaguuauagccugcugugagccgcuugcuguggauguugggaacugagcuggguucucugggagagcagcgacuacucuuaaccauugagccaugucuccaacugcgucaugagucaugagguuuuuuguuuuuuuucgaaacagaguuucucuguguaacccugguuguccuggaacucacuuuuagaccaggcuggccuugaacucagaaaucugccugccucugccucccaagugcucaccaucaccuggccuuuuuuuuuuuuuuuuaauuaucuucaguucuuaaugcugucuaacaaaugucccacacagaaccagcuuccauagugucucauauugacuuucuguugaguaaaugaauaaggaggauagaaguuaguugugcaccacagauacacucaguauagcacuucuuuuacucuagccuugcacaggguaggcacguguuguaccacugagcaacauucccaaccccacuguaacauuucuugccuagauguuaugaagagacauggguacacaaaaauccacaucugaauuggcuuuuagcuuaguuucugagaacugcuguguuugccuguaaacauuaguaguuuuguucuuuuggagaauaugauuuuguuuaucucuuugagaaauauuuagcuaauguuguuaagggcuuacauucuaucagaauuuauuugcauauuuccuccccuccccccucccccuccucucuccccuccccucuccuccucccucccucccucccucccucccucccucccucccucccuccuucuuucuuccuuucuuucuuucuuucuuucuuucuuucuuucuuucuuucuuucuuucuuucuuguguguugauuccaugucucagcuguuuggaaugauauggauauggacguagcuguagaucucgcucugagauccugcuuucuguuugaggugcaacuagaaaugcagcuauuagauuagggagggauucugcuaauuuuuuauuaauuuuuuucccuauaauuaaaaagaaagaagaaauuuuacuaggaaauagaucuucccauguaguaucaacugcaaauauuugaaagcaguauacacucauaaucucacaaaggucaggcucaggugaguaagacguaaagaagagccgcagcucucuguccgcuuggaguucuccucuuccucacagugacaguggggaccgggaagugggagcuugcuucuucuccucucacaguugauggaggaggauuccauacucagaagcucucugguagcauucucuaaacccuuauuuuucaugauucugaguauuugacgucauuauuuuuuuaguuguucuuuaacucauuauguaggucaggcuggucuacagaaagcugugugccaccacauccaguuuuaacuuuuuaaaaaaaaaagacuuauuuguuuuuauuuuauacaugaguacuuuaccagcauauaugucuauaccauguguacacaacacccaagaaauccaggaagaggguguuagguugucuggaacuagaguuaagguacagguguuuggccauccugugguugcugggaacugaacccagguccucugaaagagcaaaagugcccucagcugcggacccugcucucuaacccugcuugacucucacuggccguuucuccaggaaagccugucacucuucccuucccuccuccuaagauguccucggucugugcguuccaggcugcucugcucuugaauggccgcagcuuaccuuccucuuggucuugaaugcuggaauugaggcuugccccagcacaacugguguacagcuucucuuacuuaaguuuaugacgcuguuuuucauguugaccaauucaccuuaugagcccagagaucucuaaaugcccgcuggcuuucuguuuuguuuccagguuagcacaucugugacauguggcauuuuugcauggaauaggggaauuuagaguaaaucuugggcuuucuuucucuuucuaccucuuuccuuugaaaaugacugaaaauuucaaaucuuuuuacaugaauuugacaauguaucaaaauagccugaaagaacuaccaacaauuauguugggugguggugaugcacaccuuuaaccgcagugcucgggaggcagaggcagggggauaucugugaguuugaggucagccugguccacagagugaguucuaggcagcuagggcuacauagagagaccaaaauaaauaaguaaguaaacaagcaaaccuuuccuuuauagaaauuuacuuuuuuuuuuuuuuuuaagggagucucauuaguccugccuugguggccugcuccugucucccaagaaaauuuugcuauuuacagaaaaugcaaauaauacaaaaguauagauuuucuuuuauuauuucuuuaaucucauuguccaaaacagauaauuacuauuauauguuugucuuauguuguaucaagucuuuucaagguacacuuugguuuuuuuguuguuguuguuuuuuuuuuaaauaaaaaguuugaagauguugauagauguauggauuacuucgaaauaauacuauaauuacaaucucuaauuguuaaauuuguuacuuuuauauuuuuuguguuucuguaggauuaauuccuagaauguaguuguugaaugaaagaguaaacauauuguagacuuuuacuagcugauuccacauugccuuauagaaauucuuuguuuucucugagcuuguaggaacugaagugccucacacaugcucuggcaagcacucugcuguaacuauaucacuuuuaccugccuguaaaaugucucaguuauagauauuaguauguguguauauggggaggguuggagcacagcuuuggguagucaguucuauacuucuuuucucaccccauguuuuucuuuuccuuucuuucuuucuuucuuucuuuuuuuuuucuuuucuuuuuuuuuuuuuuuugguuuuucgagacaggguuuuucuguauagcccuggcugaccuggaacucacucuguagaccaggcuggccucgaacucagaaauccgccugccucugccucccaagugcugggauuaaaggcaugugccaucacgcccggcuccauguuuuucuuuuaagagaaaaauucuguuacucuggcuggccucagcucaagcuguccuccugccuuagcucucaaguaucugguuuuacaagucuguggaacuggacccaacauggacauuuacuuuugaaaugaucuguuugcuugcuugugcuguagugugucuguguaugccagcgugugagugggagucagggaaagucucugugcucuguauuguucucggggugaacucaggcuggcaggcuugguggcaggcuuggcaggcuggcacuuucaccauccugcuagccacaaguucacuauuucaaaaacuguugauuuguuuaacuuucuguguguguuuguguuuugccugcauguaugucugugucccaugugcaugccuugugcuucuggaagacagaaaaaggcaucgcaucccugaaacuggaguuguggaugccugagucuccacgguuuuguguuuggaaaccaaacccagguccucugcaagagcagccagugcguuuagccaaagagccaucucuccagacuucugaaguucacuuuaaaaagaauguauuucuggggcucaugauuuaaaaaguaauauaauaguuugcacuuugaaauuuuauauuucuuuacuuuaaauuaauauuuuaauuaauguacauuaugacauuuuuauaugugauucuccacuuacaguugcauaagcaccacccuuuucugacacccucaccgcugucuugcuggucccuucagacaaagauccaucuucugcuuucauuucacaugcauauaugcacauauauacacacacauacacacacacacauauacacacauacauauuaccuuuauauuuaaucaguuuuauuuuuauauaacucucuuaaagacgauuuauuaauuuauuuaacuaugcuuaugugaguuuguaucuaucugggcaugugcacaggagugcugucagaggccagaggccuuggagcuggaauuaccggcaguugccagccuccagguguaggugcugggaacugaacucuacgaggacaggagcucuuaacugcugagccaucuccagguccaauccuagccccagccccgcugucuucugguaugguuuuuagaagcaggacugguuugcauaucuccacacuuaacugagugccuuuucagaaacaauuuuagaaaauuuccuggacaaaaaucugaaaauuuaagucucuccauacacauuaccaaaguacuuuccagaaaaauuccagguuacagcuuuaagcugucucaguguccuguuuuuccuucagucugauuaaaaaaagaaaaugcugagaagaacucauugaguaaagguccuuucugaggaagccuggauaccuguguucaaugccuggaaccuaccuaaaggugggaggagaaggaaaggacucccacgauguccucugaccucugcacacacaucagacagaguaacagguguggggaggugggagaagaaaucaaguuuuaagaaaggaaaaagccagucugcuuaacagugcuguuuaggugguaaagugagcagugaguucuaacuguaguguggaguggacagguuaaagccugcagcaccacaucaguguacguccugucugagguuuacugccucuuuauucuguccccuacauuuuucugccuagagaccaaaugagaggguggacacugcaccagagaagccaagagaagagccagugcucaaagaggccaucccggugaguggcuugugaauacugcgaccagguauggugucagaaggugacggggcuggagagauggcuuacugauugugagcacugguugcucuuccagaggaccuagguucaguucccagcacucgaacgcuggcucaguuccaggggauccaacacucuucugaacuccagaggcauugagcacacauguucaggaaaaauauauucaugcauuuagagugaaauaaauaagucuucaaagaacaaagagaggugacggcauagugucugguuguuaguaguccaccauuaccauucaugcccaucuguagucagagagcacuaaaaacccugggugcuuuuuaggacuagguguuuacuaugagugauuguccuuuuauuuacagccacgauccucuguuuucacugaguucccaagaugccacagaaaccagugguccuguuuucaguauugaggauggccuuauuauuuucccccauucuuuuuuguaagcuauagauuagucgauaccaggcgagaguguaauugaagauaauuuuuacauuguaagcacuccauguguguccaugugcgugaguauggguguguggaugcugcagcucacagcuuggaggucagaggacagaccuguguguccuuccaccuuguuguggaaauggucucuguuguuugccccugugugugccaggcugacuggcucacaagcuucuggagaauguuucuucuccaccucucaucuccauaggaacacuggaguacagauaugugcuagcucacuuguuggugccucacgcuugagugacaggcaccuuauccucuaagccaucugcccagcccuaggagcacuuagcauguaauuuauacauaguucucucccuucccgccuuccuucuucuuuuauccuuccucucuucuucuacccccccucuuucucuucuuuuggaguuuuguggcauuuuucuguagguuccuucuucuuucucucuuucauucuuuucugauggaguuuugugaccuuuuccuguagguucagccaauacugucuucuguuccaacaacagaaacauccacugguguuaaguuccagguuggugaucuuguuugguccaaggugggaaccuacccuugguggccuuguaugguuucaagugauccccagcuugagguccauuccaaaauuaacacaagagguaagaaaaguaauaaauagauauuaaauaacaaguuugcaauaaagcaaagugaacauucaauguuauaugugaauguaagaauauacaaauauauauuaucuggcauaaaaauaugaauaucagauuuuuguuucuucuugugauguguuuuugauacaggguuacuuauuguauucaacauugaccuugaccaugcagcaauccuccugccucugcuccucaggauuuccucaguuuuuagugacaaaugaaauaauuauggucauuuuaaacuggcagagaacauaugucuuuauauaacuagugucuuuauaucugacuauguagcccuggcuagucuggaacuggcuucauaguucaggcuggucuggaacuucgagaugcccaccuccaccuuaugagugcugagcacugcaugugucaccacacccagcccuuauaauaacuuaauaaaaauauauuagugugagugcauguguguguguuguguguugugugugugugcaugugaguguguauuuacauuuguauaugcuggugccguggaggccagaggaagguauuagauccucagaaguuggaauuacaggugacuuugagcugcuugacaugggugcuaggaaucaaauuuguguccucuugaagaguaguaacaagccaucucuccaacccucaauaacuguuuuccccaaaacuaggaguugaaaugaggguuuugcacacaguaggugagcauucuccgaccaaguuuugauaacccccugauguuuuuguuuuucagagauuuuuuuuuuuccuuaacuuuauauuauguauugggaucuguguacucuguacccacagagagaggccagaaggguagguguguuagagcccuuggagcuggaguuacagacaguuagagcugccugauguggaugaagagaaccacacuuggguccucgggaagagcguuauuuaacuucugaggcaucucuccagccccuucauccacagaccucuuaguuaauuuauuaaaggaaaaacauuuuuuggucaucugggagaugaaucucugagaguaccugagggauucucuuaguuguguuaguaguugugggaagagauauguguagugccagucccuggacauugcagccaugcugugugaaagaauggagaaaggcagcgauugguaugacucaguggguacuagcaagccugcugaccugagcuagaacucuggagccuguauggaaggagagagcccacucucuggaaaaggugaccgcugugcugcccacuacccagugcauaaacguuuuguuuguuuguuucuuucuuucuuuuaaaaaaugucaaagcagggcgugguagaguagcguaugcuuuaaccccagcucuaugggggagaugucagcagauaguaacuucuaggccugccagagcugucucguaggcaagacccugucucgaaaaaaauuaaguaacuaagcaaauaaauaaauaaacaaacaaaacuaaacuaaaacaaaaaauggagagcguggacugagcacaagcaugcacuaauucauugcuuucugcucuugauugugauguagugugcgcaggucuccugugcucugacauccccgcugggguggacugcagcuuggaacugugagcuuaggcuagccuuggacuagaaaugucucaccucagucuucuaaguagccaccauaccugucuccuagauuuguuuagaauuucuuucgugguuccucuuguuuguuuguuuguuuguuuguuuguuuauuggcuuuccgagacaggguuucucuguguagcccuggcuguccuggaacucccucuguagaccaggcugaccucaaauucagaaauccgccugccucugccucccgagugcugggauuaaaggcgugcuuccuuaucuuaaagacacuaauuuacuggcuuucauacuucacuuaaaaaugaaagcauauuaguaagugauuagauauuuuauaugaguuuaauguauagacuaagccuuuuuugagcucuccuguguuuuguuuuauuuuguuuugauacauucuguagagucugggccauccccuucugcuucaugauucugagcucagggcuuacagacugacuucaccgugccucacucaggugaacacaaguucacuauggauuccuaugcgagucauuuucacugaaacaaggacuuuucaucauauuaaauuucacacggugauuguauuaacuuucacucagugcuuuuauucucuucugacucauucaugacuguaaauauaccuggaaaguuuuugagaggacagacauaugccuuggaucuagcaauaauagauaacugugccuuaggaguguuacaagcuaagcagagcuauaucuaugugugcuuuguccaagcaugauauauuccuaagaaucucccaccuggaagugauugcuaaguucaaagacaguuuggcuuauaauuuauuucugaguaccugcuuugugaacacaucuuuaucaucuguugacuucuucauuaucugugacaauuuuuuucucuuuucuuucgacauuaaauuuccuuuuugauaccugugcauuauuaaugagaagaaaaaaguaucuagaggucagauuugugggguuugcccuacuggugacacuggcuauagcuaagaaucugccaaaguauaguaguaaguauuguuuacuuucuucuuggcaccaugugcugauuaaaggcugggagaguagauguggggcaggaaugaagaaacucaaaguuguuuugcaagguacuguauuagaugguuguauuauguauuucuuaauuuuuuuuaaaagcacuuucauguaaccuaggcugcccucaaaguugcuaugaagcugaggaugauguaaaauuucugauucuccugccucuacccucugcuggaguuauagcgugcaccaccauaccugcuuaaugggugcugggaauggacccagguccucugcgaguaaggcaagcacagcugagcuaccucugcagccuaccuagugaauauuuccuucugugaugcuuaaagcagcuauccaugggguggauccugugucucagcaaaguagucugaaaaccacguucuaauccuugcucuacagccagcugcgccccugcagucauaacucagagcaguacaugugggaaaagggguuaggucagccuugugcuggaacuuccauagcucuguucauggagaaugggcaggcguugucaaagaagucuaaaucaauuccugaacuaaaacaguuccuguccaucuauaucgagggcuuaagagcuuucaaagugauaccacccgagagucauggcucuccucuucucuccucacaagacagcaaucucuugagauuaaggaguuguuuuuacaaauuucuuuuuaaacuuucuuucuuguaugugugcauggggagggagaggcgugcacaagccugugggugcccuggaggcuuagauccccugagcugaaguuacagccgaguccugaacuuccugaggugcacugggugggaacugagcucauccucugaaggcauuugcagucuucacugcuugagucauuaauucauccacuaaucagaugacuucaucgaggccaguuuuuauuuuagugcuagaaaauuuguuuauauuacucuuaguaauuugagaaucuagaauugaaaaaucauucauguuuugauuaaaagcaugaauuguauuuugucauaaagcuugaggugggcuagagagauggcucagugguuaugagcaaugcccacucuuccagaggaccuggguucaauucccagcaccuacacacaaucuuuaacuccaguuucaggaucugauguucucuucaggcuuucuugagcaccaggcacugaugcauagauacacauaugugcagacaaaacacccgcacaccauauucagaaaauaaacauuuuugagguaauuauuuuucucugcauauuuguaauuaauagacauguaaaugaagauuuucuuuuuccuggggaggguugguguuuuguuuuguuguuguuguuguuguuguuguuuugucacuguguugcccaggaugaucugggacuuggagccuuugggcuucugaguacugugucacguagcauggauguuuacucugugaguguguagguguguucaccugugcacacacacugaccuggaggagggugcugggugucucauuguauaucacugucuacuuuaucauucccuuugcaucuggauuuccuacugaaucugcaguuuagcugauggccagaaaacccagcugucguccugccuccauuuuacagcacuggcuuacaggcagacguaugaggucaugccuggauucucacccuggugcugaggauaugacucacauccucaugccuguacaucaagugugcuuaucugcucagccaucuucucuuuucucagccucaugccucaugcgugcuucucuccccccccucccuccccuucuucucuucucugugacagggucucaucaugcagacuugacuggccuugaacuugaagagaucugccugccucugcuuccugaguguggaauaaagcaugugccaccugccagcaugcccacguugccuuuucacaccaacaauauuuuuaaaguuuucaaaaguacauaguuuuuuaaaagcauggguguuuugccugcagguguguaugugccccaucugugugcguggugccuggggugcaggaagaguauugcauccuuggaguagaguugguugugagccucugugugggugcugaaaaaagccuggucuuuuuguauaucacugauauacaaauauaacacugcaagagcaaugugcucuuuagugcuuugccuucuuuauagccccuacuuuaaagacuuucuuugacucugaagucuuacucagugagucucuggguguaagagaagguuggggcaucuugagucguggcuugugcuggugccacagcaugcacuggggcacuggacacuugauuguggagucguagaacugcuugacaucuggccagcggcacuugccugcugcagucucuuccgcuuuaacucuggauggagcgagcacagauauggugcugggcaaccaugucuugguagcacuaugugaagguaccagcaguggucaggucccaauacucucuguacaugcugucuguaccacugcacgaguauaugcugugcugacuucccaaacacccgcccacagagcacugccuaccccuaacuaaaccaucuucuuuagcugugacacaaaguaccagaagugggauucggucacauggcuggguacaaagaagggcauccaggacagugguggcauguggcacgucgggaugggcaagcagcacccuacccugcaccccaaagugugcccaaggcccucauggcagucaguccucauaacccccacucauaaaaggauuuuuguuuuuguuuuuguuuuuguuuuucgagguuuucucuguguagcucuggcuguccuggaacucacuuuguagaccaggcuggccucgaacuuagaaaucccccugccucugccuccuaagugcugggauuaaaggcgugugccaccaccgccuggcacaaaaggauuuuuaacagacuuaauucugguuguggguaugugcaucugagagucucuggagcuagagguagaggaaguuaugagcugccugaugugggugcuggugcagacucuaguucccuggggaucccucgaugcucccaccacugagccaucucucuagcccugcauuauuucucggauauaaaaucauuucuucuaaaauacagcuuuugacagaaagcuuagaaaguugagucagcuauucagagacacacguuugcuucuuuaguuuucaugucuucaggauuuauuuuauuuuguuuuuacuuuugcuuuuuagacugugggugagaacaacugaggauugaacccugggccccuguaaguguucuaacagggagcuauacccccaggcuuuuaaaaaauuguuuauuuguaaaugacuuacuuauguugauguguaugaguaugugccugcauauauuaauaugugugcacauaugugugccuggugcccgugaaguccagaaaagguugucagauucccucgaacuggaguuaguugugagcugguguguuggguucucugcaaaugcucuuaaccacaagucauuucucuagccucuuauuuuuuauuuugaaaccaauucucacuaaacuuccaaagcuggccucaaauucuuaaccuuucuauucugccuccagagcuaggauuacaggcguacucguaaucuuuuuuuuguuuuaaagauuuauuuauguuauuuaugaguacacugucgcugucuucagacacaccagaagagggcaucagaucccauuacagaugguugggagccaccaugcgguugcugggaauugaacucaggaccucuggaagagcagucauugcucuuaacggcugagccaucuuuccagcuccacuuguaaucuuuacauacuaacacacacacauacacaaagcuacuucuuauuuauaauaguuuuuuaauuaaaaacuuuuuugagauuuuauguguaguuguguuuugcuugcuuguauguaugaacaccacauguacgacuaguuccugcagagaucagagaacauuggauccccuggaacuggagauuagaucgucucaagccaucaucuggauguugggaauggaaaccugguccucugcuagagcaacaagugcucuuaaccacugagccauuucucuaggcccuuuauaauaauuuaaauuuuauuuuggauuuguuuuauguguaugaguauuuugccagcauguauauauuugcaugugugugcagugcccacgaggccagaagaaagcaucggauaccccggaacuggaguuagaggugguugugaacacguggugcugggaaucaaaccuggguccucuggaagaacaggcacugcucuuaaccacugagccaucucuccagcuuaguccccacacuuuuuauugaucugauaaauuuuucugagugauaaauuuuugaaauuaucuuugauaaaggcccaacuuuuguucuaaaaaagugaaagcccuuuuuuaaaugugaggugcaagcucacugucuguccagauguccuaaacagugucaaguuguuauauacauuuuaaauccuuugagcucauuugguuuauuuuagaaagauuuucuuuucaauuuuuuuuucacuuuugcugaauauauguguguauacaugugaguaccaguaaagggcaucagguccccuggaacugggguuacaggugccagggugaguucacuccgagagagccacaagagcaccugaucucugagccauuuccagccccucuguuuaacuuauaguaaguaguccagcuugcucugcugaccauggcucaggaguacuuaauaggauaaggugggacauuacguuggaagucagccuuggcuaacuaacuagacccugccgucucaaacaaagagcuuugauaguuuuuguagguuauaucuaauacuauuuaauuuagaaauuaacuuuuagucacuugcaaauuauuucauauaaucauuaauuauggguuugguuuuuuccuuuuccuuuccuuuccuuuccuuuccuuuccuuuccuuuccuuuccuuuccuuuccucuccucuccucuccucuccucuccucuccucuccucuccucuccucuccucuccucuccucuccucuccucuccucuccucuccucuccucuccucuccucuccuuuuccucuccucuccucuccucuccucuccucuccucuccucuccucuccucuccucuccucuccucuccucuccucuccucuccucuccucuccccuccccuccccuccccuccccuccccuccccuccccuccccuccccuccccuccccuccccuccccuccccucccuuucuuuucuuuucuuuucuuuucuuuucuuuucuuuucaacuguuuucuuaaaagauaaugggugcuggaggucuggcucagcaguuaagacuacuugcuguucuuuaggagacccugaguugccagcacucacacaaggcagcucacuacugucuaacccuagcuccuggaggcucugucuccucugaccucccagaguuacucauauauaugcacauacccacaccauucacacaaguguauauacuuuaaaauaaaauuguaaaaacaacaguuacugaggggcuggugagauggcucagcacuugcugccaugccugaaaaccuuuguucaauacacagaacccacauggugggaagagagacccaacuccuaauguaauaugauuuucuuuucaaaguuaauggaggaaugauauuguuuuuaaauauuugcagauuuuuaaugucuggcuugauuuucauauccauuuuacauucaguuaugauuugcuguuuugguugcaaauggaacauaaugcugauucauacaugugcaggcuaggaaagggaagagugguuuaacucuuuucagaucacugaggagaguuucuucacuacacccaagcucaagggguagaagguaaauuccagauggaaucugaaaucauuucagugaacauuuguccuuuguuauguuaaaaucuccugguucagcuaggacaacauuuaaucccaguacuugggaagcugagacagucaaaucucuugucuguuugaguccaggcuaguccagaaugaguuccaagccagacaggaguauacagugaggcccugucucaaaagaaaagaaaacaaaauaaccccugcaaaguuguuuuauauaggucaaaguacuauauugugcuuugaugggucuuuuaccauccaugauuuugugugcaugcacuggccauuuaaaaaauucuugucuuaguaagaucuuucauauguugacaaaucccuuuguagcuauauucucuuucccucccucccucccucccucccucccucccucccucccucccucccucccuuccuuccuucuucccucccccucucucuuucucuuccucucucucucuccugagagucuuucuguguagccuuggcuguccugaaacucucuauauaguucaggcuggccugagaguaagagaucuacuuacaucugcuuuccuuguaccagacugaaagcauaugccaccacgccggcuagguguucuuuuaagucaucucuucucagaaucuuuuugauauugagaagauggaagacuaaaagaggcaaagacagguuuuccagaauuccaguaugauuugaaagauuaaacuguaucauugauaacaaauaauguuguuuuccuugaaguaggacuucguucuugagagauaccuauaccuucucacaucugaguaacugcagaaaggcacauugucuagugauucuggugcuccaccaugcucccagaugaccuuacuccgugcuuccccagggcggccuucacugucagucggcacacgugccucaugcuuuuccuuugcuuucucauugcacagcauauuaaagagucagaugcaaguaggagguuuaggaaaauuaguaauuuuugcucauuugucaaggccauugcauaaaacucuccuuuaaaaaaggugccaguguguagcagugaggcaccucauggcuggauguaguccugugcaguguuuguguugagauuccaggaguuuuaucugcuacugcuuuucugccuuaaauguaaagagaaaucacugugguauuguuagugaaucacuguaggggucacaggaccccuagaacagucucauguguauauagcuaacagaaugauuugaucaguguuugccucuuaaaaguucaaagaaaaauguucuguuuuggugggaaauguuuuguguuuuuaucccaauuuguaaaaauauuagagacaaauauauguggauuuuuauguccuaacauaauuaauauaaguuuuuacuuacaggugcccgggaauaucauguccaauuuuuuagcaaccagccagagagggcauggguucaugagaaacggguacgggaauacaaaggucaugaacaguaugaagaguuacuagccgaggcagccaagcaagccagcaaucauucugaaaagcaaaagguacugcagccugcuaauccucaugguuuguuuguuuguuacauuggagauggagcccagggcuuuucccauggcaggcaagcagucugcugcugagcuacaccccacuguccacugauacauuaaagcacagguaucacuuuaaaguuugaggccagccugcuguauauagcaaguuccaggccaugcagagcuacacagugaagcccugccucaaaaaaggaaauaauaaaugcacaguuguguaugucacgcaacauuguaguacugccaagacugugggaagugaggcuauagcucacgugguugagugcuugccggcagacauaaagcccugcauuagaucguugcuuccacacaaacugcacaucugauagaggcaggaggaucagagcuucaguuucugcuccauagaguuuagggcuagccugggauacacaggauccuaucucaaauacaaagaccagcuuaauaaucucuuguaaauugaugugcacaaauccagaagauaguaaugacacuuacuuugauaaggauuguaaauauuuuuuucuguaaauaucuuccuguaacucuucuuuauuaauaaacuuauuuuuaucaaagauuuuaaaauacuugauaagagccagaugugugauaucuguaaugccagcauuuuggaggcuaacauaggagaguccaaaguuuaaagucaacuuaggcuacacaaugagaacuaucuuaaaaacuaagaccaaaccauguaaaaaaguuuaucuaguacuuucugugaaauaaguguuguuuaaaguauugauauacuuauuuaaucuuuauaauaauuuaaauaagguaauaagguauuguucuuuucaacagaucaagaaaguaagguacagaaggcuuaagucacuggguucaucucagagcaugcguuauagaaccaggaaauauuucucucucucucucucucucucucucucucucucucucucucguugauuuuuuuaauuuauuguauuaguuugguuauauuuuauuuguuauuggcauauucauuauacauacucaguuguagguuucaugaagguaauuuuuucaaguauaucaugcaauuaguguaggucucuuauaauucagaaauuucuaauuucuaauuuuuuuauacuuucuauauauuggcuaggaguguccugugcuuuaaccccaacauauaugaggcaggagcaggcaagucugggugaguucaaguccagcguggucuguagaacgaguuuuagccaccaacagcaaacaccaacuaaacuuuaccacaggauaaaauaaaaaggaauaguaauuauuaucaccaucaucuuuauuuauuuauuuugauaaaacaaaaaaacagaguccagaagcaucugauucuuuggagcuggagugguaggcagcuaugagcugccuguucugaguacuaggacucaaacucuggccuucuggaagagaaguacuugcuuuuuggggcagagaaggggaugcagggggugugguucaggccacccuuuguauccuuggcuguccugaaacucacuauauccugaaacuaccaagcuggccucaaacucacagaaaucugccugccucugccuccuaagugcuggaacuaaaggcauuugccaucaugcguugccuucaauacauacgcucaaggcugagccaucuuuccaucuggguggagacauagaggauuuuaauuaauuuuauaagacuuaaauuuaaacacuuagucaucaacauuuaguuuauacuaugccaucucauagucggccucuuuaaaaauuuuuauuaucacuuuuuguuguuuuuccgagauggggucucacuguguagcccugccuggccuggagcucacucuguagaccaggcuggccuugaacuccugcagaucugccuuucucugucuccugagucuugcauuaaaggcgugugccauucugcucagcacuauuauuguauuuauucugucuauacauguauagcucaccugcuacaguguguguggaggucagaggacaacuuagaggaguuguuucuccccuucugucuugugggucccagggaugguuagugaggcguagaggccagcaccagugccgagugccucccuggccccugucuaaacaguucuucuuuacuuugcucauccuuuuauuuagcuucuuucacuuucauucagcgcuuucuuacccuccugccagugcagacucuucugcucagccucuguggacaggcacccaggguuugcuuaccaccaccuuguaccgcacacgcacgcacgcacgcacgcacucgaacacaacaccccacccccacacuggauguccuuuguuuuguugcucccuuggauuuucuccuuucucgucacucuauccuuguuggcauauuggcaucaacuggccacaugucuccacaguaccugacuacuuagcuacacauagaggaaagcggugacucugcaggagcguguuuaauguuaguguuuauuggccccuaaaaacaagucaugucuguagucuucccucucuuucacuaauacuauucaacaaaugugauguggaacaacuccucuuugggguguuguucagcagaguagucaucaaaagaaauguaaauaaaagaacagaccuucaugccacuuaauagaguaauacuaguuuauucauggcauaggaucagcacauucuauuuauuugccuagagaaucuaaaaauauuuauguguauuugaaaaaaauugcagagugcuuggaagauacauguugauuuuaaugugccuauuggauuaaacauuucacacagagacucuuaucuuuuucauaaagauucggaaaccccgaccucagagagaacgugcccaaugggacauuggcauugcucaugcagagaaagcauugaaaaugacucgggaggaaagaguagagcaguacacuuucaucuacauugauaagcagccagaagaggcuucgucccaagcaaagaagaauguuaccucuaagacggaagucaagaaaccccgaagaccaagaucugugcugaacagucagccagaacagaccaaugcuggggagguggccuccucacaaucaaguacugaccuucgaaggcagagccagaggcggcauacuagcuuggaagaggaagagccaccuccuguuaaaaucgccuggaaaacagcagccgcaaggaaguccuuaccagccuccaucacaaugcacaaagggagccuagauuugcagaaguguaauaugucuccaguugugaaaauugaacaaguguuugcucuccagaaugcaacaggagaugggaaguuuauugaucaguuuguuuauucaacgaagguaccucuuguucucuagggguuuggggaaugcuacuaaaaaccacuuaagaaugugauuuaaaucccccuuggauccacugcguucgaagcguacauucucguuuacucugggcgaaaagcucuguucuucccguuuccuucuugugacauccccaucugugguagauuaaucuugagcaaugcagccaacaucgggcuuagcuccugaaagucauggaagaaacugggcaguuugccuguuucuaauuuguagaguuaguuuuucuuuguuguaaaguaugauuuuuauuaaaauuuuucuuuuaucugaauuaaccauugcuauuaaaacaaccuacuggaauaauugugccugcugauuuguuugguugcaccagcaguagguuuuuguuuuguuuuaauuguaucuacacaguucauuuaucucaauguacuuaagcauuauuucaguguguagucaguacagagggauuggugagcuuuuccuccuuucuuucugucgucuaacucuuuugaauucaguguauauccuccuccagcaaccucucuagggcaguauauagcccaagcuagccugcauaguugaguuugacgccaagcuucugauucucuugccuguaccucccaagugcugggauuauagauuacagcugugcagcauacaccuggugcucaggaugcagcccagcacuccauaggcaagcucuguaccaacuaagcucauguuuuacgucuuacuggagaccagccacguuucaggucagccccaugugcuacugugcuggagugugcaggcuuagugaggauuucuugcauaucuguaaaucugcgcauggugaguucuguuaaaaggugugcucaucucugggcuugguagugcaugccugucauccgagcacucagaaggcagagccacaaagaguuaggcuagccugagcuacauagcaagaccuuaccucagaaaauuuaaaaauccagcuaguccugccuccuggccagcacuccuccuaacagcuguacuuaggccuugcucaggccuucucuccguccagcuugaagcugugagaaaaggccacacauuuagcuuggcauugcuguggcagcaguuuuguuagauuccuguuagcuugggauagcuuguugaguuuuagagaagaaauuccauuacuguguuggaaaggguaaucagugguauaagucagccacuaaagcucccucaguccacccuggguuuccaucgcaggcaguuagguuuuggcuugcaggugucagaauucuggaugacacuggacuauguacacgccuuccagcccacuucauaacucaggguuugugauuuugauuuaauuguaucacauguauguauauauuaaggaauuauguucuuucuucaccauuagcauagacauauauagacauuaaaauauugguuaaauauagugaugcuucauguuuagaauugguuuuagaaauaucaagaguccugcauccauucuuucugccuguggguuuaacugaucuccacagcgcuagguuuuccagaacagcuuaaauuuguuuccagcugaugucucuccauguuguccuuuugcuuucucccuucccuucuuccucucacuccccacuccccucuuucucauuuccuuuccuugccagaucccuuaaggcuguugugaguuccacaauacuggugucaggaccaaacuuaguccccuagacaucagcaggugcucuuagccacugagccaucucuagccccaaugugauucuuuugauagcagcauuugcauauuguuugaaugcaaauugccuuuauucuuagagcugguuuuauuuacuucuguaugaaaaauauccucaacacccuaaggcuauuaaagacaauucaagauaaaacuuuuaucuuucggggccagagagauggcucagcccuuaagaacacuugcuguucuuguauagaucugggucugguucccagcaccuaaauggugacuuacaaccuucuauaacuccugcuccagaggaucccaggcuacauccuagcugcugcagguacacauaagugcaggcaaacacucauaaagugaaaaucaauaaauccuaaaggacaaauugaucuuuugaaaaauaaauaacauuuaaaauuacucuuauuacauuaaaaaauaccuaaauuaagaucuaaauuaacugcacuuauuaucugucuguucauguuaccuacuugaucucaguuuguaauauaaauggcauaucucuuuuaucuaacgguauucucaucucaagacacagugaccuuucugccuuugcaauaagcaaccaaaugacaaugguacauauauauaaaaaaaacuguucagacuaggaauuaccuuuuuuuuuuugacagaaaacaggguaaugugaguuuauuuauuaagaauauuugccaggcagugguggcgcacgccucuaaucccacacuugggaggcagaggcagguggauuucugaguucaaggccagccuggucuacagagugaguuccaggacagccagagcuacacagagaaacccugucucgaaaaacaaacaaacaaaauacuuaucaccuggacuuaaggcaaauuuuuauuuuucuuucaagggaucucauuaaaauacauucugauaacgacuaaucauaauugacauuacaaguuugagcaaauuacggucacguuaagccaucuguauaagcucaugcuguuaugugccuacuaacuugucuuuuuauucuaccucauuuuaaaggguauugguaacaaaacagaaauaagugucagggggcaagacaggcuuauaaucucuucaccaagucagagaagugaaaagccggcucagagcgcgucaucuccggaggcaacaucugguucugcaggugggugugacugaggggcgccuggcuccauccucagggguuccuaagaaaguuucauugucaaagguaaacgagggugaaugaaggcaggccauaaugacauacuguguaaguauuucacugugagaguccuugcucuguaugcuaacucuaacuccagccccgggcgacugacgcccucuucuggugcacaugugcacagacguacauggaagcagcauauucaguauuuggauuuuaaaaguaauucuuuuagaaggaaacaaaagaauuagagcuagagaguuguauucauaguucuuuucccuaaauacaagcacugucccauaauuaagaguauagcuguaaauucuaugcugagcaugguggugugcauggaaucccagcuaaaagaaaccagcaacaucccagcucgaaaaaagaaaggaaaagaaaagaaaaaaaaagaaaaaagaaaaaagaaaggcguggggguggggcguuacagcugugauuuguaagccugugaaaucuuuuauaucuuauauugaaggacagcagcuuccucugcagccucaggagacagucucaacccucaccguuugcuccuuuaucuaacucuguuggagacggaguuguuguuuggaugugugcaguguuaguggcuccucauccuuaaaagagaaacgucugagggagggagucggcagcagaggcggggaggucucugugaguuugacaccugucuugccugcauagcaaguuccaggucugccagagauggacaaaacagaaugacaggaaacagcaacaacaaaaacagagaaagaaaaaugccuguauuuagaaagguuguaccuuuggaagacuuuaaggcuauguuuguaucuaaaguuggaauuacuuuuacuuauuuauguguguaugugugcacuugcacacgugccacagcaugcauguagaucucaggggacugcuugugggagacagucucuuauuuauuuauuuauuuauuuauuuauuauuuucuuuauauacauuucaaaugcuaucccgaaaguucccuauacccucccuccgcccugcuccccuacccacucacuuccccuucuuggcccuggcauuccucuguacuggggcauauaaaguuugcaauacccaggggccucuguucccagugaugaccgacuaggccaucuucugcuacauaugcagcuagagacacgagcucuggggguauugguuaauucauaauguuguuccaccuauaggguugcagaucccuucagcuccuugagugcuuucucuagcuucuccauuggggacccugugauccaucuuauagaugacugugagcauccacuucuguauuugccaggcacuugcauagccucauacgagacagcuauaacagggucccuucagcaaaaucuuucuggcauauacaauagugggaaacaguuuuuuaacguggguccuggggaucaaacaagucagauguggcagggagcacccguauucacugagccaucuuagcagauugaagcuauuuuucuuucuuuuuuuucuuucuuucuuucuuuuuucuuuuucgacacaggguuucucuguguagcccuggcuguccuggaacucacuuuguagaccaggcuggccucgaacucagaaaucugccugccucugccucccaagugcugggauuaaaggcgugcgccaccggcagcuauuuuucaaaaagacuuuaauauguaucuuaguuuuaauagaucaugugcuacguuguuauucauaauaacaguacuaugugaaugauaaaaugaauaauuaauauauauuauuagaaauaguauuauauguuauuuugauuucuauagucaguagaaauagaucuguaaucaguuggagagucuuccaugagcaugccgguuccaaggccaguguauccugcuuaguaagaccuugggccaaaauaaaaagcuauaguggggugcgagccaugugugugguuuccugccuguuauccagcacucagaagaccaagcaagaagaucacugucagccaaaguuagcuugggcuauuucaggauagccugggcugcagagugagaaccugucucaaccacucucccauccccauaggcugguagagugguugucugguaugcacacuggccuaaguucaauauuuaauugaacgagaaaaucuuaauuagcuuggucauuuagaaucuuaucuuauaaauaagaguuuauuuuguucuuuaaaagauuuugaaugcuaagaaaugauuuuguaauuuaggaagaaaaaacuugaaccauuucuguucugccauauguuggccacauugaauaguccugggacccagauuaguggauuauuuuuccccauacugaccaucuuagacaccugcuaagcaaccuuuuuugucuauuuuuguuuugagacaaggccucucuucauagcccuggcuguccuggaacucacucuguagaccaggcuagcccugaaggcaagauaccuccuacuucugcuugccuuguaugggauuaaagguguaccacuucgucucuugauucauuucucucagugccagacccuucagguuuaagcuuguguguguaugugugugugugugugugugugugugugugugugugguuucauagcguaugguaggaaacgcagucugccuggacuccccugccuuuugccaccucccacugcugcuccaaccagcaucggcucccacaccccaggcacugcagagacuccagauaacuccuggacucgcuguuggugguugguuuguuucgguguucuuuugguuugguuuuggacgggauucuuccaauguaggccaggcuagcucuggguaacaggacuuaggugagcacuucauugaagcuuaccggguuguuuuuaaagccagcacaggugugcagacaaagggcuguauaguuucuauguccuucuuagguuucugcccucccaggccccuccuguuuccucaucugggaguuuuccacggccacaguugagaaggucuuaggaggcuuuggcacguacagacagucuauugguaauuuagguuucagccucucuuccccaggaguuuguccuucuagugaccagccagugccuagcagcccauuaagaguugugucaccagaguaaaagacagaucugcugucauccacuuaaaggcucugugccaggaacuaggucagagaccaaacaacaaauuaugcuuuuauucauaccaccuagagaauuagaagggauuuaggagggaaggucagagaccauguauauacuucuuccuuuuucagagaugacauuuauuuauuugucagugugcugcaugugugccacugugcacagaggucagaaaaaccugcagaaauggguucuguccuuccauggugugggucucuggggcaaguuucuuuaaccacugagcuaugucacuggcucaguauacuuuuuauuauauuguaauauuauacugaucaaagaaucuucuggaagagucagagucuggaaaguagaaauagaaacagaucucgagucaguagcaaucaggcaagucugugacugaggaaacugaagguuauuuuuugaguugaauuuaagucaaaucugaauuguuacaaaaacuauauaacaaccaccauucuacuugggucaggcagggguggcacaugccuucaaucccagcacucaggaggcagaggcaggcacaucucugaauuugaagucugccuggucuacagagcaaguuucaggacaggacagccagggguagucagaaaaacccugucuuagagggaacaaaagggaagaaagaaaaggacuuggacuagcuauuuaaaaaaacuacggugaggguugcaggacaggguguggcguucacacaggcuugggcacaaguuggaugaggcacagugaacagcaucuuuauccaggaugaagcugggcagggaaguggaacugaaugagggaauagcgaaugucggcaagucugcugucugcagcaugucagacaccaucuaaugcagugaaguugaaggugagcaagugacucaggcuuugcauugacuuagguuuugccaagacgcaguguucgcuuucuuuggcuauaacagcaacaacaaaaauguuuuggccucagcuauucaaauaggcauaucggcuuuuauaguggcuuuguuaacuugucuuacauuaagugggauagccagauguuuauuuacacaccuauucaagaagggagaaaacaaauucuucguuugcuacuggacacuucuuaagugccgcaacuuuuauuaaugggucguuuuuccucuccuccccucagcugcugaacaucauguccuuguguaaucuguuaaguuucaaguucuguugugaacuuugcuuugcuuucuuuaaguugaguguuguucuuugaacuuaggaaauggcugucugauuaucagacauacauuaugagcucggucucugagguuugacuagaaccugcuuucagggaugggugccagggcuuugagcuugccuuucgccuguugccaguguggcuggcaaguacgcuuugucuuuuuaaaucauuaccucucuucuguaaagauaauucuaguggcccaaggauuagaagagaaacucuuuccccauagaagccauugugccaucaucucaacugaaagccaagaguccuugagcuuuuuuaaaaacuuaaauacauaaacuguguaccacugacauuucuaugauuuugaagaaugauauuuauauucauacuagguuacuacauuauuuuccaaauacacacacacacacacacacucuuaagaaaauaagugcaaaaauuguuagugguuuuaaauuguguuuguucauuaaguaacuuucagaauaauuuuuuauuuuuguuuuucaagacaggguuucucuuuguagcccuggcaguccuguaacuugcucuuuagacgaggcuggccccaaacucagagauccaccuuacugucuaccucugccuccuuagugcuggguguaaagacgcgcaccaccaaugcugccaccaccaccuggccagaauaauuuucagaagucacguuccuucacccuguguaagcuauaugcuggguugagauguggcucgguugauagagugucugccuagcaugcacaaagcccugguucaauucccagcaccacauaaacuguuggcuugugccugggagguccagcacuugagagguagaggcagggaggucaggucuuccugaucacccuugacuaugacugugugguguguucaaggcuacgcaggggcagcuucugugacuacaauuugcuaaccccacaugucccucuacacacaagcagguuuuguuugcuugcuuguuacuacuuccaaguuguuuucuuuucuucuagguaguucuugaguaguggugauuguauuagagcacgggcucugaaauccucagccagucucaucaugagggcagacuaucucuugcuuuaguaaacauuuuuaucagcuuaagaagaaagguugagaguuaaagaugguuccagaaccugccuugacagucuguaacuagacugugacucuggugcuagaagcacguaaauuauagcucugaauauacuguugccacacugccagaugagugagguagcccuccuguauuccagccuuggaagguggcucuggagaccagcugcucguuagcccuggguuuguuugauucuugauagugccuucgccugugucuguaccaaggugugcacacacacaaaugugacugacugcuuggacacaagcguacccauacauauauacaugaaaagaaaaauagccagggagauagucaguggguagagguacuugaugaccugagucugauucccaggacccacaggguagaaggagagaaucuauccccacagguuguccccuggucaccacacuggcacuguggccugaguacccauauaaaugcacaugcacagguacacaaaauaaguaaauguggacugccaaacuaccaauucuuccacaacccaaguagugggauuuuucuuuuuuauggcuuugagcuaaggugaaggaaaccauuucuguguaacucagagcugaagacaugugaagguuaucugcauugugcaugggagacacuugucucuugacuguaaaggagguacguggcugaaggucagaggacaaccugggggagcugguccucuccuggguucuggggacagaagucaggucgucaggcuugguaucaugcaccuuuaugugcucagccauuucacuggcacaggaaguaaguucuguguagcaagggcauuuuggucaguuacacuaaagacccgacaaauggcugcaguaaaggcauugcuguucaugguguccagggagacucacucguggcucagcauucuuucaaguugccaggucagcuuuaguuuucacaugaaguccguguaaguguuuaucacuuuauguuuuaaacaacuguacugaucuuagucccagaaucucaucccuuuaaugccagcacuuaggaggcagagccauuucuauaucugaguuccaggucauccaagacuacauagugagagagagagagagagagugugugugugugugugugugucugucuaucucucucucucucucucucucacacacacacacacacacacacacacacacacacccuuucacgcucaccauuaagcuuauuuuacuacuuagcaugaaaaauauuaaaaauuugcuguaauuaguuucccaugauuccuuuuuuguuugucucuacucuuccuguuugagauuagccuccugcagcccuucauucccgacaucacacuuccuaaguguguuuauccaccuucagugucaacugugccucugcuguuuuggacugacuuuaaaacuaaacuagacuagagucccccauauuugugugaguaggaucuuuuauagagcuuagucacgacuuuuaggagcuauuaaauaauuuuguauucccaaguauauaaaaguuuuuacugacguuuaauuaaaauucuguaaauaauggcauuuaaaagucaagagucuggucggaucguaagcaacugaaucaagcagugcguaagcaagucuuuguugaugugugugcuucuaucaucuccuaggcccaguagagaagaagcagcagagaagauccaucaggacucgaucugagucagagaaguccgccgagguugugccaaagaagaagaucaaaaaggagcagguuggcuuccuacauguagagaguuaaagcauaucuguaaugugguggcuuauuucuugucaccaaagaaagauccuccccaccuuggccuccuuccugaacuaucuuuccuccuguccugacgggguugcgguggcgacuucucaaaccgcugucuugugauggugcuucaagcauuuucacagagaacagguuugggagaugggaagccagcggggugagacccugacauucauuuugaaguuucuguuauaagcacaaugaguucacauuuccaugaguuuuccuuggaacuaucauugaguucccuuuuuaaaaacuuugauuuuuaguuuaagcugcugguauauauuguuuuuauuuuucaaacaaaucaaauuaauuuaauuuauauucuuauauuuaagaaucagguaaucauaaauggucugguuuuucuguugguaucacagaucuuuugaaauguuauuuuuuuuuccaguagaauggcacucaucuggaaucaaacugucagauaaacaauauugaaguauaaaguguguggggaggggcuacauuuugauugaauguguucaacugguguaaucgauguaguaauaauauacaugugaaauuaccuuuucaaagaauucugagaagugauucuaucaauuauaaacucgcagauuuuuuuuuuugauuuuuauaaaaugaaugaauacccauuuuuagguaagcacuuugccgcugagcuguccccacucuuuccuuccccuuucuuuacuuuuggagacaggcucucacuauguagcccuggcugacauggaacgaaaucuauagaccaggcuggccaggcauucacagagauccaccugccucagccuccccauugcugggauuaaaggugucugacaccauaaccagcuuuagaauauuuauuuuuuauagcccacucaucuaguauuaaaauuucagaauuaguuacagcaagucuaauauuuuaaagcaauuuaccauggaggaguauguccuuuuuuauuuaaaaucuucauaauuuaaaacuuccaaauuuaaaagcuaacuuugugggugcucuauaguaucacaagcauauaaaaauuuuuugagaauauuuagcuaaaauuucaguaauauuuguuauuuaucauauaauuuccauauauaggaaauuaaagaaaaaauucaagucugacaaaucuauaguauuuguuaccaaaaugaaauugugacuuugccaccugguucucaaauucagucugugaccagucaguuuaaaauaaacaaacagaaugaguaaaaauaaugggacaaauuguuacugccacuguguuauauauaguuaguaguagacuaauaccagugauuguuuagaagauuuuauauuuguacaacuaauuguaucguacaaaaagcauuccuguuguauguuuuuuuaccuguuguaaaaaaaaaauaaaaaaauuuuuaaaaagcuuagaacaauccuuacauauuuacaaaauguguuucaacaugcauauuucacaucuuaaagaaacauaaaauuccaucccagccuaaacagaaacuucuacaaacagcaucucuucccuauuccaaugguucagucuuccaguaccacguguucuacauauacauuggcagaauaacuucugaucucgcucuccuaauguaggaucaagacacuguucauaagacacucaagaaagugcuaaugcaauaucacagacguauuaaguuuguucuagcagcacaaguauugagcuuccagcuguauggagccauguagcacucucuacagagagggucccgauugccagcaacuuagcugugagugcaggcgcggaaggaagggucuuaaaguggcgugaguuacauuaaccugaguaucauaguaaguaaacauuuauccuaaugucuuuggggcgggagggguucauagcaacauuggggcuggucacagaaacagacacugaggaaaaugcucuggcucuccucuagcaccaggggcgcggugggaagucuuugcuaaggagcacgaggcuacgcugucaccugguacucagcacaggcagcuagggcuuacgccucccugaccuugagacagacaacuugacucagaagaugggauugaguuuagacuuucaaugacaucgaucacucaucacuauuuagagugaugaaaaugcaaaaauuuuuucccucgauuuucuaccagugaaaaagcccuccuguuaaugucguacuguucuuuccaaacagguugagacagcuccccaggccucccugaagaccggguuacagaaaggugaguuacucuaaggugcugcuuggcauuuccugauuaaaccagucucuaagaauaauucauuugugcuucauggacuuuugucugucucuguaaaucuuuguugcuauucaguguggaauuuuacccucugugugugugugugugugugugugugugugugugugucugucugucugucugucugucugucugucugugugagagagagagagagagagaggacagagaacgagagagucgagagagagagucuucuacaguugauccuacucuguacuuccaugugaaaagucuuucuuguuuugauaaauuagagaacaccauguagacuugguauuguuuccagcuuuucuccguaagauuuugggauuucacuggcuuauaaacuagggaugugacgaauccacuuuuuugguauucgaccgaauaccgaauaguagcuauuaaugcuugucaaaaauggacuauggcaaaucagacaggacagcuugacugggaaaaaaugaugccccccccuuuucagugcuguacaaucguuuuguaaauugacccuuagcguaacuauggcuacuaguagaugaccauauuauguaaaucucuuugagauaugcacaaaguuuaagaagccuuaaacuuaucuauguguuuucugugugcaaucugaguauaguacaaacuccauagcaugacucgugaaauuuuggugagcucaaacuguauuuaguaccuguaguuuacucugggcaaauugcauuauuuuaaaauaaauaaaauaaaacaccagccugucugcacucucggggagaagucugcagcgauggucuccguggagauccucagcagaacugaacgccucucggagggaacacugcuuggcggagccccaagaaaagacaucgcgaucgaucgcugcgagauuaggaggccugauugcguuguguuuccaccauuccacagggucggcggaccgaggagcgcagggcucugucagauucagugacagcuccgucuccgcagcgaaagaggaaacuguggacugagauuccuguacaauuucaucccagaaacuccagacuuggagucuccgugcaagaguucuuugucggcggcucgauaaaguuccuuuuguuuugauuuugauuuugccaaucauuauuauuggcauucucuggccugguuucuucuucaagacugaacaauugcuuuaacauucagaugauuucucucuaucuuuuuuuuuuuuuuuuuuuuuuuuuuuguccgagcuggauggguacagcuuaaaucauggguccagccuaaaaaacaaacaaacaaacaaacaaaccaccauuuaacuuacccugaucaauuccaacauggacuguuuuguuuuuaaauaaagcaucauuaauacacaucugcaggguuuugccaaauggcccaaacuguauacauugcaaucauuaaaagcucuuauuauuuuuucuaacauuagugccguugucauggagaacaacaggacagcugcuuucagcagucugucauuuuucuggcauuuucagaaacucaucggaauuggcgguacccguguuucccuucgcaagccucucaguacagcacuucuguucuucuguuaaaacuccuuguuaauucagugaucucuuaggccaaggaaauacuuuguggugguguucugguuccacacaccagcaaugaaagagauagauuuguguccuuguguucuugaaucagcauuaacgugggcgggcacccuccuuuguagcugucaggaagcauucagugcaaacuuguaggaugggaugugcuaagaagguuccaguaaccagagcagucucccgaggccgccaccuccaccacaacacguggcuagacaccaagcgcucccuucggccuguuacggaucuucauggccucaggagaccuguuucuccacagucucuuccggacugcacaauuccaccguagcuugcugggcugaucuagaugucugucuguuguauggaaaguuugggggggggggaucuaaaacaaacuguggguggacaucuuacccgucuccuugguuccuugguauucaccgugccugaucugcacaugucaucgcggcugucucugucuagccuaccgcauuagcccaagagauuauugcuuuguaacuuuuugcacuauuguuuuggcuggauuuguauuacacgcaguuuuaaaaaaaaaaauuccacacucuucucugccuuuuuuuucccaaguauauauuucuucucucccucacaaaguccagaggccugucaucuagcccuuggugauuucucgcacuugaacacugauuguccauucagcccucaguaacguuccucccacauggcaugauguguguggacgugccacagcacuuguuaacggucacaauaaaugccacucuacuaagaaagaacaauuaugaaaauccaaaauguauuggggggcuaauaacugaauugcaaaauugggggguugaaacggcacuauccgaguaggaaucgaauacaaaucaaagauuugucacaucccuaaucaaacaagauggagaugucucugcaaccguaucuguaaacuacacuguguuggguuucaugucuuccccuuacgcaaucaaaugguucucugaauuguuccaaaucaauuggcugucucucaguuuggcuagaauggaugucuagaguggaacuugggcccugcuggggaaacggcgacaagcagaacugaacuuaaauguuuuuauagagcaguugugaaugggaucacuuaauaccggaagucagaaacuuaucaaguccuggcuugcaacuucagugcuacaaacagcugugaauuucccccaguauacuugagacgaguuuggggaaagaaaauacucaccaccaacaaaaaaaaaaguuuacagugacccuaaauucuauuuuaggauuaauuucaguguguuauguuaaggugccagcgagauuucagauuccuguaagccccuaaagaaaaggagucgcgccucaacggauguagagacggcuaguugcacguacagagacacaucugacuccgauucuagaggacugagugacgggcaggugagugugugcucgggucugggcagacgacuuguuugccagccacaguuagcaugcuuucucgggagcauccggggaacguaagcguacucgugguacgauagcauguaaggggggauagcauguuugucaucgcucacucuuggucaccacaauauucagcuuaccugucuguguaggcuucucuuucuucauugcugcacaugcagcucccccaaaccggaagagaauggccuuccccaauagaggagagucuuuuccaggguguaaaugugugugugugucuguguguaugugcagcugcauucuccugcuggaaagucuugucaggcuuucaggaggggagacugcagggcagucaagcuucuaaaacugugggcccauccaaauaagaugcuucauguggugguggucagcccuuguuuaaacagauuaccagccaggcaugcugucacacgacuuuaaucccaugcuaagaaggcagagagucaggcagaucucuugaguaacuggccagccugcaguacauaggaaguuccaggauaacagagcuauauuaugagacccugacuuauaaaaauaauaauaaaaucaauacucuuagaaaaaucaauguuuuugaaacauuacuucacuauguaacucuggauggccuagaacuuuccauguagaccaggcuggcagacaucugucuaucuugggcucaccagugcugagguugaagguguagcuuggcugggggagggaggggacaacgacgacucccuuugguuauaugaaacuuauuuuguagauuucuugcauaacagaggaguucugucauuuugccuuuuaaauauucgcuucaguuucucccaaaugacacagauacaccgacaacaucccuggguugaaggaaggaaggaagacgagaaggcaggcgggcggugaugagaugaacuucaguugguuuccuuggguuuugcauuaugucggggaccuauuuuuuccuuaucuuguuuuguuuguuuuccacauagguaggcuuuggcaaacaaguagauagcccgucagcuacugcugacgcagaugcuucugacgcgcagucgguggacucgagucugucacggagaggugucggcacgaguaagaaggacacugugugucagguaggcgggcggcuacuuagaagcaugugauccaguucuaccagcugugucauugucuccuguacuuuuuauuauuuuauuaaguugcuuuaaagcuacaggucuaaaggcuauuugugguucucccuauccugaugggauguuugucauuguuguuuugcuuuugagacaggauugccuugccuggucuaaggcuugcucuauagaccaggcuagcuuuggacucacugugagccaccacuaugcccagcuccuguuccuccuuaauuuuuuugaguuauuuaauuuuauguuuugccuucaugagggucugugcaccacaugcuugccuggugccugaggaggucagaagggaacuggaauuacagaugaguaugugagccccauguagguucugggaaccaaacauagggcuuugcagaggaaccaugucucaaaaaaaaaccccuaaaaacuaaaagaaagaaaaggaaggaaggaaggaaggaaggaaggaaggaaggaagaaagaggaacuacaaaaucuuggauuccuuuuuuaugccuucuaacucagaauauuaggagaaaaaucccauggccuauacuugaacaagcgcuguagucaguucugagcugcaaguuugagaacugcugcuuucuugcucuugcaggucugugagaaggcuggcgacugccuuguugcuugugagggggagugcugccgacacuuucacguggagugcuugggacugacugcagucccugagggccacuucaccugugaggagugugagacuggugagccacggagggcggggcggggcggggcggggcggggcggggcuggcagcucuccgugggguggcuccccuugauuuacuccguucuugguuaaugcagcuccccuccccucccauagguauuuuaacaagccaagacaccauccaguauuaagcuuuccaagauccaaaaaccaguccaaaccaccuauguccaaaaacaaacuuguuuuguuuguugaguauguaaaucaguuuaagauuggugugugugcuuaacaaacaaguuuaaaguccuuuaguagacucaacaaguaucgauugaaacucuuaauuaugguuacaguaaauauuuaaguauaauauaguaaauauuuauaguaacuauaaauaugguuauaguaaaacuguaaauaugauuauauauuuuugggaaaaaauaaugcuauuaacuuuuuuuaaaggcagggucuuacaguguagcccuggcugcccuauaacucacuguguagaccaggcuggccuuaaacucacagagaucuaccugccugccuuuccccccaaccaccccccaccuccccaccccguacaggaauuaagggucugcaucaccaugccagacaugcuguuaauuuuuuuuaacuuaguauuuaucauugauuucuucucccacuauauauuuuccaaugccuucuuguagcauacaaagaaauaugcuauuuuauguuucuucuguaauauaguuaugguuuuguuucauuagaaagcaauuguuuaaccugaaacaacauagcuaguugucuuaguuacuuuucuauugcagugaagagaugccaugacauucuauaagguaacauauagaagaaagaguuauuggggauuuaggcuucagaaggugagccugugaccguggcaaugaauguagcaucaggcaggcagguacgguaguagagcaguagcugagagcuuacaugaaguagagggaucugacuuugaaaccucagagcccaucaucccccugugacacaccuccucccccaaggccacaccuccugauccuucccaaaugguuuuacugacuagggacuaagucaaacauuuuguauuuauuuuuguugcaguaucgguagguucuguuuuucuaggaauuuucccauugauaugaauuuucaaauuagcaaauguuuagugauaucuuuauaaucucuuuuaaaauaggaauuuacuuauaacuuuuuaacaguuuauuuuuauuucaugugcguuggcauuuugccuguauguauguguaugucugugugagggugucaguccugggguugcagacaguugugugcugcccugagaacgcaggucccuugagaaaguagccaggggucaugaccacugagccaucucuccaacuccaggucucuuuuuguaugcuaaauucugaaauguaauagcuuuuucuuucaagcgaagcucuuugauauuuguagcugcuucuauauaaaaggaguauuuagcuuauguggaggcacacaccuguaaucugagugcuaaggagacugaagcaggaggauggcgaguuugagcuggucugggguaccaagugcugggauguagcucagaguccucaccuaggaugcccaaggcccuaggccuaagcccaacacuuugaaugguucaaugaaugaacuguaauauguuuucaucagauuuuacuuaaccuauauauauuuuuuuuuaucaauuuucuaggacagcacccauguuuuucauguaaagugucugguaaggaugugaaacguuguucuguuagugucuguggaaaguuuuaucaugaagccuguguccgcaaauuccccacugccaucuuugagucaaaaggauuccgcuguccccagcacuguugcucuuccugcucuauggagaaagacauccacaaagcaaguaaaggugagcagagcuaaaggaggggccgugugcagagugcccugcggcagugcguggcacaucugccagcaauggcggcaggccuucuguuuauuuccaaguucaaaagcugagacacacaguugacuuauuuauuaggcagaggcuacguugcaauucaagcauucagacuaugcuaaaaucuuccuuagguuuaguuacagcauccgcaguagacccugauuccuuuggaggauucucuaagugacuauuagucuccaucuagggaccaagaagaauaggaaugauggugucagccacagcacuggccuugcaaagaagaacauucuguaccaacuauaacgaguuugauauggcgggggagcccuguucccaugcugugcuguagccggcaugcuguguguucccgugccguggucggcaugcuguagcccgcuucuugaccugucuucacacaggccgcaugaugaggugucugagaugcccggucgccuaucacguuggagaugcgugugucgcugcuggaaguguaucuguguccucgcacauucucaucuguaguaaccauuccaagcggaguagucagucugcugcuauaaacguaggcuuuuguuucguuugugccagaggugagugucaaucuguuuuuuuuuuccucguucuggcaucauucgcauauuucuccauuuaacugugucucugcauuggugagaacuccagcuguccgucucaugaacuaugucccagcgagugcugacugcauucuguuauauauauaguacuaggagagaauguuucaggcagacauucccauagugagaauauuauuucuucuacaaguuaaacuaacaucugcauuuuaaaaauaucuuaagcuggguagaguggugcacaccuuugauccuaucacuggagaggcagaggcaggaggaucuuggugaguuuaggcaaggcuggucuacauagcaaguuccagggccagcuaaggcuauauagagagacccugucucaaaaaggaagaaaaaaacccaaguuuagaauuacaauuaaguguugguuaguuuuuuuguuucucuaaucagaagguuacuuagagcagaaccuuccugcacuguguuucagcggcucgggagugucaugugugaagcaagggcagcccauucucaguuagaugcuuuggucauugagggccugagaagagcagccaagcagggucuuucacauucgugaaauugauaaacugaaagcaguaucguguccuguggaggaccagacaugguauuaacagacuuaaguucauggugugucuugcuuuuuuauugcugugacaaaacaccaugaccgaagugauuuauaaaagaaaacauuuaauugguagcuuacuuccaguuucgggggacuaguccaaggccgucaugugggaagcaugacaaguuagcagguuuggugcuggagcagaaacugagagcucacauggugcaguaaccaaaggcagagaacaagccaacuagaauggcuuggcuuuugaaaccuccaagcccaccccacagugacacacaggcuccaacaaagccacaccuuuuaauccuucacagaugauucuaccaacuagaaaaucaagcauucaaaccuaugagccuauaggcaugauuuacauuuucaaaccaccacauuccacuuccuggcccccauaggcuuguggcuauuucauuaugcaaagugcauuuaauccaacauuaaaggcccccauagucucuucgguuuuaaggcuucauaaaaguccagagucucuucugagacucgggcucucucaauuggaaccccuguaaaaucaaaaggcgaaucaucacacacuccagcauacaggggcacagagugcccacugcccguccaaaaggacggacggagcaccgaagcccagcggggcaaacucaaguucugcgucuucaggucagagggcucuucagauuuccugcucuuccaacuuugaugucugcagcacucuucucucucuuggacugcuuucacaccguuugcaguucucuuugacaguugucacaggacucuggcaucuccaacacuguggaucuucagugcaaucccaacuucauuuucucagcuucauacaguacccucucugggucuccaugcagguacuccccugucacacgccuggccucagcaucuuccuuaaccaggaaggaagauuuuacaaccccuuuacuuguguguuccugccucuaaagccggagcccgguaggggagcuacuaaguucugccacacugcuuggccccuccuugaacuacaugugcacagacuuggguuugccgaugugcuucacccugaguaagcuuucuucccuuagaagcagggaucccuuaugcauuuccuuuuuacgguuagaggcuuggcugggugaggucgaagcaggccgggccuuucuuuaaacaucucaucucugagcacaagacuuggcuuccacauuaauuuccucaggcucuucuuucccucucacuguacacuguauguuugcuuucuucccugcuuguucuucuucacuguagaucugcacaggaguaaucacuaauaaccacaacacacagucaauacuagguuguuuuggaauuucugcccaugacaaaauccaaaacaauuuagcuucaggcagauucuuaaggcaagggcaaaaaccaaccacauucuuugucaaaauaucacaagaguuccuaagucccaugcuuaauagccuuccccucugacacaugagagccgaaaccuccauaguccaugcuguucuucccacugcugauuuccagacuccugcuaggaugaugcccagcgagucccauguacaguguucagccuugcuucccucagccagucuuccgcuucucuaagaucagcguaacccagccugucggcaguauaccacuugcucuuguauugcgguggaggaagaugacagaggcagcucaggagagagcaccuaguuagggccuucccugcagugucagaagcucccccaucauaucaggccauagcagcaggcagcuguggugcuagccuagcucaaagccugcaguugagucaaacaccaugagacagagagagcacaaacuggcccugcucuuuaaaccucagaguccucucuucccagugauacuccuucuccaacaccacaccuccucaucuuucccaaacuguuccaccaucuggggaucaaacauucaaacacauucucaugugggggucauucucaucuaaaucaacacgugguacauguaaaauaaaacuuuauuagacuacgauauacacuguccaucuuaucuugucuuaucuuggcugcauuauaauaaaauucuuuuucauaauuaggaaucuuauaaauaucuguuuugcuuaaaaaugacauuuguuuuaauuuuuuuucacuuuuugcauuucccuguauguaacauuugaacuacuagauauaucaagucuguuauuauauuuagaucuuacugaagaucaaaacuuuuuguuguuuguuuuugcuuuaggacacaguuaauuuguuggaaguaucauguguguauguguguuuauauauuuucuuucuguuuuuuugguuuaagaugagaucuagcuagaggcugguauuaaacuucugaacugaagugauccuucugccucagcuuuccaaguagcuggggcuguggguauuuuauuuaccaugccaacuuauaaagauauaguagauuuaaaaacaacaacaaaggggcuggagagauggcucagaggcuaagagcacugacuguucuuccaaagguccugaguucaaaucccagcaaccacauggugguucacaaccaccuguagugagaccugaugcccucuucuggugugucugaagacagacagcuacaguguacuuagauauaauaaauaaaucuuaaaaaacaaaaaacaaaaaaaaaacaacaacaaaaacuuagaagugacagccaguuaaugauuaaguaaacacuucuguauuagcagcuuguaugcagucccuucuauagccagcuguuauaguuaacuaguaagcaaacaucuguguguuagcagcuuguauguggucccuucuauagccccuggauuccuuaugcuggggcuuucuagcuuccucaguuuccuaagcauguauguuaucugccagcaaguaaggaacacugguaucuuaguuuugauuguuuguuugcuuguggucuggggauuaaacccaggacucaggcugaagaagagcucuaccauucuuccuuauccuacccugaagcaaaaguagccgcccugcuuugaagccagcaggaguucaaccaaaguauucacuuccacacuguuaauggugacagacaagauccagagggggucagcuaggcaaaugauaaguaaaaauguguccccacuuucuguuacagaauagaguggugaucagagaggaccugaauucagguguguguguguaugugcaugugcgcaguggccaccaggccauaagagaucaucagacccccuggaaccagaguuaaagguggucaugagcugucauuugggugcuggguaucaagccuggguccucugugacaaagcaaguggucguagcaucaggcaccucuccagccccagccuguugacuuauaaacguaauccauauguuuagaggcccucagacaggccgugacagcaugcagcccugguugcuuagcugcuuuuucucggucugccucuuccagacccuuuuaacugcuauguuagccaaguccaguccaguuuagucaguauuuuaaccaauauuuuugugcuguguuucauuuaauaauugaucuuuguuuuauuuguuuuccaagacagggucugauucuguagcacucacucuguagaccagcuggccucugcucccaagggugggcuuaaaggcgggcaccguuauacuuagcgauuuuccuggguuguuuuuuuuuuuuuuuuuuucuuucuuuuaaauugguugcucuuuaaaacuguuuucaauuuaggacagguagaaaauguacaguuacagggacguuugccauuucaugagaugaaauggaugcucaugaacuagaagcuuaagaauaauauccaugggacagagccccuccauucagaauuagaaucuaugacucaucugucuguauuuuaucuaaauaccaugcaaugaacucccgcauauuuuaacuguauagcaaaugaacuuuguauuagaagagaacuucauuuucuuucauagcauuuugcaaaaauucagucuaaacauaccagauguuucagauuugagaagauuuaaaucagagucuuuuaaaguacaagcauggaagccaggggugguggcaaacaucuuuaaucccagcauuuagaaagcagaggcuggcagaucucugauuucuaaggcagccuagucuacagagugaguuaugggacagccaguacuacaugagauccuaucucaaacaagccaaaaagaaaaaaaaaagcuauaaacauguaaucuuuuaaacauuaagaacaccuauuuuuaaauagacugacuauaguaaaucuauaugaccaaaaaauaaaaccuacuuuaauaaaauauguuuuagaauuagaaaauauugcuuauuuucuauuucuaaccuuauuaagaauguuucuaaucccauaaaggauuuuuuuuucuuaguuccugguuauuggauauuuaaaaucauuaauccugggccauugagauggcuccauggguaaaggcuuggugccgagcuuggcagucugacauuggaugccagggaugcagggcugcacucaguggaaggagagagccugccccuauuaucguuaucuccuggccacuguuugcaugccuuuauaacacacgugguucauuaacuaagaaaugaagucauaaagcugguucuaagcacuggaaggccuagaaacaucuucagagguuuuaccugcauccccagccaaccugaaacaccacagaaaauagugagaugucuuucagcgcaauuuauauuccuuaaacuuucaugcuucuugaguacuauauaaaagaaagaacuuaacguccuaagucuuacuuuguaauggaaaugauagguuagguuaucuuuuuauuuuaauagugguaauagaaguuucuuuugcauaugcauauagcacacucuaauagacaauuugaaauaaucgccaccguugcuguaggagucgucuuuccuggucugugugagcaagaacacuaaaacccaggcugaguuauuuuccuaaugacacagacuggcgaguggggagauucuacuugaccuucuucauuuuugcuuuuuauaaucaugugguagaauuuauaacaaauguauaguagaguuuuaaaauauauuuuauuuacagauagauaacuuuacggauaguuuaaauagcuaauaagccacucaaagccuuuuauuuuauucucucauaaauuacaucucauucacaguuuucccucccucccucuucaccuuccaggcccuccucccucucucucuccuccagauccauuccuccuuuucccuucagaaaguugcaggccucucagggauaucaaccacacaugacauaucaaguugcaguaagacuagguaccuccccucauauuaaggcugcacgaagcgacacaguaggaggacaagggucccaaaaguaggcaaagggucacuguuaggaguccuacaagaagaccaagcuauacaacuguaacauacauacauacauacauacauacauacauacauacaggcaugcgugcguaauugucaguuuagugucugggagucccugggagcccugguaguugauucaguggauaguuuucuugugauguccuugaccucucuggcgccuacacucagccuuccccaucuuccaugggguucccugagcugcacuuagcgucuggcucugggucucuacaucugcucccaucaguuguuggacgaagccucucugaugacaauuauucuaggacuuguuuuucuuguucuaggucuccaggcugcccagccucuggcuccugguccuccaggcaguguccaucauggccucccucucuuggcgugggucucaaguuggaccagucauugguuggccacuucaacaauuucugcgccagacuuuucucauuuuaaaaaucucuuuucauucauucauuuuuuaaauaccaccucuuuuuacuaaaugaauaaaauauuuugacauuacauaacuuuucuuaacaagauuccugugugaguggcaguguugaauuccauucugucacuuuguucagaccuaucaucuguccaucuguccuuccauccuuccuucuuuccuucuuccuucuuuccuucuucccuucuuuccauccuuccccuuccccccuccuccucuccccuccccuucccccuccuccucucccccuuccccuccccuucccccuccuccucucacccuuccccuccccuucccccuccuccucucccccuuccccuccccuucccccucccccuuccgccccccuccccuuccuucucuuccccuccuuccccuuccuccccuucuuccccuuccccuucuuccccuucuuccccuuccuuccuuccuuccuuccuuccuuccuuccuuccuuccuuccuauuuguuuuucaagacaggguuucucuguguaacagagcccuggauguacuggacuugcuuggauucaccugccucugccucccaagaacugggacuaaaggugugcaucaccaugcccagucuaguuuagacauuucuugaccccaucucagugcagagcagcaucaaaugcagauugcacccaaaggaaaagugagcggugauccucccaaaccacaacucuuccuucucagaguggucccugugugacacugucgugacuuacagacuaauaaccaauggaguaauuaacacuaaaacagcagcgcccugggcagacaguggauugugcauuguggauguaccuggagguauuggggccagugcuacagugaaucuuguguuuccuuccaaauaggacagauggauauguaggcgggucauaguagcuuuuuagaacauuuaaggugguaagcacuuccugugacagcauaaagagaucuaaacugguuugcacucccugggggaagucagggaaguagggcugccucacucccauugccaacuguaaggcguggucacauagaggugcugaguuuuccccucauggaaucauggguaguuucauggcagcucaucucuuucuguuuguuucauauagggcugauaguucaggaccauucagaccccauguucaguuccuaugccuauaaaucccacuaccuacugagugaaucaaaccgugcugaguugaugaaauuaccuaugauuccuucuucgucagcuuccaaaaagagaugugagaaagguaaucgugacuaaauaguuuaucucguguuuaaucucugcauuuuccguuucucucuuuaaguggagggggguaggggguaugccugccaagcacugccuguugcuuuugguagguccugccuuugugguuaugacucugucuucauauggcuauggaauuacuaaaaaggcuuaaaacaauucuaucaucacagauuuuuauuuuucucccugaaucaauucucagcauucaaagauguaacaaucacgguucauuccuaauauaccauguaugcauaucaaaaaauagguuuuuauuaguguuuuaaaauacaagguuuuuaaaauacaaagacuagaauuuuauauaacauaaaagacuuccucauuuguuugagguagaacugucauucauguuaaacuagaauagccacgauacaguuuuuuucuccucguaagcuaagcaaccagaaaggccacuuaaaaaagaaugacaagcagauacuggaaaagauuguuucuagaacaucuucuaugauuuuauuucuuaaauauuuaguuaagaugcaaugaaaacaaaugcccuucccguaggagggaagcugggguucagggcuaccccaaauacuggagggugaaagguagcccagccagaggacugaugaauaguuuauucauaaagaaaugagcuaaauuuauguucacauucucucaagcagugucauuccugaaagaaaacucuuagccgugcuuaacuugccauagccugcuugcaauaaggggaaaguggcuucauguuugauuugggggauuauuaucucagaggaagcgucagugagcuuagaagguauggauagaccuuuugcucaauauauucuuauuauaguccaaguucagaacugauaaagaaaaaaaaaaucaccguucauuccuaauguaccauguaugcauaucaaaaaauagguuuuuauuaguauuuguuaucugugcggccucuuugaucuguccuugcucuuguuggcccaaguagcaacuaauagaagcgcuaucuggcaaggugacuagagccaccaggaguccugagagacuggccugcgguuggguuguaugcuuucugcucaggucagccuccagugccuuauuagugauguccuaagcuuccuuaaggugggcaggggccugcauuacuccucaacaagauagaauuagucuguuaguacauuuauaaaauuagauuaacucagcuguuguuuuguuuccagcauuaacauugacaucaacuggaacuauuuugaaaccucuacuuagcuugaaugauauauuuccucucuuguaucuggaaaacaguuugauuuuuuuuuuucugguuuguugguuugguuuuuuuuuguuuuguuuuguuuuguuuuugcauagcacaagguagaccauucauguuucauuuucuucuuuaucuuucuauauuuugaacauuucugucaugacagauuucacugauucuggcucuguauuuccucugaaauaagacugaacauuuacaaccauuuacauuaacacuaaacaugaccuucccaacuuccacagugguguuaauaauaacauauccucuaaggcugucugcaagacaggccugccucuugaucaguggguuccaguggacuuaaaaacccuaugcagagccuggcgguggccgcgcacaccuuuaauuccagcacucccaaggcagaggcaagaggaucucugaguuggaggcuagccuggucuacagggcuaguuccaggauagccaggggaacacaaagaaacacugucuugaaacaaaacaaaacccuuaaaacauccaagcagcuggaaaauugaaccaguuaaucccacugauaaccuguagucaaggggaacugcuaaugugaaggcuggcagaggaaauacaguucucugguccaucgugggggguuuagguuuccuuuucauguaacaguugagguuugaaggugcaagaagacaagauuucuggaaaucuuuaaaagguuagagcaugcgauuuggucaaguuauauagaaggcgcugaaucuuuugccugugagacuuuaaaucucuuguugguuguagaacggacuagucaggggaaguguccuuugucuucaguggugagcuuucuuacuugugcuuguacgagagaccccuguccccuacccgcucauuuugauuugucggcauucgaagcguuacuguuuguugcaccuguuuugguuucaaagagagggcuuacuagaaacccgaaaggacaagcuugcacauaguacuucauucugcacugacaauuacgggguuuugugcuauaaagcagugcuucucaaaacugagucagaaaaaaaacaaaacaaaaacaaaagaaagaaaaaauucuaagcauuuuuggaaauuaagagaauuacaccuucauacaauauagagcuauaugaguuuauauuuggcuauaacuuuaacuguucaacaugcuaauacuuucuuugcuuuuggaucauagucucuaguaguuauguauuucuuuggucaauacaaaaaggagagcugggcaugguggugccugucugcagucccagcacuugggagacaggcaagaggaucacugguggaaggugugagcuacauagugaaauuccaucuccaagaaaagguggaggaaaauucuucaucuugaaaugcaaguuuauuuuugguuggugugguuuugaaaacguaggucaugacuaggagaaagggaccaguggagauggagcaguuacaggccacugcuguaacaguuaaaggccacugcuguaguuacagaccacugcuguaacaguuacaggccacugcuguaacaguuacaggccacugcuguaacaguuacaggccacugcuguaguuacagaccacugcuguaguuacagaccacugcuguaacaguuacaggccacugcuguacugccugcuugacggccucugcacugggaaggagugacgcuggagcuaccguugugagaaucuguguuccaccuugguauuagaaggagaaaauaaguucccaucaccuuaauuauuuucauucuugucugacguuauuauaaagagauuuaguuuauugugguaguggauuaaaauaaaaaugauuguuacuuuuuccuagcuguaaagaacaaaagaaagcuauuuguuugaaagccuauuuuaaaucuacaugggcuaacgagguucuguaucucuugugauauuuuagcuagccaauaccagauccccuguagcucauauucuaaaggagcacagguuggguuuuucugguuuuuuuuuuguuuguuuguuuuuuguuuuuuguuuuuuuacucaaaaacuucguuucuagcugcugaagucuuaacaacuagcuauuucauucauuuccuauuuuaauccaucacucgggacauaauucagugucuuuguuucccauuugaauaaagucuaguauacuuaaacguuuuccuuccuuccguuucucuguuacuaaggcuguuugucuguuuuaagguggaagauugcucugcugugaaucgugcccugcuuccuuccacccagaaugccugagcauagacaugccagaaggcugcuggaauugcaaugacuguaaagcuggcaagaaacugcauuacaaacagauuguuugggucaaauugggaaauuacaggcaaguuuuccaagcacaaaaaaggaaguacuacuguugcagcgggggucaugaucugcacggagugcgauuagcgcacaggccgagagacaggcuugcaggauccgcucccugaacaaaagggcucaaagacaagggcgguuggucuggauuucuagggaauggcaaagguuauuuugcucuuggauuuuuguuuuuaucugcuugccuuuucuuugagaguggguuuuucacuuugcuuagguucugagaauuauuuuauacugaugaauuaugcacuacuaaauuuugcaaugaaaggauuuacauaaagaauggagguuuuggguuuuuuuguaucuuaguuuuauauugguuuuaaacuuuuuuauaaacauuuauuuauuuguuuguuuguuugucuauuuauuuauuuauuugguguaugagucuuuuuacuagccuguacgcuuguaucucaugugugugcuugccuagggaagucaggugucagauccccugagacugaguuacagacagcuuugagcugccauuugugggcuagaaauugaacacaggucuucuggaagagcccugaacaaucucuccaugccuugauuucuaauuuugaaugagaucaagaguuuauagcuuuuaucaaaauagauccauucaaauuuguuuguuuuuguuuguguguguguguucucuguguaauaacccugaaacuugcuuuguagacuaggcuggcaucagacuaacagggguccaccuggcucugccuccagagugcugggauaaaggacgugugccgccacacccugcuaggucaguuugguucuaaaccaggcccacuguguucaaguagcccuaagcugugugcaaagagugcuuuguuuucuucauauauacuaaaaagugagauuauuccaguaagagcugggacauacaagugccacaguacaauuuuagaggucagagaagagcuuucuggagcugggucucuccuacccaagagaaucucaggaggucagccuugacaacagcagcuuuaccuguugagccaccacaccagcccaagccucaguucuuaaaggcaugagaacaggggcugcagagauacuaagagugauugcugcucuuuagauccguguucauuucccagcauccaugucaggaggcuuacagcccccuguaaccccagcccaggcaggcagaccuucucuccuggccucacacaggugcauauacacacauaaaaaauaaaaacauagggcuggugagauggcucagugauuaagagcacugacugcacuuccaaagguccugaguucaaaucccagcaacaacauggaggcucacaaccauccguaaugagaucugaugcccucuucuggugugucuaaggacagcuacaguguacuuucauauaauaauaaauaaauccuuuaaaaaaauaaaaacaaaauuuaaaaugagagaggaauuaauauuauuuaaaaacauacuccuuugugauaaguuauuucucugccagugaaaugagccaauucaagccagaguagaguacauagcagguuuauagggaagcugcucuugggcuagguaaguugucaugggaggggagagagaaagagagcacgcaagcagggagagagaaaauggagagagggggagaggagagagggaaagagagaccaaauugucuggauuauauaggaaagagccucuaggggaggggaaauucagggcagagggcauacgcccuguaacagguagagacugagggaugcugggagaaccuggaggccagguccaucuugcuauguaaaauauacaccucagccuccuguccugggucugaaacccagcaugguaagacuuuaauauuuuuguuuauuuuuguuaucuuauguguauggguguuuugccucuguguaugucugugugcuguguacccagggaggccagaagagggaguuagguucccuggaacuagaguuauagauggcugcgagcagccgcgugggugcuggaagagcagccugugcucguagcugccaggccaucuccccggguccuccuuuaagauaauuaauagccuugauauguguuaggauugguauuuugaggcagggucucacugcguagcucucucuagccuagaccauauguagaccagaugucugccagacggccugcagagugcugauauuaaaggcguguaccaccacauccaccuuagcuguuuuuaaagauggggucucacuauauaacucuggcugaccucagaguuggcgugcagaaaaggcugaucuaaaccacagagacccaccucccucugccuccugagugcaccacaguaucaggaauucuauuggaauucugaagaaaauauauuucuagauaauugcaaccauauuguaaauuguuugcaugaagaguugaguuuagaguauauuaaacauaagcagucuguguccauguuuuuacauguuaucucccuuuuggaggauaggacagaaucuuccuggccuaacuaaccucuugcuuaagugguccuccugccccagccucucaagugggugagaccaccauuguuggcacuucuucuugcuuuguuguuggaggaauuuuguauuuuuguuuuguuuuuguuuuuguuuuuuagugggagcuggagaaguggcucggcagugcgagcacugacugcuuuuacaguggcacgcacagcugucuguaacuucagguccugcuccacaccuagcacacacacagggugcauacauguaagccagacauucaaacacauacaaguaaauuuuaaaaagugugugugcgugcgcgcgcgcgcgugugugugugugugugugugugugugugugugugugugcguguguguguguguguguguguguguguguguguacgugcgugugugcgugcgugcacuuuaaguguagaucuggauacauacaaucuucuuuuuuccaguuugguuuuauagggacagacccucucuccagguuagccccacccccacccccagcccuguuguacaauguguucuucacauguggggaauccaucuaaugccaauagucuccaugccaagagcacggaggagaugguuuuuucuacuugcacccuguguucaucaaguugaacugagucuggaaugcugacagggagccugguauaucagggcgagaggcaccuccucugguugaugagucgagaagugcugacucgcauguaguacugacacuuugcuacggcaguggcucauucucaaaagaaucccucugaccgcuagaaacaauccuucauucucaaaaguuagucuccucccccugggaagagaggaaguucaucaguugugggaaagugugaauuuccuacagugaaaaugggcugggaucauacuaguuaacaucccaauuccagagcugggaaguggucgcauuguccuucucacaguagauguuauaacugauauguucgugauauauauuuuauaaauuuuaaaugcuagucuuuuaaggaaagaaaccacauggaguuguuagggccuacuuuguucggccuauguucucuguuauguuaauucagcaauagugauugguuguggucaugguguuuuggugguugguggggcggggcguugggguugggggaagugagggugaggcagggucucacugaguagcucuugcuguccuagaaacucacuauggcgaccuggcugaccucgaauccacagagauuugccugccucucccugggauuaaaggcauguagcaccaugcuaagugagcagaucacuacuguguauucuagaaugugaacccuucucccggccuguaaggaagagugugagguuuucaccuucuccauuuuguccucagaugguggccugcagagauuugcagucccaggucugugccgcugaacauccagggccuuaagcaugacuugggggacuuccccguguucuucuuugguucucacgacuacuacuggguucaccaaggcagaguguucccuuacguugaaggagacaaacacuuugcagagggacagacuagcauuaacaagaccuucaaaaaagguaaguugggccaugcucacagagacccagugcucacacucagggcuguguuuuguauuugcacacgaaucuucugccacucaagaauguucaccagggccgagcguggcggugcacgccuuuaaucccagcacucgggaggcagaggcaggcggauuucugaguucgaggccagccuggucuacagagugaguuccaagaccgccagggcuacauagagaaacccugucuugaaaaaccaaccaaacaaacaaacaaaaaguguucaccaggcacugggauucuacauccauaaaccuccuaugacaucaggaccagguuugagaugcauaaagccuagagcacuaggcuauguuugaagugucuuuuaaucaagugaaacuccuuuaccacagacaaguaggaaaggcuucccaggaagaccuuggacauuugcaacaugacagagucuaccuuucuuuuucuuuuuaauuuuuauuuauuuauuaagauuuauuuauuuauugcaagugaguacacuguagcugucuucagacacuccagaagagggcgucagauucucauuacagaugguugugagccaccaugugguugcugggauuugaacucuggaccuucagaagagcagucaguacucuuaaccgcugagcugucucuccagcaccccagaagucuaccuuucucaguaaggauaaaaucaguuuaaaucuaggacagacaggguacacaggcgcucuucacagggucaccuagaggucugagucagugacgucagcccugugcucugaugcauagugguugaugcuaauuuauuauuuccucuacagugguggugacuggugauuuccaaaacauaauuuuagaaagucagccucaggccagaggcagagcgugucuaggaugguagaauguaacuucccacgcuaauggggugugcucuucuuuugacaauggcuugccugcucuucuugucagcacuggaagaagcugcaaaacguuuccaggagcugaaagcccagcgugaaagcaaggaggcuuuggagauggagaggaccuccaggaaacccccucccuacaagcacaucaaggugagugcgucuccccgcugcuuaaagccccuugacuuacagggaugcuccgauggucacccucuccuuguuaagccaccaccugggaaccguggcuuacauggaauucuguuguuucugccagaguauccugcaauuagacaaggauauagaccuuuagccuuccuuuuccagacauugucccuugauuucagguauuaaauuucaucagccuguggcaagcggggguggggugggguggaugagacuugacaucaagcuucagccuuuuuguguagcaaauagacauaguuauuguuccucgucuauucuggagaaaucacgauaaagagcuuuccguauugugucucagugcuuugauguucaguucauguugcucacagauccucaucuucucccgccccucucuugcucugucgucucccaggccaacaaagucauagggaaggugcagguccagguggcugaccugucggagaucccccgcuguaacugcaagccuggugaugagaacccguguggccuggagucgcagugucugaacaggaugucacaguaugagugucacccgcagguguguccugcuggggaccgcugucagaaccagugcuuuacaaagaggcuguaccccgaugcagaggucaucaagaccgagcggcgaggauggggccucagaaccaaaagaagcaucaaaaagguaaugugguggccacauggcugcccucgucagucguggcaggacuguaagaagcauagcuacuuaaaguuggacuucucacuucucacaggguuugcacuugcugagcgagaagaaagugggaaaggauaacagaacagccuggcacugucauugaugagccuugcucagaaggggcauugugcuuuuugauuucuuucuuuuuuuaaaaauuauuaaguggaaugauucaaacauauuuucuuguuguugcuuuucaugguggauaaacaugucagagaagcaacauaauaaaguugauuacucaccagggcagaaacuagcaaacccagaacuuugcugcaacaucaagucauagccauaagugugaccgaaucaccaaaucacuaaggugggcuguaacagucguccauuguguggagucgcagcucguuagaggccucggauuauaugugcaggggugguagaaacaguugaaauaauauaacucuauaacuuauuuuuauuuucacaccuugagacagguuuuuuucccccacaagacccuccuagcacaagaaauauauaccaguuggagaaguauuuuaaagccaaagagcuuaaagaaaaauuaaaauuucuaguaaaccuacuauucaaauagugggucucagcuuuuagaguaccugagaaucuccuguggcucuugucaagaaacuaacuguggccggguguaguggccgcacaccuuuaaucccagcacucgggaggcagaggcaggcggauuucugaguuugaggccagccuggucuacaaagugaguuccaggacagccagggcuacacagagaaacccugucucgaaaagaaagaaaccaacuguggggagggugauguguguguuucauccuaguacucaggaggcagaggcagaggcaggcagauaucuguuaguucaaggccagccugagugaauucuaggucaaccaaggcuagauagugcgacccugucucaaggaaagagagagagagaugggguggggugggguggggggagacagacagagacagaaagagagagaaaccagggacuggagacaucaauaguuaaaagcacuggcugcaccugaauuugucucccaagcuuccauaaccccaguccuagggcaucugaugcccucuucugacccaggcaccaccagguacaaguagugcacauguauacacaugcaggcaaaagcacuccuacagaaacgagaauacaccuaagccgaggggaggccggggaggacccaagagacggaagcaaacagccugcacacuagugcugaagacugagugguaacaggacaugagcugagguagguagccaagagccaggccuaaagccguccuucaggcaagaacuacuagauggcuucaguaggguggcucacugaccugacaacgcugguucucuauuacuguauagaaguauuaccacaaagccaggacccucaaacuggcugugcugcucacaccuguuucugucacuugagaggcugaagcaggaggaucaccaagaacuugaagcugguccggucuauauaaacuugggaauuauggccuggccuuaaaaguaagacccuaucucaaaaacagaacaagugaccaacucaaggagcuggagagcacuggcugcuuuuacacauacaggacccagguucaauuugcaccacccagcaucacguggccuccaugggcacuagacaugcacaugggacagggacagcaagcacacacaggaguuaacaguuucauugucacagcugacggguccuggaucggcugugcucagcuggaccgucauuuacgauugcagggagugaaccagacuucauccuuagcucaugcagggaagggcccacuuucuggcuuaccugcuauagaguuccauucuuuguugcuauggucugagggcuuguguuuugagauuuuuuuccucucugcucuuggccaguaauaacucuuaacuuugaguggcuuccccaguuccuugcuaccugagguuccagacguaggcauuagagacuccacuuagcaugccggacauugagaucuuagacaacaaguucuuguuagccuaugcaugccaucaccguugucacguccucacaggaggggaucacaggaugaaugguaugaaucagaaacaggaucuggggcaaccuugaggaccugacacauuuagaguuuuagagaacaaguuugccuggagaaugaagggauuaugagaaaggaaaaaaaugcuaggauggagccuguuccagcaggccaggaaagugacaugcacaaggccaguaggucggcaggcuaagagagugacagagacauuacugauauauacucgcagccauccuguaaugagaagugaggagaauuuguggagugaaagucuguuaaaauaguaagcacacacauauuuguuucucaagguauuuauuuccucugaugaguuugaaacgcuggugagucuugcagcuaacacagcugcccuagacugagcgaguguggcuuucgagaugaugaggucagugauaauagaagcccacgcagcugacugacugccuggucccacucaugugguccucacuugaaacaauggcauuucccaauucuuuccaggauccagaaguccugggccucuucuguguugguggugggaguguaaauggugcagccauugucagcaguagugugccagacuguauaaauacacacacuuacuguacuacacaacaaaucuuaacuacuggcuauuuaaaccaggaaaaugaaaaacuguaaucgcaugaaaacucuucccaaauguguacagcaacuguauuuauaauagcaaaagucuagaaagacuggccagucuucuugaguggguaaauaaacaaaugguggcacauccacacugaggaguccuacugagccauugaaacaaacaacugaaaugggucaucugacaaguagcuuauuuuauuuuauuuuauuuuauuuuauuuuuuaagcucgcuccauagcuauagaugugguuuagucauuaggcaacucauauagaggacccagauuugagucucagcacccacacagaacuaucuaaacuccaguuccugggcaucugauaaccucuuucagccucacugggcacugcaugugugugcguguccacacacacacacgcgcgcgcgcaugcaugcaggcaaaacacucauaugcauaaaauaaaaacaaauccuuaacuauuuuaugugugaguguuuucucuauguuauguguuuggguuauguuccuguuugguaccugcagaggucaaaagagaucaucagauuuccugaaauaaaaacacaucuuuaggagcuaaagagaugguuuagcaguuaggucacugacugaucguuuagggagcuauguucaaugcccagaggucacauggcagcucacagccauugauaacucuaguuccaagggacccagugcccucuucuggccucagaaggcaccaggcguguaagugguacacagauauacaugcaggcaagauacccauuuaauuuuuuuaaaugauuaaaaaauccaaaucuaaaaauaccagucucaaaagauuacauauuauauaaaucuguuucuagaacauuugugaauggcaaaauuauacugauggauuaguucggcaaggguuaggugcugaagugauggagagaggguguccuguccauacagucuugaacauggcuugugguaacaggacuuggugucugagugaaugagugccaacaccagcuuccuaguauuaguacuguuaguguucugugagacguuaccauuggagaacucagagaaaacagaaaaaaacacugcuuauuuuuuuaagcuugcuguaaauauaauuacuucaaaauaacagguuuagagagcagaagcaaacccuauguguuucaaacccagagcuuuuccauuucuuaucccuagaugccaccacucccucagcuacaaacucauauaaguuugugaguguagugaugauaauggcuucaaaagucaggguucgcuuuauuccaagaccuagugacaugccacagaugccacuugggaauauagcaauaaugucagcaagaaaaagcaagcacauugcugccuuuggaaauacuugcacagggauauuccugccacccaaauaccugugaauaaauaauaacuauuuacuucuaggguugaagggggauuuuccgguucucuuuucuuuuuguagaugugugcucaugccuguuaaagucagguaacaaucaggauguuguuucuaagguguuuucaugacuuuaaugcaucuuaguuagcaaacuggggaggaaaagauuuauuuuagcuuacaguuguaguccacuaugaaaggaguucagggcaagaacucaaggccugaacugaagcagaaaccaaggcucagucagcuugcuuuguuuuaaaguucuggcugucuugaaacucccaugugagugcuggaauuaaagguguugucuuagacaggguuucuauuccugcacaaacaucaugaccaagaagcaaguuggggaggaaaggguuuauucagcuuacauuuccacauugcuguucaucaccaaaggaagucaggacuggaacucaagcaggucaggaagcaggagcugaugcagaggccauggagggauguuccuuacuggcuugcuuccccugucuugcucagccugcucucuuauagaacccaagacuacccgccagggauggucccacccacaaggggccuuucccccuugaucacuaauugagaaaaugccuuacaguuggaucucauggaggcauuuccucaacugaagcuccuuucucuguaauaacuccagccugugucaaguugacacccagaagcagccaguacagguguaugccaccaugccuggccagccugcuuccuuagaccauccaggaccaccugugagcuggugcucccccaucagucacuaacaagagaauaauaccucuggacucaccaggcaaucugacagaggcauuuucucauucaaggcuccucuucccagauaacucaagcuccuguugaguagacaacaggccaacuagaacagaccugcuguuugacaggguuucucaccaccugaaccuucuccaagcuggacagugagugucacugucucuaggauuucacaaaaauauggugugugccaccaugcucagccucuuaguuucuauggaucugagcucagaucauaacauuguuaggcaaauauuccacugcacagcucugugguguuuaucuuguuuuucauuaaaaaggauugucugagaaacuaggccuaggcagauccacauguacacaccguguggccaguaaagugaggacauugcucauccccuuacaugguucuuagcaucacacucagguuacgcacugagccaucccuuucccccaguccugggcuuuuguuguuguuaagguaagaucucauggguccaagcgagccucgaacuccacacaagacgagacaagaugagggggaccugaacugcugcugucuacaccuccccgugcuggggcuauagacaugugccaccacaugccguuugugugcuguuggggacugagcccauggccuucccauggccuuacacaagccaggcaaggauucugcuauuguauuacauuccuggcccucacaaacacuuuuaguuaguuuucuugguucauacaugugguguuaggaugugcauuacagugcagcugauguucccuguuacauccuucuuugcagggggaauuuguaaacgaguaugucggugaauuaauugaugaagaagagugcagacuccgaaucaagcgagcccacgagaacaguguaacuaauuuuuauauguuaacuguuaccaagguaaaauugcuuuuauuuuuugguaagaaaaagggacguuuuguguucuguuugugauuuuauguugaccucgguuucuguuccuuucauuuuuuuucuaaguaaacuaugaggauuuucaguaguuggugcuguuauuaucucaggauuacagaaggaaccguccauagucaggagacuauggagcaagagggaaaugcuaagaaacaaagcgaccaugucugaggcagcuagagaucuggguucuuuauuacugcuggagaaaucaacuauaacugaguuauuaaauaccuugaaauuuuucauuagccuaaagcucaaaaguuuucucuguauuuauuaagcuuaaaaaaaaugacaggcuggagagauggcucaguaguuaagagcacugacugcucuuccauagguccugaguucaagucccagcaaccacuugguagcucacagccacagcagugggaucugaugcccucuucuggugugucugaguagagugaugguguaaucacauacauaaaauagauaaagucuaaaaaaacaaaaaaccaaugacaagaggguuggagaaaugucuccauggcugggagcguuuguugcuuuuacagaaaaccaggguccgguuccgagcucccgaguacuggcacacaacaauuuggaacuucauucccagagaacaugacaucuuauuucuaaaggcaccaggggcgccccgugagucacauacauauaugcaggcaacauacucauacguguaagacaagugacaggaaaauaaugaauguuggcauaagaacaauggaaguaaacuaguuuaaauaaaacuuuagccaggcacuguggcacgcaccuguacucucagcguuugggagguuaaagcaggaggaucauaaguuuaaguuagagccagccugggcuacauaguuaugauccugucuaaauaaaagagaaacaaacacagaaaagaaaacagagcaucgaagaccgguaacugguaaauugauuuguauuugcgugucucauggcagccaugaugucauuucuuaucaucauccuuacagaggacaggaagcccaggccuagguguaguucagucuuuguuuaguacacuacuacacaccaaggaccaagacuaguccuccuguuccacguguucugugaugguucuaaaagaaucagaaugucaucuaagcugaggccauggcuccgugcugaagcauguacugaaggcaugugaggcuguggguuugagccucaucucaagcaaaaacuugacagaaaaccaacaaaaaacaguaaaagagguugugggcaugguggcacacaccuuuaauccuagcacuuuugagacugaggcaggcagaucucucaguucaaggacagccuggucuacauagcauguuccacaccaaccagagccacauugucagacacuaucucaaaaaagaaaaaaggaagauaaacuauauguaguuaugucuuaugugaaaaguguagccgggcaugguggcucacacauuuaaucccagcacuugggaggcagaggcaggcgaauuucugaguucgaggacagccugcucuacagagugaguuccaggacagccagggcuacacagagaaacccugucucgaaaaaccaaaaaaaaaaaaaaaauuaaaaaauagaaaaguguacagcuugcacgugcuacaggguaaccucgacugccgguguuaggcuggagucugcgucucgaauccucuuacugaguucaguucagugacagcguccuguguguucaggccuuggcacgaccucacuguuagaguccacacugacagaccuaacugucuaguguuuccugcguagguaaccccugugagaggacagacaugaaggacugucaccucccgcucagagagagucucauugcccuucucuguccucguggguaaacucguccaucccauagcaguuuaucuucuagcauagaguucaagagagaagcugagaaggaacugccugagcaguugguuaccugaaccauauagcuccgugcacgaucaagaaugccuaaacaugugaccugcugcugauccuuauuuauuagacuaccaucagcaguuucuaugcaguuucuagaaagaaagaaagaaagaaagaaagaaagaaagaaagaaagaaagaaagaaagaaagaaagaaagaaagaaagaaaagaaagaaagaaaaauuuaaaaaacaaaacccuaagguccucaaauagagaacguguuaacuccacagaggagugucugcaauguuuuuagagcugacaguuggcacaccagcugaugauaaaugauccugucuuggaguucccuaacuggauguuucuaaaugggcuuguauccaguuuauguugaagcaccccccacacacagacuuuuuuuucuuucugaaggaccguauaauugaugcuggaccaaagggaaauuauucucguuucaugaaccacaguuguaauccaaacugugagacacagaaguggacuguaaauggagacguucgaguuggacuauuugcucuuugugacauuccugcagguaaagcgugacuugcugccggggccccuccacgggggaagccugucuuaaaggcccagccccugagagucuauucagaucagacaacugggcguuacuugccaaugugguaaaacuacaucuaaagagaaaaccuguccagccuuucugcagaagaggaugugggagggucugccacagugcagacacgucacuucccaaaauagugcugucugcagaauagaacuagauggccuagcucuucugugcguuuaaagcauacuagagguaauuaacucauggaggcuggagagauggcucagcaguggagagucuauacuuguuuugcagagggccggagaucaaugcccagcgugcauguggaguggcucacgaccauacugcagcugcaagggucagagcccuccagcucccacgggcacccacacacauacacacauacacacauacacacauucacguaauuacaaacaguccaaguaaauccuuuuuuaagaaagcaauuugcuguccccacaccagcuggcuucuuuuucuuuuccucuucaacucugaagaucauucuguuucagguuagacuugaggagccucggagccaugguuacugcucuccuuuccuucccuccgagcuugucaacagaaccagcuaguuuuccaaguuuaggggcuugguaagggcggcucaguagcuagggcaccuggugaaaggcugcucagcauggguguguguggugagcuacaguuguaaauguguauugguucacaguggaaggcguuccuaacacugucaugacaccacaguagugucacuuagaaacuagagcuuagcuguagaaagagggcaaggcuggaagcccuuauuuuuaaaaaaaauuauuuauuuucuguaugugaguacacugucacuguuuucagacacaccagaggagggcaucagaucucauuacagaugguugugagccaccaugugguugauggguauugaacucagguccucuggaagagcagucagugcucuuaacagcugagccaccucuccagcccuagaagcccuaccugaccacaggucccaugcccagagcucuuauuucauuguuuucaccacuuuuugcugaaggguuuucucuuuuuagaacaucuuaggugggcagggauuguugaccacaaggccucucucuaucauuguuuuuagugagaugggguauggaaggaagagucuguaguuaugugaugcgugcauuuauaugcgcuugugaggacaaggcaggaacuccuaggacucugcuucaccauggaaucugaauccaggucccauugucaggcuuucauggcaagcgcuuucaccccgagccaccuugccagccugggacaagccuuugucucagaaccgugugucuacaugaaagugucaggcaguguuucucccuccuaacaucacugugaauaauuuguuucuccuguauuucagggauggaguuaacguuuaacuauaacuuggacugucugggcaacggcaggacagugugccacugcggagcagacaacuguaguggauuucuaggagugcggccaaaggucaguuguacagggcacuccacccagggcaggaaagggcugugcuacagacauuagcuuaugaccugcuuggcuuuguuacagaauucccgcugcucccucaggucuguggugacgugggggugguuuugagaucucuuggagcacaggcuggccuugaacucucucguucuugaggaugacuuuguuuuuuugguuuuuuuuuuuaauauuuuuuauuacauauuuuccucaauuacauuuccaaugcuaucccaaaagucccccauacccucccccccacuucccuacccacccauucccauuuuuuuggcccuggcguucuccuguacuggggcauauacaguuugcguguccaaugggccucucuuuccagugauggccaacuaggccaucuuuugauacauaugcagcuagaaucaagagcuccgggguacugguuaguucauaauguuguuccaccuauaggguugcagaucccuuuagcuccuuggguacuuucucuagcuccuccauugggagcccugugauccauccaauagcugacugugagcauccacuucuguguuugccaggcacuagcauagccucacaagagacagcuacaucuggguccuuucgauaaaaucuugcuaguguaugcaauggugucagcguuuggaugcugauuaugggguggaucccuggauauggcagucucuagaugguccauccuuucgucucagcuccaaacuuugucucuguaacuccuuccauggguguuuuguucccaauucuaaggaggggcauaguguccacacuucagucuucauucuucuugaguuucauguguuuagcaaauuguaucuuauaucuuggguauccuagguuuggggcuaauauccacuuaucagugaguacauauugugugaguuccuuugugaauguguuaccucacucaggaugaugcccuccagguccauccauuuggcuaaggaggaugacuuuggauuccugacucuucugcccucacuccccaaacacuggaguccaggcggaggcuaccacacccaacgugcuauucuuacuuuauaaugaagcuuguuuuaguaaggucugauagguucugaaauguauaaaauccacugaauuauauacuuuuaaaauggugaauguuaccuggguguggugacucaaauccuagaacuugggagaaaaaagauuaauuccaggauaguuaaaaacaaacaaacaaacaaacaaacagaaaauccugcagaaauacaaaaguauauguugucauaugugaauuucggggaaaccucaggcuuucugaagucugaacacugaugaguaaaagagcuugcagugaaaucuacguuccaaacaaacaaacgaaauagcucagcagucaggacucuucauuaaagugaacuugucuuuaaaaacuccauaguagccaaugauagucacugugcugccaccgugcccuagaacagagggcagccuggaaguccaggugcucggcuggaguggcuccugaagagcacgcaccccucuagaggaccccagcucaguuccccgcaucuaagucagacagcuuacagcauucugugacugcagcccaggggauuugguucuuccugccucugcgagcagccgcauguacccacacagacauguaauacagagcaagucauuaaagaucauugaaccucuagaugcuuauccaaaaugcuucacugugggagcagacaacgugggccccaggcacaucugucugucccucugagggacagcuguggugcuggugggcaagaccaccaaggugugcaaagccccugggguaucuggaaaacaacccagcucuggagaaaugguugccucgcaccuggggcuggggcugagggguguuuaugcucaccaaggagggucucauuccacagucuaugaucuguggcuacuuaccgcuccugacuuguccugaguucaccuucccacuugcugaaaacaccagggccgccugcugcugcucuugcuguggccccagccagggccagagucagaggaggcuaaggggacuaguuuuucugacuaauuccucaagcacccaccaacucagccagcuuaauuugagaaacauguaaaugaaggccuacaccccucucuuuaaaaaaaaaaaaaaaauucaaggaaggggcuggggagcauguucaguuguuagaaagcacuggcugcucuuucagaggaccagaguucaaaucccagugcccacguggccgcucacagcugucuguaauuccaguuccaggggauccaacucccucauacagacuuaaugccaguaacaucaaauaaaaauagauuuacaaaugaaggcaaagauaagagaguacuguaguucuuauccacagcugccugguagagucccagcugagcguugacaggcugcuguacucacuguaguguccucuggggucagcccccugcugucuuuaggacacaugcagagaugcacagguggugcgcugugugugucuuccuguguaaagcaccauuguuagccgauguuaaaacccuggucugucuuucuugccagucugcaugcacaucagcaguugacgagaagacaaaaaaugccaaguugaagaagaggcggaaagucaaagcggaggcaaagccaauccaugaggauuauuguuuucaguguggggaugguggagaacuggucaugugugacaagaaagacugucccaaagcuuaccaccuccuaugccuuaaccugacucagccaccccacgguaagccaggccugcaagcuucucuguuuccauuucaccacugauuugggauacauugcugucuuuaaugcaacugugaaaucagaaacauuuaacguuacaaacagaacuacucgucagaaaucuguuucuaugcaaaugacguguaccucaugugguauugagggcacauuuccuguuuauggucgccauggguuguagguggcaccuaugacauuggguuugggccaguagcucauaucuguaugaaagaaaaaacacuacaagauggaaguuuguuuggcugaaguuuggagagggauucucuaagcaaagcagguagaagccaaguacaguggugccauuguuaaucccagugcuugggaggcacaggccagaggaucgaggccagccuacacuuuggagaaagaccuuguuucaaaaugggguuaauaacauaugccuuuaauccuagcacuuaggaaacagguggcagagcagccaggcuacacaaugagacuuugucuccaaaaaggggaggggguaccucuuggguuuuugguggguaaucaagaaaucagcuaacagauacuucccucuccuccccaccccugcauuaggaaagugggagugcccguggcaucggugugacgaguguggcaguguagccguuuccuucugugaauucuguccacacucauucuguaaggcucauggaaaaggggcucuggugcccucugcacuagaaggucgucucugcugcuccagccacgacccugcaucuccugugucaccagaauacuggagcaagaucagauguaaaugggaaucccaagauaguggagaagaaguaaaggagugagcgguggugaccuccucccacugcucucaguaaagaggcgcagagaggccacgccugcccugcccugccgucaguccgccuugacggagaugggcgccagcucacacaggcuaaagcacuugcuggugucuggguuuucuauuuuguuguuugggggauaauuuuguggacagcaaaauucccuuggucucuucuugccuuucauugugcuucagugucuuugcaaucagcaaaagagguguccuuguuuuuagaguugagagagagaaaauuaaaagaaaguuuugucuauacgaucaguguaaagccuaagauguacucccggguuauguaaagugaaaguagucauuccuguauuuauuuucauuuuuagguauucugagaaguguaguucaaacaaucuaaccuccaugagugcucgugcguguacgugcgcgugugcgugugugugcaagcgugcaugacugucaccuuuauauaccucuuuccugagccauagaguggcuaacuucucuuuccuuuuucccgggccuuuucucgggucagagaaggcucucagcaaguauucagacuggccucuugaaaacaaacuccuugacagcauuuaccucuguggucuuaaacugggugggcuucauggugcgccaacucuacguagaaauaucuuagagggacaaggagugagugcauucuacucauugugauuuucugaaacauuugagggaugugaauacauaggggaaugcucauuccugcuguccugaccacuggcaagaggcuaaagaaagauaaggcacagaccaaacauuggaucauauaugcaccauuuucugaccaauuuaauguagacuccagucuaaccuggaauuuaagggcauuuuauuuucugucuuucccucugccaaucauguuuccuuugccagcugggucacucagucauguuuccugguaaagcuauauaacugaaucugaauuauaugaaauagacuuuuucaguugauuuccuaacuuagggaugaugcaaguggacagaaacaucccuaaguuauaugugaaccauuucuacuuaguauuaugcaauacuuaagacuguccccauugcauaaggggaagaacuugcucuuuuacaggguauguaggagccacagagaugcuccauguagaaagcacuugaaaccgccccccacaaagucaguguuugcaaacauggcugugagguuugaauaguacagacccaagcauaccaaggcgucggcccgcagaauucacuugcaucuagcacuuaggaucuaguccaguauuacuugugugaaaucaugucagacaugguaacauuagacuaaauaaaaaucuaguguuaccaugaaauaugaacuuccucaguguguuucaacugcuuacuggagguacccaguaggcucucuucuccucaagaaccuauacuuuacuaacguagggcacgagaugcucuaugacacccuguaguuauguuaggugcguuuguccuuuuuuuaguuuuuuacaaaucaauucagaccucaucucuggacaaaagaaagagcaauuuugugccucuuuuuuuuaaauauauauaaaugugcaauuuauaggcaacagacacuacaguuccucucuaagcuccugaacugccauuuaccuagucuagcacuugugguaaucccgcuggcuagacaagcuccugugaggagggagacaggacgguacccagcacccagugcagucccuacgaccgacucgaacgaagcacagcccacgcaaacacuaaacucucugcucuugagcaauuaugaaguuugauguccuuuaaaacaauaauguaagaguaucuggguuuugucauauuaaauuuuauuuuauacagacauaacauuuuuuaaacuuguugauaagcgacuuccuuugauauuccaaauguaacccucaugagaacaauguccgauaugagauuguaucuuguuuccuuuuugaccucgugcuuuuuaguaucugauaacuuuuauagaguaagccccaggguucaucauguauuuauaaauacccuacccugaccuaucucucuccugcuucucugcuauggcucgcuuguuuuuauaucuauaaaaggacuuugcacuuuucagaucuuuuccuacuagaugacuaacaggcuugcucucagaagccugccugcuccaagccaagugcaagggcgacugccugugccaucaucgcagccugggucuuagaacugaggguuaggaagcagaacguuggcugacugguguaaguauacguacaccgucggucguuucauguccugugucagugacauugcaaggcacugugcuuacucggagccugaagcugcuuggugguagcuuuucaauaugguuuagguauacagcauuugugguugauuuuauucagcccagaaauaaaggacucaaagcagcaugggauacuagugguauuuccuaaccucaggaggaagaugagaguucugguuaucaguggaaagcuuuagaaauugggcuggaaagagcuagagaugauagcacgagaccaucacaagcacugugccuuguaggugucgcugggccgccaggguagcugccugugucuggccaagcaggaugggaccagugcucgucacugccagugugcugcaguaaccucugauuucagucuccagucaggguggggaucagaguggaguagguuuuaucuucacuuuugcuuugcaagcccuaccuacucuuauuuuaauucucaaaaauuaccuuuccuaagcuguagaauagacuugaguuuucugugcguuauauaaauaacauauauauauauauaaauauaaaauguuuuauauauauaagugguguguguguguguguguguguguguguguguguguguguguguacacauacauacugaguuaggaaguauuugaaacuaaagagauaauaagggccugcagcccacugcuucugucagugucucccacugcaguguuugcggaaguguguguaacuaauauggaucugagauacugagggucugucugcucaugugaaauacucggcuggacugguaggcagcuuuuaugcaguggcuucuuuuuugaguacuuucuuacuguuucgggucaaagccagacuacaguuugaaguccucccauuaucuguucagaacauagacccggcucuccaagaccugccgcuaaucuugucaaaacaacacuccucuugcagcacuuccccacggagcuaaaaugcugccaaccacaugccaugcccuaaugggagagggagacaaauugccucagucucccugagcgugagcagcguauggucuuuauguuucucaaggcacugcuucauuucuagacuugaauugcuuuucacguggcuguugcaucugaccaucccggacucugccaggcugcuaagggcagcguggaagugaucggauggcaagguccucaggaaggaccgcccacacuuggucuuugcuuauuuguaacagaaugguugguuacggaaaggucuggucccuccuuggauggacgaagggauccguguaggcagcuuugcaguggauuguuguauggacugaggugucacaguuuucaccuugggugggggaaugggaauguggggagaaagggagggaaagguacagugcaguuccccuaacaccgagacccccccaccccauuugaauucaggcucuucaauuccuugggacuucagauucucauuuuauauuuuacaguuuuaaaauuaagacauggaaagcaucauguuguauacugucagauaugcaguccucccgacgggagcacgggcaucuuagguuucuuggcaccuuugaggucggagcucgugcauguugagaaaugauuucccugcgucuuuguuuugccuuuuucuccuuuccuugccucaccccuggguagcuggucuuucuguuuaacauaugcuuguguggggggaagagggcgcacuuauguuauacuccuaaaaugcuauguauaaccuuuguuucaaaaacccauuuccacugggcaugguugcacacgccuuuaauccuagcacuccagaagcagaggcaggaggaucuccgagaguucaaggccuaccuaacgcuucccagccagccaggacuauguagagagacccugucucaaaaagggggggaaaaucaauuguuuggcuuuugucaauccauugcaaaaguggcagaugugagcgcuuguauuuguguaugggggaggggggagaaaaguauuguuuguccuucaguaggcucugaaagucauugacuuguaaguucaagggaaaauagaaguugccaaagucaguauucgguccuugguuuucuugugacuucacugcguccguuaagggacgagaagccuuccuuaccugcugacugagccuugcucugugcagauggcuuucaaguaucugccauuuugccucaacagggaauucuugucaguuaaagggaaugagggaauuacacuuuuguuaucaauuaacaucucauuuuuuguacccuaugguaaguaacuguauugccgcuaauaaccaaguugcuaacugauuacagcuggcuaaaaaguucuuuuuauauacaaagauuuguguauuuucaacugcuauggcaaauucauuuguguccauuuaaauauuacacaauaaacacauaucugcagaucccacccucaccuuguguucuuugaauaaaguucuugauagauuguuuacaucuguauuuaccuguaaugaacgcuguagaccugugaaauaucaaagugucaacauccauuagucagucucuuuaguuucugugacuuggcgcuccuaacacuaagggguuaguguuaauguuccccagggguauucuacuagggcauuacuguuuaaugacuucaaaauauaguuuaaggauuuuguuuauugaccaaugucuuauugcaaaguaugagccuaccaucuuaguuaaccuguacauaucuguuaacuaguguaguguaugugagauugccuguaacauuugagcuucuuacugaugugugcuggugggacagguuuuguacauuguauuuacuggaauccugccuuuuuaacuuacagauacuuuagaauucaaauauguuuucugcuucuguaagaaugugggaaagcuuuuaauggcauuccauugauuucaggucuugcuugagguugacuuuaauaaauuguccuguauggucuacuuaag

SEQ ID NO: 4359 - RNA, 4853 nt, Mus musculus
guuauaggaagaaauacauaagagagacuuuuauuuaaaguauaauaacaauaaaaugguagcuaucaguugguccuccauaccaaguucuggugauagccucuaguugcgccauuuauuucuuuaugaacaaaggcagaaaguguugcauuuauuuucuagauaauaucccuaauuuuucuuuccuaauguaguaaaaaguaaaaaauuggccaaaauugaauguuuuauuauuuaaggcuuaauggaauguuaccacaaaaagcaagccgaaucagaguuuagcuggcacugcccuuauuuauaaaggacagggauuauguucgguaaauggggucaugaaagcuuccuuuguggaaagguuuccucuggagugacauuuaaucacuguagacacuaggucuuagaauagcaauccuauggauuaaccuagugagagaaguccugacagagccgugccaggccaagcacugagaccucaggggcuagccuuggaagugggguaaagugcacagccuugcggaggcaaguacaguguggcuguguccucacuuagacccugaagaggucaagccagaaauccuuggcuugugcguccuguccaguuaggaggguugaucugcuuguucuccacugagguagauucagcuaaauuuccaaauggugcaacucacugggcuucugugaggacggaaguuugugcuuguccugaaaugguuuauggcacucuacgucagucagagggggguaguacugccuguagcagacauaggcaaaugucauuccaaucauggagccaacuagcacaucugaagagagaaaauagcaaccccuuuaaaaccauguuagaugcuccacaguuacagaguacuuggcccucccaguuauucugcuuguaggggcuaaaauaaaaaaagagcuccgaaccuaugcuauuaguuucuuuagagcaacuugauuuuaccauacaguuacagaauuauuagucugauuguucucuaaacaucaagucaacacccucaguuaaaucagcauggacugaguuagauuuauuuauuuauuuauuuuguuuuuucgagacaggguuucucuguauagcccuggcuguccuggaacucacucuguagaccaggcuggccucgagcucacaaaucugccugccucagccucccaagugcugggauuaaaggcaugcgccaccacugcccugugaguuagaauuuuuaaacaaguguuuuugacucuagucaucgauuuguuuucacuauuucaagaauucuggggcuggagagauggcucaguggcugagagcacugacugcucuuccagagguccugaguucaauucccagcaaccacaugguggcucacaaccaucuauaauggggucugaugcccuuuuuggugugucugaagaagcuacaguguacucacaaacauaaauaauaauaaaaaagaauucugccuaggaaugguggcauacgguuaugaucccaacauuugggaggcugagacagaggccugcuucugucuaggcuuugcuagaggcgaggcccugucuuaaaaauaaagggagcugaggcacagugauguacaccuuuaaucccagcacccagcagacagaggcugcuauaauucugugaguuugagccuagcuuggucugcauagcaaguuccagggccauccagggcuaacuagugaaacccugucuggugggguagggguguguuaacagugagagccgaggagcuggcugagcagguaagagcacuuacuugcaucaacaagaagacauggguucaaauccccagcacccucauaaaaagcugagagcaucugugcauguccuuguaccagccugugccggggaggguggaaaggauuacagccacuugcuugcuucccccaugauugggggacaugcaccugcauacacgugcauauguaacauauacaaguuaauuuuaagaagaauguguguguuuuaggcgggggaucuguguggaggugagaggagaauucuggaauccauccuuccucccuucccucccuccuuccuuccuuccagggaucaaacacaggcugccuggcuugugcaucaagugccuuuaacucugagacaccucacugccccaagccuuuguccucuguggcugcaggugcgcacucaguacaauccacaggcuguccccuccuccuccacugcuccuucacucagccgaugcuuagcaagccacccucugccaaucugggguuaaaacaagcaaagcacaaacuccugugcuuaccuugccaguggugcuuguagucacacgugcgggacagugcaaucacggcugcaaagaguaaaggugacagaaaggcacagagccuccaggacuucccucggccuuguggcgugaagcaguguaacuucccugccagguagaaggaagcaaaggccagaccagcaaaugcaacuagaaagggaagaccugugaguuuuguguccugugggguccccgucacuccuguccagacagggcagggagcaagagcagggcuuaccccuccugauuacagggaaagggaaaaaaaugaaggacuguauuuucugucccagaguuaguauuuuaaguaacaguaguuucugguauaaaacuuauggugagaagucuacagcaccguccacaguaauaagugggaaucacaaaaauauaccacgcuggguuccugggagcuacaaaggucacaauguaaaaggcugggcagccccucacaaguaguagcucuuaaauauauuuuuuuuaaugacuaguaagagauggcucauuccuccaaagcuuuaagguuaaauguaacucuauuuaaaguagguaucagagcuggaggagccaagaguugagucggcagcaguuagcuuuugagaggaccuugguucaguuccccaacguggcacucacacuggucugaccccaccuccaggggaucacacaccuucuuccagccccuauaccauuugcgugugcacacguacauguacagguguacacacacacacacacacacaaagagcggaacauggacauguaaguauuuaaguaguucccaugaaacucauacaggaagaauguccacuggggaagcucuuucggcccucguucaccacauccucgucccccgugcacgucagaucagaaugggccagcccaucagggaagcagcgguagaagaagucugggcggggccuggaagaaauauaauuuacucucucaggaaguauuuuucaguaauaguagaugucaauaaucuguugaccacuaaugucauaggcaaaauaauguaauggggugagauuaguguuuauacugagaaaaaggccuuagccacgcggccaauguucaagaaagucucuagcauaugauuguaucuuagcacagagcagcuagucauacugcagcuuuagguacauaaagguggucgcugugggaaauacucaggacaggacgcagaccaggugguacacuuggaacaggcagagggcagggagagggaguucuggugagaaaggagagacuagucugagaauccggguaaacacugcuugagaauguggugguguguguguggggggcgcucagggagguuugagugccaaggcuucucacuuaccugcccacuaucaguuugauuauguugguaaagacaccauucagagcuagggcaaggcuggcagcuggaaagcaaagaagccguuagugccaucugcuuggagaagaguaagccaccaccucaugaguagagccuucauugcuuugagauagaacccaaccagaauaaaaacccaaacggccuaggggcagagaaguggagcacugaggaacaccuauguggcaccuguguuaauagggaacaccuguguggugucuguguuaauaaggaacaccuggccgggcgugguggcacacgccuuuaaucccagcacuugggaggcagaggcagguggauuucugaguucaaggccagccuggucuacaaagugaguuccaggacagacagggcuacacagagaaacccugucucgaaaaaacaaacaaacaaaaaggaacaccuguguggcgccuguguuauuaagcacauucucaucaguacugcuuuuuggucucaugggguaaaaagacauacuuuagggguacagaguagcugaaccccauagcuacuugccaacacuaagacaggaacaacuggaacaagggcgacuuaccgaggcaggcuugcuugcugucgguagcgucagcuuuccuuagaaacuuggcgaggaagaucagggacaguggagugagaaaggcaaugaccugaagguaaaacacagggucgguaaaaccaagucccuccuggccuaaagcaccagcugccgcgcacuaaccaagaucggggcucagauugcccaccagacgccucgcccuagcccuggaacucaaggcaggggaggagucccugccagcggaggagggcgggagggcagcucacgcacaaacaugcggccgguggggaaguauuccgccuccacguacggguuccuguagagccacagcuccucgggcuggauccgccgcuggaagggagggagcagcucggucacccuggggaggaaacggggaagauugacaggcuaccucggcggaagaaccugccgccccgagccgcuuaggaagugcgagcgcccagggacgccugggagcguugacagauccuuacaggaaagccacaaagagcaggacccgcacgcccagcucggcucccagggccgccguccccaucccgccauacgugcggaucagacgcugacguggccccggcgcgccgugguuccg

SEQ ID NO: 4360 - RNA, 30766 nt, Mus musculus
caugaggggucagaagguccgauuuuccuccuucaaagccucagcgcaggcaaggccucccgugcgugucccccacgccccuagcgcgugcccggcgcgugcccggcgcccgacgucugcccgcaggaggagccaggucucgcgcgagucccccaguccucaccgcacaucucgcgacacuucggaggaucuuucugcgccuccggcucucaccgggagcgcagccuccgcgggcgcacugcucuccuccgcuggagcgcugaggagcccgcgguguggggauuggggcgcggccgcaggcuccgcccguccgccccgcccggcuugggagguaggcugcagcggcgauguggcccgggcucccuccgcgagggcugagagcgcgagcggcgguguggacgagcgaguccagguccgcgcgggagccugggccggggcgagccggggguggagaggcuccagugugcacgguaucccggggcauccguggacggcucggcugcucuccuagaucccgaacucggagccccgagcuggcggcgggagcaggccgaggucucgggaggauaacggggaggcccggggaguguugguuccugagcugugcgguccgaccgugcccggugcagcgaugccgcucguccaucucccguccugggcuuuuggguucugcuucuaugucugcagcgcuaguccgccgggugcuuuagugcuggggucggugggaacucgcccgacauccaucgccccgggggcaguugaggucauuugucacuuuucauccgaaacucuggcucugcgucucggugggucgaugcgcagcuauagccugcaggcaaaguuucuguuugggcguuaaauguaccagagcccguauugaagcacacugggaggaucagccaaaaugguucuuaagcgauuaguucuguuuucuguauaguaagauuccaauaguuauguaaauguguguguaauuagaaauguacaauagagccuggggccuuaaaccuaccuguuauuacugucugacacacuaaaugguuuguagugugcacaccuggagguaggaaauuuccagccuucgcuggugcugcuacuuuuauugugaaaauugugguaaaacacccuguugcaaucaguuuugaccguguguuucuugacauuucuggguuuucuaaagagcuuguuguaugauuagacauuuuuuaguuuucuaaggagaauuggaagcucaguauagaaugauggagcugaacauuuuguuucucuccccaaauaauuguguguguauaaaaauuauguagcuuuuaaauauugcuguuuucaagaacagcuuccaaaaaugguuauugagcauaugaacauuacaguguuaauagaugcaaaauaauucuccugauaguuuuuuuuauuuugucuucuagagcgaaaugucaucgggggaaucacaccaggagcagcugucucagucagauccguccccauccccgaacucuuguaguuccuucgaacucauagacauggacgccaguaguuccuaugaacccguuucuccacauugguuuuauuguaagguacuagauuccaaggagcucuggauuccuuucaacucugaggauucacagcagcuggaagacgcauauggcucugguaggaagaaacugaugacucuaauaaaaacuaacaaguaauauccucuacugugauagccacuaacaugaaauuucagaauuacaccauuuucauccuuuuaaaacuguauuaaauuucugcauaguuaucaaguauuuuucucuauucuagcuuguguuugacuuuuuagucagaaaguuuguguguagagucgucacauugcagacugagcuaacaugucgcuuuuguucucauguaacaaaguguuagugaggauauaucauaauugcuauuaauuugccuuuaauccaaguaaaaacuucagaaaaaaucuauguauguaucuguaugagacugugaguguguguguauaaguguguauaagaggcauuauugucuuagaagaggaaaaauguucagcuaguauuugcuuuuuucauuaaaauauaauugguuugaaauacuaaaaauuacucaugaaaaaaauaugagcaaaaaaaaagaaaaaggaugagugaaaaaaaaaaaaaccuaggaaccaaauucuguuucugauguagccaaguggagccuguguacagcuccuguggcuguuuuggacuguaacuuacaaguguauuugggagaguuguugugacauaguggacuucuuuucuuuuuugcaauucuugauaggaaaagauuguaaugagaggauuguucccaccgaugggggcagauaugauguucauuuaggggagcggaugcgguaugcuguguacugggacgagcugccaucggaagugagacgguguacgugguuuuacaagggagacaaagacaauaaguauguccccuacucggagagcuucagccaagucuuggagguauuccucugcguccgguuccccgcugcuuucuccguuccuucugucccaauucuaacagaccgugugaaacuuccaggaagaggucaccugcuuuuaugucauacuuuauguaauuucucucugcaggcuaguuucaaauuaaaguuuuaacuucagauuucaaguuuucuagaaaugguauugugccuuuuaaauuuaaauguacccaggcaguggugguacacgccuuuaaucccagcacucaggaaguagaggcagguggagcgcuugaguuugaggcuagccuggucuacagagugagacccaggacaucaagaacuauacagugaaaccuugcuucucucuaacaaauaaguuaaucaaucaauuaauugaauguuucccaaugauaauucuuguuaacaucuaaaauauaaccacaaaaacaaucuuuuacauaauuuuuagaagauuaaaaaaaauuuuuuuugaaacagaguuucucuuugaagucccgacuguccuagagcuugcuaaguagaccaggauagccucagacucaagagagaucugccuuccucugccgccugauugauugcugauccuaaagucaugugccacgaugccuagcuguuuaaauuuucuuucuuuuaauuagggaguguuuaauugcuuguaagagcacccuguaugugcaguguccaaggaggccagaagagggcauugaagccucuggaacuggagcuauaaauacuugugugccguugugugggugcuaggaauugaacccagguccucuacaagagcagcaagugcucuuaacuaccaguccaucucucuagcuauaaauacuugugugcuguugugugggugcugggaauugaacccagguccucuacaagagcagcaagugcucuuaacuaccaguccaucucucuagcuauaaauacuugugugcuguuguguggguacugggaauugaacccagguccucuacaagcacagcaagugcucuuaacuaccagucuaucucucuagcccuaauuugaauuagucuuacucugagaaauauauugauuuuauugaacuugaaauagauuguuaucgauauugauguuguugaauagcuaggaauacaguuccgugguaaagcgcuggucuaauacaugcgaggcccugcauccguuuuccagcacuuuacuaccaagaguuuuaaaaugaauuuguuaacuuggagaauaauuuuucuuauuggaauucauuaauaaguuuggcuuuaaaaacaguuguuagagaaucuaauauaaaauacauuuucuuuuaaggauacguacaugcuugcaguaacucuggaugaauggaaaaaaaaaauagaaucuccaaacagagaaauuauuguauuacacaacccaaagguaaggcgaagauuuagaucaaaggucaguguauuacuaaggaaacccaauggcucuuuuguucugacgccacauagaaugaccuuuggcauaguuuauguuggacucucuguuauaaagguuauuaauguuuguagucauuauuuacuccaguuagcuuauguaagaauuuucuucuauauguguaugauguguauauguauauacugccuguguuugugauuuguguucaguguauuuguaaauguggauaugcauauacaacaacgugcuuguugaagucaaggccgauuugaaugucaguccuguucuagccugagacggaguucuucauuguucucugauguguauaccaggcuagcuagcuuguaaggcuucccugucuaccucccagaauccuuuguucugccucacaucucagcaccagagcuggggaugagguucaugugcugauucaaacucacagaaguucuugcuucugccucccaugugcaggaauuaaaagcaugcaccaccacaccuggcccaucugaucugcuaguuuaauguauugucaggcuucuuuuuuacuugcaggcuauaggacuugcaugucaaaacuccaauuaagguuugguuauaugacagauuuguuuuugucauucaaaaugucuuaaaucgcccacgccuuuaaucccagcacuugggaggcagaggcaggcagauuucugaguucaaggccagccuggucuacaaagugaguucaggacagccagggcuauacagagaaacccugucuccaaaaaaaaaaaaaaaaaaaaagucuuaaaucacaagugaauguagacuauauugcucugaucuuuucuguuuaagcucauggugcauuaccagccaauugcagggucugaugaaugggguucaacauccacugagcaaggucggccaagaucaguaaaaagaggcgucgagaacaucccuguugauauucacugugguaauguuaauccuuuauuuuuccuuauguucugauguugauuuauucuauaauuuguggacguaauuucucaaaaagagcaucagacuuauauauuauagaagaaagcaaagaaguuaggugacacaucagccaagguacauugaaguuaucugacacaaaacaaaaaaugcaugcaaaaagacuggcaggaaccaggcaauguuuacaguugagauaggaacagcccuaucuaaaaucagguauucacaggaaccaggugaguggucugaugcaaugcuggucuauuguuaaacucaccaccaggggucccuugguaaauaccuaguuauucuguuccucugggccuagugaaaaacaugccccagggcaguucuguacuacuaacccuuucaugaauaauacaguacuccaguuccuccuuaaaccacaacccaccuucuuucuaauaauauguaauguaggcugccauucuuguauguaaugagaauucuaaguauacuuugcuaagcuugcccugagauuucuagcuccuauccaguaaaauacugcaagaaagcaugcaagacccuccacaauaauugcagggacaaauuuggagcauucgugcuaugggaaugccaagguuccaggaggcuaaguuuccaugaaacauuuuugccuugggacugcaaccaagcuuuugggccugccacacagucuuuacuggaguggguguggcacauuuuaccaauugaaauacaucuggguaauggguguugcacucagugcgugaauagcaccagaaaaauaaaaaaaaaaaaaauuaguaagcuuuaagcucucaccuuccuuacucucauuucuagccucccccccccccccaaacucggccauggacggccucccucuuucuaccuucuuucucccuaccuuccuacaauaaagcucuaaaaccagaaaaaaaaaaacccaaaaaaacaaacaaaaaaaaguaaaauuaauguuguauuaaguaauuaaauauaugacuguuuuguaccuuuuaauuuaucuauuuuuauuuuaauuuuguuauauuuauaauguuucuaauuuuucuuuuuaauucuauuucuaggggaaccguuacaaauagaucacuuaguguuuguaguccaugggauuggcccagcuugcgaucuucguuuucgaagcauuguucaaugugguaggucuguaaagcauguaagauagcucauuugagaaacauuaucccugugagcaggaucaaacguugucuuuagucuguuaccuuaaguacauaagaagcuuuguagcuaaggaugcugagaaaggagugaagcuucccuuagaccugaggguugauaaguuccagagacuuaauucuccuagcuaguauuauuuacugugagugaguaauccuguaauccuggugaaacuugucugugauuuaaccagccuauuuauaaccaaauucagagccauaaggaugagaguuuaauaauagagacuuaccaguauuguaauucauagcacaacaaaccucuggcgaaccucagcugaagucaugaauguaacuuaauuuugaaaggcaguaucuuucuucacaguuugucccacuugggaauuauguucugcaagguuaagguugaugugauaaaaauguugaacuacaguguauuuuccaaaaaccuaaaauauuagaggauguggagaaggcucagcaguucaaagcacucauuggcugcucuuccagcacgcaugugcucauuggccucugcagccaauguaugcguauagcacggauacagcauggggcaaagcacacaccugaguaaauacauaaaaguaacuuugucuuucugaggaaggguucucccucuggcuguccuggaacucucuuuguagaccaaccuggccuugaacucggagaucugauugcuucugccucccagcuccuagaauuaaaggccucacuacaccuguccaaaaguaauuuuuuaaaaaauaaauauaaauuauuggcuaauggauguuuuuaaaacccggaaguuuugacuuuugaguagcugucuuuccagugaguuuacuagccuauuuccauuccaggagugucugucugucugucugccugccugucuuuuuagacaggcucucacuauguaacacuggcugaccagggaucccuuaugaggaugaccaucuggccugaguucauggaguuccgcuugcuucugccucugagugcuggcacugaaggugugagccgcacucccugcugucuuuuucuuuuuaaaaacuguuuccuuuaaaaauaauuuuuaaauauuaaagaauuaaauuuucguauuugugugcgggcacauauguggcacagaacguguguggaggucagaggacaacuuggagaagucacuucucucuaccauguggguccacagguguucaggccugggggcaggcaccauuacuuacugagccauuuugauagaccagcugacugaugcugcuucugucaaacacacaugaaaaaucaaacaggaaagcaguaacaacugcaguuaggguaagaacagggcuacaagaugcuugacguggagucaugggauuucaaaagcgaaagcauucuguuauacaguguuucguaugauaaacccaagcuuuauauuaaacuucuccuaauuacaugccuuagucuuuuguaggcuagugacuuugucuccagccagugugugcucugaggugcccagcaggugcugcuguugaugcauacguuaauuuucuuuuuuaguuaaugauuuucgaaguguuuccuugaaccugcuccaaacacauuuuaagaaagcccaagaaaaugagcagaucggaaggguggaguuucuuccagucaacuggcacaguccuuugcauucuacuggcguggacaugugaguagucccugagacccugaaauuguuaacugugauuagaguauuuuugauugucaucaugcuuaagaacauuuucuucuuaaagacuuauuauuagacauuagguacacuguaacugacuuaggaugcaccagaagagggcgucagaucucauuacagaugguugugagccaccaugagguugcugggauucaaacucaggaccuacggaagagcagucagugcucuuacccgcugagccaucuugccagcccgcuuaaguacauuuuuaauagcugauuauauauuaaaauaaaaauuaaagauagaaauuuuauuuaauaccuaucagagaaaugaacagcuugggucauugacaaagcauucauauuuaaaauguaggucuguaacuacucggaaccaucuguaacugcaggccucuuuguucccugaaauaaugauucugagacuucuuuuuuuuguuguuuuuuuuuuuuuuguucgagacaggguuucucuguguagcccuggcuguccuggaacucacucuguagaccaggcuggccucgaacucagaaauccgccugccucugccucccaggugcugggauuaaaggcguguaccaccaccgccuggcgauucugagacuucuuauauaugaaugaaugucuaggccaaaagccuuugauuguucccugaguagcacauaacuuaaucacccuguuauacuauucuaaguucugucauguggcugguuagcugguuagcugguccuccguuucauagaacugucuuccuucagagguuuccuguuucucuguauuggaacuuccuccuucccauuuucugucugagcuaauaggccaacagcauuauugacauuuuauuccauacaguagaagagauuuuucucuccaagugccucugagugcauauacuacuacauacagauuaacugaggagaccuucacuuccaguggugaagagaauaagcacccuggcggccuuggugguauaucccuuuaauccccacacucaggagauagagggagggggaggcacauggaucucugaguuugaggucagugugaguuccaggauagucaggacuaugacugucucaaaaagcaaagcaagggggcuggagagauggcucagcaguuaagagcacugaaugcucuucugaagguccugaguucaaaucccagcaaccacaugguggcucacaaccacccguaaugagaucugacgcccucuucuggugugucugaaaacagcuacaguguacuuauguauaauaauaaauagaucuuaaaaaaaaaaaagcaaaccaaaacaaaaagaauuaagcuucucauaaaaguauccccuuccugguagcccacucaguauucuccuucuucuuucucuuccuugcucucuucugcaucagaaucuacagcagccuccucccaguccuuccguaagguagccauguccucaagggccccaggguuuucagcauuaaugggcuucucucucuccugugugcuuucuguuuguaggguuugcccgggcugugcauuccguuacaaagcugcaucacaaccauuagcacuaagucucauugaugccugagggauacaggguuagccccuccucccagcucacuuccuccuuuugagaccgcgucuuacuguacagcccgugcugacucugaaauacugauccucgugccuuagcuucccaggguugggauuacagcccugggcugcacuaccauguacagcuacaaaguagagcauuuauacuuuuuuuaguuauuuuauguauauggguguuuagccuaugcguucucaucuacauaccaguguacaaaggcaugcuuggcauauauaagaucaaauuugugguaaaaaaacaaaacaaaaaaacccgccugcauuuuccugaauuuguacgccgucuugcacagggccaugcuaaucuuaccuguacaguucugauguuacuauaucuacugcagaagccaucccuauauauuuauaauuuuguggagauguauuauuaaguuauggucaguccuuugucuugagcuaucucugguuaaaauuaacgaauaguuccuggugugguagcagaugccuuuaauuauagcacucaggaggcagaggcagguggaucucuuugaguucaaggucagucugguauacauagugaaguucaggauagccagggcucuguagagaccuugcuuacaaaaacaaaaacaaaaacaaaaaacaacugauagcuccucacaaaaaaaccucuuuacuuaucauuacugauagagaaagggagagugugugugugcaugugugcaugcaggcacauugauuguagugcacauaugguggaucagaggaggacaaggaaauucacuuuuuccuauugugaguuuuguaauaaauacuuuuagcuacuaagccaucucacaggagugauauuuuuuauauaaaaauaaauaagcacucuaucucauuaguaugcaaauauguuuuaaucuuuaauaagugguaaaauuacaugcuaucaaagaauuacuuuaaauuauuuuauuauuuacuaucagugaauguuugauauauacuuauuuuauauauccacauaccuggagucacuuaaacauguuuuggaugaaaaggagucacaaguuuaagaaacugauaguuggaguacaugaugugaaauuuacaaagaaucaguaaaaagugaaagaacccugauauaugguauuuuuauauauguauaauuuauucaguaaauaucauucagaauguaccacuaugcauacuacauuuauauacaaaauucucaaaaaauuuuauuuaccaaguaaauguucaaggggccuauuguuaaugcuuguaauucuagcaugugggagguggagaccaaggguucagagucaucucaaagucagauccucucuccaaaacccuugauuccugauccucacacuccacagagucauggcagccuaucaugcgcugcucggcugcauccugagcuguucucauccaucucaugguuaacaaauccuucacucuugacaguuuccugugugugcucaguguaucuugauagugugcacucccaacacuugucagcaaccggcccaugaucucccugccaacuuuauguuuugugugugugugugugugugugugugugugagagagagagacagagacagacagacagacagacagacuuacucaaucugguuacuguugacugauggagugcugauuggugaccuuggcuugcccuuguacagauugauuguuuuuauucucgguguaaccauaacugcagugaguuccuggguacacacagcuauauuaugcccagaaagugccacuucacagcaguccuccccuuccuuggccucuuauaucuuuuuccgcccccucucugcauuguuucuuuuuauuuuugguuucuuacuuaaaggugauaauuuaguuauuuaacugguacauuaguagaucuuugaaagggggagacaacuugacaucuguaauaaccauaaguaaaaauugucuuauaauuaaaaaaaaaauaguaucuagugaguuuggggacuuagacgaagaccuuguguucaguccucagcucuguggggaaacguagcgaagaguuaggauuagggcuauaguuaguguauugguuaaaaugcccucacagaggaugcaaguucagguccuagcuccuaaacuguagcucacaaaggccugcaguuccaguucagggggcuucagcgcccucuucuggccauggucguguaugucucuaaccucaggaggcagagguagaggcagacagaucugugaguuugaggcccaucuggucuacacugcaaguuccaggauggccgugacuauacagacagacaccgucucaggaaaaaggaaaaagaagaaagcagcaguuuaaacuaacauucagaucuccaaaucuagggcagggaagccugggucagccaaccuccccaguccccuccccgugaggaucagaguuacagugcauggguuccccagugcuccuccauccuggagcuggcagugcuccuccauccuggagcugggccucuucucaggcccacagcccuucuccccaagaaaaacuggaucugggggguggggaagagagcuacccaggggaugacccuuuucuguggcauuagaaggaggaggaccuauuccaccucccccacacuccuggcaacccccagucaguguuugagccucuaugucccuuggacaccaguuggugaauccuugaugacaauuuggcaacuucaggaauaaacggcaguucucaugggaaaaauucaaauuuccaguguccagcugauaauuuauauaccuguaggacacggauggacacacauauuuaauacugaaaucuaagcugagggugaugcucuacaccugcaaucccuauuacuggagaggcugaaccaagaaucacaagaucaaggcuagccugggcuaugaagugguagccugucaauuuuuuuucuagacugagauucaaagucugugcucugaaauuaaaugucucucccuuuucuuuuuuuauuuccauuuuuuuuuuguuuuguuuuugcuuguuuguuuuucaagucggaguuuuucuuuuuuuaauguagcccugguuuuucuggaacucacuccguagacuaggcuggucuagaagucacacagaucugccugcaugacauggcaugucuccaucuuaacuuucuaaguuuuuuuuguuuugauuuuauaauuucuauauugaagaaacugggugucuuuauuugaucaccucuuuuuugcuucacuaaacauauuuuuucaaacuuuugucuuuucucugccuugauaaguaucucuucuauuauugcauuauuugauucuaagcuuuaagaauaaguuaaauaauaauuuagaaguaacaguggacuacauuuagguuuccugcuuaaaauaucuuuuuuuuuuccucccucagagaucugcagcggauaacccuacccaguaucaaucgccucagacacuucacuaaugauacaauucuggaugucuucuucuacaauagccccaccuacugucagacuauuguggacacaguagcuucugaaaugaaccgaauauauacacuuuuucugcagaggaacccugauuucaaaggggguguauccauugcuggucauaguuuagguaacaaaugaauucucuguagccagagaggacaaucgcacuaugaaaugcagugucucuaaucuguagcagagucagaaaaccaaguaaucaaugaggaagaguuugcaaggggucggaagcgggggugggaaauuggaaagauucucuguguugauuuucuuacauuuguaauuggcuuauaauguuuuguauaaaggacagccaaugucuuagaaauugucccuucuucuauuuuacuuauagguucgcuuauauuguuugauauccuaacaaaucagaaaaauucuauuggggauauugacagugaaaagguaauuuggaaguuuagauagguucuuuuguaguauucuguacuaaggauuuuuagauuuccagccuuucuuuuguauuuagcuauuuagucuuaugccauguuaaauguacauuuauuguaacagccugguaauuaugccuugccauucuugcgugcuagaagcaaggaucccugcauauuauagacuaagcauagguguuuuccuucugugagucugcacugcuggggcuugacuagaaguguuccuucuccugagcucauuguggaguguguaaggacaggaagacuggcgugggugcuuuguagaaguuaugugugaaagacaaggggagacaggauaaugaaacuucucuucauaaaguccauggacagacauuuuaccacagaugagauugacucaguauuucauagaccaucuucuaauuuauuuauuuuugaaaguguccuaugaacauuuggguucugaguucuuccaagacuuggguucugucuuagucuauuuugcaccuuuguuuuguuuuguuuuuuagauuuauuuuuuguauacauauggcuuuuuugcuuugauuuguuuuuuaaucuauaucugagcuuugcccaugugugugugugugcaucagaagguacaagaucccucaaaacugaugguugugccucagcuuguggaugcugggaacugaacucuaggguccucuggaagaacaauucucuuaaccacuggcccaucucucuagcuccuguauagcuguuuugccaguauguguauauauucauuguauauuuaccugcugccccugaaggucaaaagagggcaucaggugccauggaacugaaguuacagauagcuguaaacaaccaucugugcuaguuaccaaauccucuacaagagagcaagcugugaacugcugagccaccuuuccagacuccucaccugauuuagaauguaauguguaucaggguuuugccuucauguaugucugcaccaucccuguacuggaguccucagaagccagagaggacauuggauccccuggcgcuggaguuacaguugugagcugucaugugguugcuaggaagugaagguccccuggaagaguagccagugcuccuaaccacugagucuuugcuccagcccugacuauuucaucuuaaauuauguuuucuucauaagcauucauuaagggcuuuuuaaugauaauggagagacuuugauauuaaguaaaaaaaauuuuugccaggcauuguggcauaugccuuuaauuccagccucugggaggcaagagcaggugaaucugugagugugaggccagcuaggucuagacaauguauagugucuccaaaagaaaaaauaaaaauguagaaguaaaaaaaaaaauuaguugagauugcaaaaaguuggauaucccuguuuuauuuuguguaaguuaaaauguauuuaaaacugggugugguaauuauaccuguaaucccgacacuggggagguugaggcggaggguccagaauuaaaggaaaucucguccucaguuacacaguaaguuugaggccagccugggcuacauuagaccuuaucucaaaaacaaagcaaagguuagaguuaagguucauuguuguaaauaucuugaaugauauaucucauauuauaaaguaguauuaauaaagacauuuucugaguaauaaacuuuaugauacaauuuuuaggguucguugagcucugcugaggaucgaggcgaugcaucaacauuagaagaagacuugaagaagcuucaacucucugaguuugucacugucuuugagaaggagaaaguugacagagaagcucugguaaguaguaggcuuuuaaauguuacaccaaacaguucucaguucuuuuauccucacacuuuuaccaagaaugugcccuuuggagcucucuacuuccagauaucucaccacucaugaugggcuucagcauugcuucccugcauuuugucaaauaaagcgagggauccuugcugugugggagcucaggguucccauggaccauauugcugugcacauaucagagugugaucuaagcaagcuuagagcagaugugagugucuaacaggagcugcccggcucuuacaguuuccguuagguaaagcgcugcacuguugguauucucuuucucucacuuuugcugugcuuuuucugauuugauacaucgcuucacuuauuuaauaagugcccacuaugaucaggcaugugcaauaggguacuaauaacauggagcugguuacuguguuaauuacgcaguuaagaacuuaggaggagggccuggugagaugguucagcaguaaagagcacugacugcucucucaaagguccugaguucaaaucccagcaaccucaugguggcucacaaccacccguaaugagaucugacgcccucuucuggugugucuaaagacagcuacauuguacguacaaauauuaauaaauaaaucuuugggcuggagcaaauggguccagaacgaacggggccggagagaagaaaaugugucugaggacagcuacaguguacuugcauggaaacuacacagcaguuuaagaaugcaaagggaaggacagccuuccccucuaaagugaguggcacuuaugcugagauuuuguuguuaacucguugucauccuucuguguuagccaaaguccucacagcuuuuguccaucaggaggagucuaagucuaaccaucacuggguaccagcuuuccuaauugcuguuuuucauagaguauucuaugacuauccagugacacuguaguuuuuacuaauacuucuuggguuauuuuauaauuaagacaagacuuucuuuaucaaaguuacuuguguguuauaccuuaagggagcuggaucaguauagaaccaagaacaagacugacuccuuuagagucuagaacauuucauugguuuuacuuugcuuagaaguuaaaaaaaccuguuguguuguuuaugccuaggcuuuauguacagacagagaucuucaggaaauggggauucccuuaggacccagaaagaagauacugaaccauuucagugccaggaagaauucagugguaugugucuaaaauggcuuaguggcgugagaagguucguugacacugauaguaucuuuaugcuuugugagauagacacccugcuaaccaaguaacgcucuggguggcuuuccacacggggaugaaacuagaaccuuacccacgcuaggcaagcaccugaaaacugggugcuuguuuuuuuuguuuuuuuuuuaacguuuuauuugaagacagagucucgcuaaguugcccuggcugguuuugagcucacucuguagaccagggagacuucaacuagaauuugaaaucaccccgccucaagccccccgaguaccugggacuguugcccugcagcaccagcccggccagggccgcugucuuugugcuguguauuggccaggugaggucucucucugcuacucaagugucuucacacuccuggcauuguuauuucccuugagacagggucuugcucuguagcugugacugucccggaacacacuauguagaccaaguuggccaugaacucagagauccuccagcauugcuucccaagugcugggaucaaaggugugugcaccacuauaccuggcuuccucuuuccuuagcaaauuguuugaacuacagaugaggacuaccacucuuggcagaguaguuuucaucauuggacuuggcuuuuuuagaaauuaaacauauuuucuuuaucugcaucuuuagacacacuuuuguuuucaugucucucuccuagagcuccuacuguucagauuuaucuuuauaacagagugauucauaucacauaugauuagcuuuucgcaauauaaaauccagguguuuuuaggcuuccuuauuuuuuauaaccaucccuacuaauucuagaaugucuccaucaccuccagagcacaucccguacugauuguagucaucacugcguaugacugcagccuuugccagccacugccagucucuguguuuaugcuucucuuuuuaauaguaguaaguuuucauacaagugaaauuaugcauauauagccuuuuaugacugcccuuuuucauuuagcaaaguacugcauauuaagaucuguauauguucuuucuguccgugugcugguggugggggggcauggacagggagugacccuuguccuuagccucugagugcugggaucaugggcacuaguuucaggccguagugauuaacuccuuuucaacuuuucaguagacccaagucuuuguaagacacaagucaugcaagcauuaauuuauucauucauucauuauaucgagauagggucuuacuguguagaacugccuugcaugaacgucacagagaucugccugacucugucucuagagugcugaccuuaaaggugugugcuaccacagcugguaagauccaagucuugauccaguauuuguauuauaugcaacccccagagagacaucacauuugccuucauugcagacgcauacacuuuguagaauuuagcaacagugauuugccugucauaugguuacuugaaauuucagcuggugccaaaaugcuuucguaauuuauuuuuauuuauauauuuuugagacauggucuuacuguguaguuguagcuggccuaggacucacauguagaucaggcuggccuuuaauucauaaagaugggucugccucuaacuccucccaagugcugggguuaaaggugggcuccaccaugccuagaauuuacuuauuuuuuuuaaagauuuauuuuauuuuguuuuuauauguuugauuacauguaugucuguguacucaugugcgugccugguacccauggagaugagaagaggacauuggauucucugggucugcaguuacagcuaguuaugagcuaccaugugugugcugggaaccaacccccaaguccucuggagagcagccagucuuacccaccgggccgucuccagcuccucuuccauuguuuugaagcacauagggcuaucagcucauaucauauggcaaauaucauuuuuucaguacauuuaucuuguuuuguaagggaugcuacauagaauuauugguugccauuuuaaagcuuuuccuuugacuguagcagcuauuuccagugaauaguauuuccaugaaacuauuuuuuucuuuuguucuuuuuagaguauuaauagaccagccaugucagccucugagguaaacaucuccaaggaaaauggugacuaucuggauguuggcauugggcagguaaaaauacucuuugguuuuuuggguuuuuuuuucuacuacuagucauugguaggaauagauaagacucauuuuuaaugaggacugguuauuuuccuccuuccaggugucuguaaaauacccccggcucaacuacaaaccagagaucuucuuugccuuuggcucccccaucggaauguuucuuacuguccgaggguugagaagaauugauccuaauuauaaauuucccacaugcaaagguuucuucaauauuuaccauccaguaagcauugaauagcugcuauauguuuuuaccuaaauugguuauauuauucuuuagaaauuagacaguuguuaguauugauuagaaagaagaaauuaggagcuggcgcugguguaugccuuuaaucccagcacuuggggggguaggggauauugaucucuuggguucuaggccagccugaucugcagagcugguugcuggacagccugagcuaagaagugacuagaugggagagcuguguguauucauguguaugagcccaaggacagccucagugcuguccgauggguuuuguuuuuuguuuuguuuuugggggggucagggucucucauugaccugaccuguaucuugccaagcaggcuagacugucuagcccagugagccucagggaucugccuaucuccgccuucccagugcugggauuuacagcuuguuuguuuguuuguuuuuuaauauagguucuagggaucagacuuaguucccuugcaggucaagcacuguauugccugagccaucucccaguccacaacuguaccucuuuacaaaauaaauguaauuacuuuuaucucagauacauaauucuucacucugucuuauuagggaugaauaguuagcuguuauuuuccuaugcaguuugacccuguggcauauaggauugagccaaugguggccccaggaauagaguuugagccaaugcugaucccacaccauaaaggcaggaagcggaugcacuuaggugagucuguuaauagaccuugauaauucuggauguucuggugaguauaaacuaagugggcugaauucuguucuuguuuaaccuugacauaucacagaguacuuuguucacucacguuucagaacugagagagggcuugaccaggaugaguauggaccugaagaacaacuugcuggggucacugaggauggccuggaagucuuucaccagaggcccauacccugccuuacaagccucagaaacugcagaagaaacugaggcagaacccgaaucaaguucagaaaaguccaauggucagugacaggacauagaaaugacccgaggaggggugcugugcuguggaguucucucccagggccugcuucccuucccuuuaauuauguagggucuauucugugagucaugguugaccuugagcuaugcuaaccuuuccugcauuuuaauugaugaaaguuaggaugaaacuuuuaugugaggaggaaaaugucaagagaagcuauuaacuacccucgaaacauuucccacuuuggauuuuuaaauaauguuaaaagccuacucuguuaggcauagugacacaacccuuuaaucccacugcuuaggaggcagagacagaggcaggugaucuuugugaguuugaggccagccugaucuacaaaaugaguuucaggcuagucaaggcuacauagagacccuaucccuagaagcaaaacagaauccuacuguuaaguuucuacuuaaaaaaaaaaauuauguguuuguaugaauaguggaggccagacgaggguacuguaucccugaugcugaagguacauacauuugugagcugcccaacaugggugcuaggaacuaaacaugucccucuggaagaugagcaaguguacaaaccugcccagccagccugccagcuccuuucccuuucccuucccuuucaacagcauuugucuucacgcuuauguaugugugcgcgcauucuugaguguguguauguguaucaagugaguucccgaugcugucagaggccagagucacugcguccccugguauuggugucacaggggcugugcucuccugauggaggugcgggaauuaaaccuggguccuuucaagaacaguaaguagucaauugcugagccauucuuacacuuuuuauaaggugaaguaagugugugugugugugugugugugugugugugugugugugugugugaucaguuuccauugcugaggacuagcuaggauacucagauuccuacagagucuuucucgauuugcauuuaguuuauaaaauucaagauaccugacucauggauguacaggugacgagauguguugaucagaagaaggaauugaacaaaauuagugugacuugaggaacuuaaaaaguugagaggaagacagaagggagcucugagcagaguaccucauuauaagguaaacauggggucugagggagugcagggucuuuuagauggguguguuugucuguauguguaugugugucugucuguguguacaucuucaugggcacauauacaugugugcaauguguguauguguguugguacgcaugcaugugcaggccagagugucuuccuccauuuuucuccaccuuaguucauuuagacuaagguuuauuuauuagauuuagucauuagggccuuucacuaaaccuggagcucaucaccuggcucccaguccuccugccucugccucccugguguugggauuacagcucaugcugucaccuccagcuuucuggugggugucuggguguuggugauaggagugcagucccucgagcuugcagaguaagcagcuagccaccucagcagagucauuucuccaguccugcacuuaggcccuuacaauggcccuucuguauccagaagccaacacggaggagccuccuguggaaguuaaagaagaggcucccaucagugugggcaugcugaauggaggccagcggauugacuacgugcuacaagagaagcccauugagaguuucaaugaauauuuauuugcuuuacaaagccaucuaugcuacuggugagugguuucuguuguuuuguguucugcuuuuuuuuguuauuguuuuuugagacaggguuucucuguguagcccuggcuguccuggaacucacucuguagaccaggcuggccuugaacucagagaucugccugccucugccucccaagcgcugggauuaaaggcgugcgccaccacacccggcguguucuguuuucuuaucuagucuucccuuuuggcuucacuaggguugagcugggucucagaaguacuggcacccagcuucaccccaguuggcucagaccuuuaacauuuaucuuuugaugcuuucaugcuuguaacucuagcauuugcgaugcugagucuggaggauuucaaguguguaggcagccugaacugaaauccugcucccuuacccuacuaagggguuaggagaagaaacggaaauaaaagaaagcaacccauuuaaaagcauucacaauagcugucacauguauuauuauuaaauauaauuaauugccugauggaguguagaucaguaguggugguuacuaaauuuugugucauuuaccaauacaauuucaucaccaacgaagcagaaauaaagaaaaauaaagcuagaacaauaagaugggcacagagaaguauuuuuaaaagaugcuuaccuguaaucaaguauucuggaggcuggggcaggaggauugcugugaccuuguuuuauguucugaggaauuuaucaguggaacucugauaagggguaauucugguguaaucacugccucucuauuugguaaauagagucaaacuaaagcgcagcaaaaucagucacuauacggagcuaacauaaugcccuugaaauauguucucuuuaaaaugcuuucuuuaaaaacacuuaguuauauuuaucugugugugcauguucuauagcauguaagugggaguuaguacaacuuauguaauuaagcugaagguagcagccuugauggcacaaaccuuuacagcugagccagugcaccggucuuguuuguuugcuuauuacagaauuaaaccuaauuuaaaaacuuuuucuuuaaagcuggaaauguugguacauggcuguaucccagaacuugugagguggaggcaggaggauccggagcuccaggccaugugcugcucuguuucaaguuugagacuagccuggacuacaugagccccugucucagagcccaaaaugcuagacaagaaagaaugcaucuccuagucuggauuaaauuuuuuugaguggugugaaauccaaaggaagaugaauaauuuagagggagggaagggggagagagcgcaagcacuccaucucguccugggccaggguagugggugucccccacaugcagcuguccugugucuuguagcaaugagaaagaaagauuucuuuuaaaauguagauagacaaaucuucugccuugucuacugauacuuuugcguuucuucauucuuuuagacauaauguuucacuuuauuuuuuuaagauuuauucauguauguauaugagugcugucuuccugcagaagaaggcaucagguccauuuuagaagauugugcgccaccaugugguugcugggaauugaacucaggaccuaugaaagagcagucagugcucuuauucgcugagccaucugcaguccaaguguugcacuuuauuaauuuaucacaguugucagucaguccucugcugguagaccuuuuacucuuuacagcauguccauguugccccauccacucaugagucuuacuuacaaauggaauugcuggcauaaaggcuauaugcguuuguaauaucugguaaaugcugcccaaaaaaagguuacaaaagcauuuaucauauuuauuuauuaguguuuguguaugcauguguccuggugacccgacucagcuuggcagacaggaaaugcuguauucacugacuccucucccgggcccagaguguccauuuuacauucucaucacagacaguggacauuacgucggauuacaguguuucccauagcuuuuuguaaauagguguuuugagaauugauuuuugugugauguauguacguguuugugugcacaugugcaugcaggcaauguguacuaucuguauuuagagauggaggccaaaggucacugucaguaccuuucauguuuucaccuuauuuuuugagacaagggcucucugaaccuggcgcucacugauuaggccaggcugacuggucagugagcucuggggauagaccagucccauuuccccagguccuccuugcccagguccugagguuguagucccaugcuuccuaaccuggcuuucauguggcuucuagugcucuuaaccacugagccaucuucucuagcccuuaaaauguuguuuuaaaaucuauuauuauuuauuauuauuauugugaguguguauaugugauuugaaccaugugggaauugaacuuaggaucucuggaagagcagucagugaaugcuguuaacuacuaagccaucuuuccagccccuagaguucucuuuuuaaaaguauuuauguuauucugugcaugagugugagcacuugugcuguggcccacauguggaagucagaggacaacuuuugggaguugguucuugcuuucuaccuugcugaggccuggucucccuugugccacugugcuacacauacuguggaauggcuggccugagagugucuagcagauuauccuggcugcucgucccauuucaccauaggagugcugggauuucagaugcacaccagacacacagcuuuuacauggccuggaggucagacucuggccuugauucccaggccuucucuguggagguuaagcugagagaccugcauguggaauuguggggcccugcauguggaauuguggggcgugaggguuagcuguuaagaugaucccaccuacacaaguaagugugugugugaacaaacauuuuguugccagcaauccuagcaccaagaggaacagguaguuggacaucugagcuugaggccaaccagagcuaucacuugugauccugucuaaaaauaaaacaaaaauaaacaaaaaaaaucccccaaacaaaugaaaagaaaaucuuguucuuauugagcuuuuucgagacaggguuucucuguguagcccuggcuguccuggaacucacucuguagaccaagcuggccucaaacucagaaaucugccugccucugccucccaagugcuggcauuaaaggcgugugccaccaccacccggugagccuuuuuuuuuuuuaaaguaacuuauuuauuuuauauacagugauguuuugccugcauguguguguacaggaccagagccgcagacagcugugagccaccguguaggugcuggguauugaauuuggguccucuugaagagcaggcagugcuuagccacugcgccaucugaccaguccauagucuuuuuuuuuuuuuuaauagagucauucaagauuuuuuuuugauaugggaccuuacuauguagacaucuaaaauuuucuaaaacuaacuuucguaguuuugagaauguugguucuaaucuuuuuuuacccaguuucucguugcuuccuggaaaggcaaaugcuuaaaucuccuacgguauugucacuccuuccuuauugguuuucaauguagacccgaacuaguggcucccugguguguccugcuguguauggcagguccuucugugcgagugcauuacuguuaauguuuugcugaagauuuuugugucccuauuugugagggauauucauuuuuagucucucauuuuuggccuucuuuugguuaauaaugacuuucaaaauaguuaauucauuuucuuguuuuggaauaauuugaacugauuuuuuucuuucugucuuuaaaguuuuguggguuuuugggugggggcgaguuucaagacaggguuucucugugcaguccuggcugucuagaacucacuauguagaccaggcuggccucaaacucagagagugcugaagaaggcaugugccaacacagccuggcuauauuuauuuuauguguguggguguuuugcuugcuuauggcaccaugugccauacagugugcccacggaaaccaggaagagggcauuggguccccucggcugcuucagaagggagauagacaagagaaucagguuuucugagcuugagacaagauagcuagcuggaucugucuauaauuuuagcacuugugaggcuggagcagaaagauaugugcaaguucaaagccaaccagggucacauagcaaaaugucuccaaaaaaaugagaaaauucuagagacuguagcaaggcuccgcaguggaaguuugcgaguugcuggacgucucgggguggagggguaucagagugagaaagaugagagucucaagcugguguuuaggagagacaggacgagaggaaaaggacucuaaacuaggaagugguuauaaauguaaaauaugcauauuacacauauuuuuuucucucuguauggguuauaugugugcgcaugaauacguaugugcucaugugaggugaccagagggcacugaguauccugcucugucauucucuacuuuauuccuuugagacagaguccugagcuaggcuguuagccaggaagucucagcaauccuccagucucagccccucacugugcuguuaacuauccgagcagguuaagcagccuggcuacucaugugaguguuguguuccagacucagaccccauucucgcucagccagccgucuagccgcucucuaacccccaucugauacauuggaaauucugggucauacaauccuauugccuuuucuaaaaagcaaauaaaguuuaaaaaugaaggugaugagcagacagcugcuccuguuguuucaagaaugccucugggagcuaagaguggguuuaugcuuguaguccugaggcaagaggcugaggcuggaagauuucugugaauucaagaccagccuaagccauagaguaaguugcaggcacagcguggguuagagugagaccugccucaagcagucauuuaccgccuuuaugagggaaggugccaggacccuuaacucuuccuguuuccagaccaccuccaaaccacuagcaauggaccucuaaggcacauauuuuuacaguaguaaaaauuaauaaaaagcuaagguauuuguauagauuacaugaaaagcauauggugucaaaugguuuugucuuuucucaacguaaguuuuucucuacacagggaaucugaagauacaguauugcugguucucaaagagaucuaccaaacccagggugucuuccuugaucagccuuuacaguaaacaugacccaucuguggcugcuuaauguaaguuuucaaugcagugaaguguuuacacguuauaaggaacauuggaaccucaagaaaaacucacuucgaggacacugguuaaaauucacaggaaguguccaguagcccacucagaaaaggauugguguacaucuuaccuugugcuggggaucccaaguuaccacacccagccuccagacaggaaccuggaaagucuguauuagacaguggcauucucugguggcugguuccccugggugaccuuuucccccccucucccauagauggacacugagggagacuguccugaaaacccacacgcuugcugcugcagcuuccuucucagcuaccuuguguccugcaugcugccugccuuacuccaugggaucuucccaagagaacccucuuuggagacuacuggaaagcggaggggcacucacuguucuguauggacgcucagcagguuuuguggcuagggcguuuacauaucccaaugcuuuaacagcagcacuuccuuguuucuuacaugggaaugaauaucuguuuagggggcuugggggggguuacuccuuauccuuaccaacacuacgggugggaguauaagauguagagguacuuaggggucccgucccucuguguguucucugugcuggagggcugagcaucacugcauuugggagagcugcuggcuuuugagccagcuuuucuuuccuggauuauaugaagaucagacagaagcuuacuaauagcacaguuugcucugaacacuguuacgugaguggauuguagaaccacuggugcugguccugguccugguccuuacaacugcuucagcuucugcaacccugaagguuguauuaacugugugccugcucuuuuacaccguauuccaagccagcggugaaguugaggacauuacuagguaauacuuauuuugaaggucaaccugaaauuacauggcccuucccugcuguucauguuguaaaugcagucuuuuaguagcaccgauuuaagucaccugcuccuuccacuugaguaaaggaaguaugugacauaaaugucacauuuuuuuuuuuuuuuuuuuuugacacaggguuucucuguguagcccugguuguccuggaacucacucuguagaccaggcuggccucagaaauccgccugccucugccucugccucccgagugcugggaucaaaggcgugcgccaccacgcccggcugcgucacugcuuucugagguaccaucaaauuguuuauuacaguuggcagucauggauuugagcaugcaagcuaggcuaccuucugaaggaaaacccugucuacagggucugaggagcugaaucuggauaacucaaggcacauugaucgugaggaagggugacuguacacuaaguguucccuuccuuagcaugugccgucaucuuuguccuccucacgauugcccuuuagcuccucugauuuccacaggucucuauagaguggcaggagaggugagcuguguuuugguuuuuuuccuuguuuuguaaaccuaucaugguauccagaggcacugcacauaacaugcccugaaacccucagauggcagugcccucuacagacaggcaaagggagggaagcacugugcccuggacguuagagaggcaagcaugguacgucaggcccagccugccuuccugcucauggguaauacuggaugagcaagcuacuaaggaguuccagguauauggaauacuuuauuuuuucuacaauaugucuugaguaagaauaccugagaauuaaguaguauauucauuaaauacuaaaaaguaaguuuugucaauugcugucuugagguuuguuuacucuuguuagcagagucauuacuacuuaagaguaaaccaaaguacaaccaagagugcguucuugugaccaaagaugggcagcuuggcccuggagagcuagauaaaccccugcacugagaaaggcuucuucccgcaguccgguacuuacacgugaccacgcugaguguuauacaaggcagugugguggcaagggaccuggguguggaccugcacugcgucgucuguuaucaugcacaaucuccugaccaaggcuguuucuaaacuccagggugacagcauucugucugugauucugucugugauucuggcagcacaguuggugggagacugucugcaagggacgaugaguagcucugauaaccuugcugauauuuugcacuuuugaaauguuuguuuuauaugugauuauauuuaagacguuaguaaaugccgaaauaaaacuauugaccauuugccuacauucauguggccuuaucuaucaucaagaaaaucaauauaguaggcauuuucucuuacauguuacuaaauucaaaacaaaaaguuuuaggcaacuaacugaugguaagcucuuuucccuugauggauguuuacauucucauggacacuauagcucagaauugaaacagagccuguccuucagcaucugcaauauuagcuaauacaacugauaccagcaguuaguuacauacaccagaugggaagccagucuuaaucuagaccugaacgguucuuaugaaguacaaacccucaggcacacucuuguguuucacugccagacuuucugagaaaacgaaguacacugagaacacguuuaagacuaugucagagcugggcaaugcuggagcgugcuuuuaguccuagcacucuggaggcagaggcaggugggucgcuugaguucacucacacacacacaguauguuauaggaagaaauacauaagagagacuuuuauuuaaaguauaauaacaauaaaaugguagcuaucaguugguccuccauaccaaguucuggugauagccucuaguugcgccauuuauuucuuuaugaacaaaggcagaaaguguugcauuuauuuucuagauaauaucccuaauuuuucuuuccuaauguaguaaaaaguaaaaaauuggccaaaauugaauguuuuauuauuuaaggcuuaauggaauguuaccacaaaaagcaagccgaaucagaguuuagcuggcacugcccuuauuuauaaaggacagggauuauguucgguaaauggggucaugaaagcuuccuuuguggaaagguuuccucuggagugacauuuaaucacuguagacacuaggucuuagaauagcaauccuauggauuaaccuagugagagaaguccugacagagccgugccaggccaagcacugagaccucaggggcuagccuuggaagugggguaaagugcacagccuugcggaggcaaguacaguguggcuguguccucacuuagacccugaagaggucaagccagaaauccuuggcuugugcguccuguccaguuaggaggguugaucugcuuguucuccacugagguagauucagcuaaauuuccaaauggugcaacucacugggcuucugugaggacggaaguuugugcuuguccugaaaugguuuauggcacucuacgucagucagagggggguaguacugccuguagcagacauaggcaaaugucauuccaaucauggagccaacuagcacaucugaagagagaaaauagcaaccccuuuaaaaccauguuagaugcuccacaguuacagaguacuuggcccucccaguuauucugcuuguaggggcuaaaauaaaaaaagagcuccgaaccuaugcuauuaguuucuuuagagcaacuugauuuuaccauacaguuacagaauuauuagucugauuguucucuaaacaucaagucaacacccucaguuaaaucagcauggacugaguuagauuuauuuau

SEQ ID NO: 4361 - RNA, 18690 nt, Mus musculus
ccgagccggucccgccccuugcacgccgagcgcggaacggucauggacgguacgggucaauccgggccucgggucgggaaagcgaggcgaggggcagcgcucgucacgcgugaggaaacgccuauccuccgcccuuccgaccuggacuucacugcacugacuggaggggaagagaacguggucggccaccgacuggcaacacgcccggcacgccucuuucggcggacgggcaggcgauaccggaaguggguggggucaccugaaacgcuuccggcgacuagcggugucugagcugcaggugagcggccgguucccguccgcgucccgccgacgggcgacuggacgcccucgcggccguccggugcagccuugcgagagcucaaacaugaacuauaugcccggcaccgccagccucaucgaggacaucgacagugaguaccuaaccucucccucgggggaagccuggugugggaccccuuuucgagugggcgucccucgacaagggcccagagagugaucucugggcccgggcggggugguucugccuucacagccucggacggagccuuuucccaagcugccuucucuguccuugagcggguaacaccuccccgccccccgccccccaagcugugaaacgccuuccgaggggcgcagcauccgacuugggaacgugaagggcagagcacgcgaaggaagucgccugagccacuucgcguucccaagucggaugcugcgccccucguaaggcguuugacagugaauggauggagauugcuucuagaaaggacucaccagacccgacaacagcaguugaauuuaauuagcagagaacguaggcuuucuguuguauagccacuagcacucuccuuuuucuguaagggucauuagcacuuucagauuaaaguuguagagacaggugccggacguaauaacgggauuuucugcgaaugcuaagucacuucaaacuuacucuuuucuguuugacaguuuugcuuuuacuaaaaggagguuaguccuguaaaaauaaagagguuacaauuucgguuuuaaaagguuuaauuuauuguguauuuaugucucgucuacauguaauuaaaccacgggcauauugguauccacgaagccagaugacuuucucuucuugggauccucuggaauuggaguuauggaccgaguuacagagucacagugugggugcugagaaaggaacucagaucuucugcaagagcaacacgugcucuucugaaccaucucuccagccuccacuuucauucccccgccccgaauucuuaccuguguaugauuccuugaauauaacuuuuuuuuuuuuuugguuuuucgagacaggguuucucuguauagcccuggcugaucuggaacucaccuuguacaccaggcuggccuggaacucagaaaucuuccugccuuugccucccaagugcugggaugaauauaacuuuuaaagcagcauuaaaaaaacaaacaaacaaacaaaaaaaaaaaaccgcuguauaugagcauguauguaugugcauugcgagcuugccuggugcuggagagaacagaagaggguacuggguccucuggaagaccagacaauacucuuuagcacugagccaucucucaggucuauaaucagcauuuuaaaaucauuuuaauacugugacuuuucaaaagcaaaaugauuuacaacuucaaacaaguaaaaauguuuugugugaguuugcaaauuagagagcagcugugauuauauagacugggauaaacauauuaaaguuugcucauauauuacagguauagauauuaauauauauuuauauguguauuauagcugcauacacauauacacuacuuuauaagccuaucuaugaagugugaugaaauacucuuaguggaacuuuuugccuucaccuuuccuuagauacgugaauuaccgaagcuucuaacaacaagucugcuaucuuacuaaacgcgcuuguguucucaagccuucuuggacuuuguggaucucagacccuuucauuugauauacaaccuuuagaacgugucugucccagucuuuauggggccuuuugguuuuuucgaguuguuuuuguuguuauugcuuguuuuuguuuuguuuguucuuggguugagacaggaucucuccaugauccuggcuauccuagaaugccccugccucugcucucccuugcucugauuuaagauaggugccaucaugccugguucagcuaugcuugagucuucuagcucagauauagcucaguggugugucuccaucagacucgcaucccuuccugaguaccccagugcacugcagcuuugacucugcugaccaucuuugucuagauuuugcugucagaagcuuugggguuuuguucuuuuuuuuuuuauugguuugguucauuuuugaaagggcagccaccaggcuggccccuuuaaaucauagcauuccuucugucucuguuuguaaaauucugggguuacuguguauugguggcucaaaucccaguacucaggaggcaaaggcaggcagaucacugugaguuccaggccagccuggucuacgaagugaguuccaggacaaccagagcuguuacacagauaagccuugucuccaaaaacaaacaaacaaaaauucugggguuaaagacaugggccaccuugccuagcuuuggcuugaagauauguauauauauauaaauuuuuuuaaagauguauuuaguaucuauaaguaucuuguagcugucuucagacacaucaaaagagggcaccagaucucauuacagaugguugugagccaccaugugguugcugagaauugaacucaggaccucuggaaaagcagacagugcucuuaaccgcugagccaucuccagcccaaagguguaauauuuuuaaagauuuauuuauauucauguguaucuuuuuuccuaugaauuuuuagagauuauuuacuuacuguuuauauguuugugccuacaugaauaaugaauuuauaugaagugcaugugugcaggaugcagaaggagggccuggauauggaguuaaaaagagccaccucaugguguauaagagaagcaguguucuucacuguugagccaguuuucuagccccucgccccucgaagcuguauucauaguuauaaauauaaggccuuccuuuuaagugcagcuguacauuguguuguguguuuggguuuuucaaaagguuuauuuagguauuuauauuuauguguacauguguguaccuguaugcuuacauggauuauguucaugcaggaacugacaucagguagugugagcugggaagugagccuggguccccuagaagagcaguaagugcucuuagccaccaagccauagaaccugcccucuguuuucuugguuucuccaacucuaguucuugaggauuuucuuaguucucuagacuuuacuguucucuaaacuaggugucugaguugcauguuggguuuguuuucucuacaucucuagacauucuaguugggcuuagcaucguaacuuccaaucuuucuuucuuucuuucuuucuuucuuuuuuuuuuuuuuuuuuugauucaauaaaguuuucuuuucccaaauguacagcugauuuaccuguucaugcaccuuccccagcagccggagcgucuccacucuuuguguuucugguguaaaugacuugggcucugugcuuugaaaccagcuugauaaguccuucacuaaggagcuccuggagggcuguccuggccaagggaaccucgaaucugaauucagucuuuccggagaucacagcuggaguaauaagcuugucguauguggcuuugucaaacaggacaagauuguucaacuuguucugaacucagccuuuggaccacuucuucuucuuggccuugccaccagauuuauuuacugggucuuuguccuuuuuggccgucuuuccggcaucuuucuucuucuugucgucuuugggcggcauggcgaagcucagagagucgugugaaucacugcagccucacuaagaugucggaaaaaagccaauuuuucuauacaucagucuuucaugcuuccucauucuuuugaaguuaaaccugccuucaauacuugucagaauuuagcuccuguucuuucuuuuaacuuugagccgaaugugaacaugcuacuuccccuuauacuuaauuuacagauucucuaaucuuuuguuuccacuuucucuuucucauagccaagauuuauuuauccuuaaggauccaacugggauaggucuaguuucuuuuuuaagucuuacauaauuaagauuugcaugcuuaugauacuuaauuauagcuaaugaugacauaacuccuuuagaggagacucauugcccuucuuuucagacagacagugcuuuaugcugggcacugguggcacacaccuuuaaucccagcauucagcaaagguaggcgauaagugaguuugggcccaaccuggucuacagagugaguuccagggcagccaggucuauauagagaaacccuggggggaagggcauucacugccacaccuggcuugguguaugcgcuuuauuuuugagcggggcauaaugaagcacauuaugugucuccuaagugcauuaauccuagcacuuaggagacagagacagagguagauagaucucugugaguucaaggccagccuaguuuauaguuucaggacagccagagcuauacagugagacccugucuuaaaaagaaaaaaacagggguuggggauuuaguucagugguagagcgcuugccuagcaagcacaaggcccugaguucgguccucagcuccggaaaaagaaaaaaaggaaaaaaaagaaaaaagaaaagaaaaaaacaaggcuagugagauggugcagugaguaagagcacugacugcucuuccgaagguccugaguucaaaucccagcaaccauaugguaaugagaucugacucccucuuuaggagugucugaagacagcuacaguguacuuagauauaauaaauaaauaaaucuuuuaaaaagaaaaaaacccaaaaguacuuuaugcauagcauuaaagaaaugacugguugaaaucuugcuuuucuuuuuuuuuccccaccucuccuuugcuugcuuuucuaaacgaugcuuaucacacuucagagucccccacaucacacuuucugugguuguuuugguguguccuucauccaacuguuuuguuauucuguuguauuuuuuguaagauguaauuuuuuugcuuucauccuacagugaauauaaauucaugagguuggugacuuugagaccucagaauaguuuagagcaaugguccucaaccuuccucauucaacaacgcuuuaauacaguuccucauguugugacccucuaccauaaauuuauuuuuguuacuacaucauaacuguaacuuuguaggccguaguggcacauaccuuaauccucacacuugagaggcagaagcagguggaucuuugaguucaaggacagccuggucuacagagcuaguuccagaacagccacaacuaaaaacaaagaaaacguguuucaaaaaaccaaaagaagaaaaaacaagcuugguggggccaugaaucuuucacacacacacacacacacacacacaagaaaacaaaaccaagaacuaacuuuacuaguguuauaaauuguaaauaucugauaucugauaggcaaccucugugaaaggguugucugaucuuaaagggguugcuaccccccagguugagaaccgcugguuuagagcguucaauaaauguuuaauucagucuaaugagacugcucagugguuacauaugcagacuucuuucucuuccugaagaccagcgugauuuccagcacccauguccgugguucccugagaacuguuuguaacuccacuucuaaggagucugaugccaacuucuggucucuccaagcaugugcgcagacaaacacaacacauaauuuuuuuaaagcuuuuacuugaguuccuguucuaggucucuaucacaucuugccugucugagacguuucugaauuuuaguuuuggugcugggcauugagccuaggguuuaggggcuuuacuucucagcuacacacccagccagccccucuaaagcaggguuuucauuucagauuuccuugauugaaugaaaauguugaaauaauucuaggauuaagguaauagaaauuuagccaacgaugaaaguaacuagaacuuccauaaucccagaauuuagauggaggcaaggcauuuaagaguucaaggcugggggcuggagagcuggcucagcaguuaagagcacugacugcucuuccagagguccuggguucaauucccagcaaccacaugguggcucacaaccaucuguaaugggaucugaugcccuucuucuggugugucugaagacagcuacaguguacuccuauguauaaacuacaucuuuuuuuuaaaaaggagggaggggcuucuagguuauccuaaauaugagcuccacuagguuaguaaaacccucucagaaaaauaaaagccaucuagacuaagcuucucuauuuaagguagagaaauuauaugaugcuaaaaggguugacuguaacaucagggccagaaccacuugcuuuccuggcuacucaguguccuuuucuagcucaacagcacuaacugcuccaagucucugcaguacugaugucauuuaaaucccaggcuacagucuuccaucccguguuuuacaccgagcuccauacuaaauacauuagaagagggucugguacagcuuagacaacuauuaacugaauuuuuauugauacuguauaaguucacugaaacugacaccuuuguuuuaauagaucuuuucuccuuuucccagaaaagcacuugguccuacuucgagauggaagaacacuuauagguuuuuuaagaagcauugaucaauuugguauguauugguuaugaucccaaaaaauuuuuuugcacugcuucauacugaaauuuacuuaucuaacuuuuccacauguaucagccuaauggaaguguuggggugaguaauuuuuuuuuuuuuuuuggcuuuugguuuuucgagacaggguuucucuguguagcccuggcuguccucgaacucagaaauccaccugccucugccucccaagugcugggauuaaaggcaugcgccacgaguaaauuguuuuagaguuaugauuagguguuucaaaaccuuguauguucauucacaaaacaaguuuguauucuaaaacugauuuacacuuauuuuccccacuagagggcgccaggugacagguuuaaaguuagucuuaaaaucauuuccuggagguaauccuucccuguccagugagaauagggucgaggccauuucccgaaacucuuguugggggcagaacacagauaaacucaguaguuuacauacaggaauacaucagauuuagucaucugucugcacuuucugaaggaagagaucuguuucucccuuugguguaagaaaccucuccguucacaccgacacuugcuggucaucugcuggguuccuggauuugaaugugagggcaaacauaggaggccuaaacagccagcugugcgccugggucccagggacuuacggguagaucaagagggucacuuuggaaacagaucaaaccaaagcaaaacaacuucuguuuuacuucaaggaagacaaauaguacuaauucaaaggagaaaaagauuuuuaagaagaaaauguucuaaaccuuaaguuaaauucauguaagugcuaugaagagauaaaaagcaaauuccuagauuaccaugcaugauuauauaaaucguuguuguguccuaacccauaaaauuuaguuuggauuacaugaguccuaauuacuaaaaacuauuaaaucucacuaaagucaucacauacauauauucacacaguaaggaagcucuccuucuaaaaaugcagacuuucaaucuuaauaguuggcuaggcucuaguuuuccagcuucccacucauuuauauuuccuagggaccauguugauacuggcaggaaaugauacagaaguaacuuauuccuaccaucaguuguucauuagcacagcagagucggaaaugcucuuuacuuguuugaaagucuccuaaaacugaacaugccuguagucucagcguguauagcaugugaagcaggagaaucaccacaaaugcuacaucaggacuuccaggccagcugaggcuagagugggacccugggacccugccccccccacccccaaauaaaacaaauucucauauauggcuugucauaacugauaaaauuuuaaaaauaacuaaauaauuuaguuauagacuuuauaaucaacaaugucaacuaaagaucuguuucuucuuugugugcuuauagcuaacuuagugcuccaucagacuguggagcgaauucaugugggcaaaaaguacggugauauuccucgagggauuuucguggucagaggagagaaugugguccuacuaggagaaauaguaagugagacuguuaaacugcugugcgucuggguauugauguuggcugcugcuuuccaauuuaccaagcuucccacaggaagcuggcaacuagggaagcugugguugccagagcaacacuacagaaaguaauuaauguuagucugugaccuuuggcauuuuaaagauuugauuucacucgcaaaauauuguugacuuugucggauagaaaacaauauugcugguguuugcuucaauagcacuuauacuaagguccaaacaguacaaagauuaacauggccugugcaaggguggcacacauucucucaacuggaaagaaagagacagcauugcuagguaugguggcacaugucuaaaaucccagcaguuaggaagcugugguagguggaacuccucuaguuugaaacugucuuaguuaggguuuuacugcugugaacagacaccacaacucuuauaaagggcaacauuuaauuggggcuggcuuacagguucagaggcucaguccauuguuaucauggugggaagcauggcaccuugcaggcaggcacggugcuggagaugcuaaaaguugugcaucuuguuccaaaggucagcagcagaagacuggccuccaggcagcuaggcugagaguauugaagcccaucugccaacaaggccacaccuucaaauagugccacucccuggcccucauaggcuugucaaacaugagucugcauuauagcauaaugcaaaacacauuuaguccaacuuucagagccccccauaguauauugcagucucaacaauuaaaaguccaaaguucaaagucuuaugagauucauucaaucacuuaaagucaaagcagaucacacaccuaaaacaucacaggauauacacuaccguuccaaaaugucauagugaguaaaugcuagaacaaauacaaccaaaucccagcugggcaaacuccaaacucugcaucuccauggcuguugucaaagcacucuucagacuuccaacuccuuucaucuuuguuuacugcagcacaauucucuuuggcugguuccacucccuguuggcaucuuuccucagcagguaucccacagcucuggcaucuugaaaaucuuacggucuguaaggcaacuucagcauuacagcuucuuguucuaaugucugggguccacacaugaucuucuagguuucacaaaagggcuugggucacuucuccagcuccgcccucuguagcacucuaagcucagguugcuccacuccacugcugcugcuguucuuggugaucaucccauaguacuggggucuucuggugcaacuaggcuucaccaguacugucucauaggcucucuucaugguaccaagcuucaacuucuuugcaugacuccuucaguccugagcugucaacuacaacugaggcuccaccuuuguuaauaaccuuccaggcccuugcacaguaccaagccucagcugcucuccaugacccccucauaccuucaaaaccaguaccaccuggaugacucuuacacauuaccaaguccugcugcagcacaagguacaacauuggcucucucuggaacacagcuucuuugugcccucagaaaauacuucccagauuucaccucaguaaugcuggucucuucuuaaucaccacuauauucuuagcuccagcuaaccagcaucaauugucucaguagucccuucuauuuuuggcucuaaagccagagccacaugaccaaaacugccuugcaggagcuggaacauggcccccuuguucuauuacauuaucaacagcuuucuguuuuccaacucuuucucucccuaaggcauagcuguccuggaacuugcuuuguagauugagaccuugaauucacaucugcauggcccugucuccugaaugcugacaucaaaggcauguaccaccaugccuggauuuaagcuuuucucuacuuggaacuuguucuauaccaggcuggccuugaacucagaucugcuugccuuaggcuccugggauuaaagguguguauuaccaugcucaggccuaaauuuagcuaugugggacuuaggcccaaagucacaacucccuuaaucuguucaucgucuugaacauaggauacagcuccauuucacuuccuaguaccccuuuauuacuugaaucauacauuuuauauuuuuccuuucucaacuuguuccuuuucauuaaaaugcuuuuuauaagaggagugaacuuaaguaaccacacagcagaauuuguacugggcuguuuugagacuuccuuugucaaagcaagaaaucuaaauuuugucaccuuagccuuaggcagacucuucagauaauggcaaaaaguagccacauucuuuuuuuuuuuuuaagauuuauuuauuauuauauguaaguacauuguagcugacuucagacauaucagaagagggcaucagaucucauuacgggugguugugagccaccaugugguugcugagauuugaacugaggaccuucagaagagcagucaguucucuuacccgcugagccaucucgccagccccagcagccacauucuuuaccaaaauaucacaaaaacggucuuuaggccacauacuaacauucuucuccauugaaaucucuugggccagguccucacaauucaaaucacucucaguaacaaagucuuccauacuccuacuaggauagcccaauaaguccuauuuaaagcauuacacuguuuucuaaacccaaaguccccaaaucuuccaaacaaaagcauggucaggcuuaucacagcuauaccccagacccugguaccaacuucugucuuauuaggguuuuacuacugugaacagacaccaugaccaaggcaacucuuauaaaggacauuuaauuggggcuggcuaacagguucaguguaggcuuagauuuuucaaauccuacuuuuaauaaggguucuuaaaugcuuuaaccuuccuucuaacccaccauucaccagagguagugggaaagaaagguuauuaagacgugggggguugugaaaagcguaccuguuuggaaauaguucuuuggaacaaauccaguuugcacugucaggauauauacuagaaguccaguucaguggugucagaauagcaaacacaaaucagcaguguagcacaaaacagccaggcuucccucugccgaauaggcaccagucaggaccagcaaggacaccaggaguucucugccaugccucucucaacgaaguggagaucagcgaugacaaagacucaagaccgaggaagugcugccaagguagcuaugcaagcucccagucacugucugcugaguccuguuuauacuccucccacgggucuucccucagugaaacacuaaacaagucuggaucagcugacaucacucugccaauggcgagaaacugccagaacaccaccgcaaguuuuuuagucaguuuuuccuaugaauucaagacaaaugaugaccauuaaggaauggcaagacgucccaauaccguccaucgucgucccccaucuguuagguuauauuuaccuuccuucuuaacaucauguguccuuucacaugucugcuuuaacaaaacauccuuucaucugugucugcuucagugaaacacuccuucacaugucugucccggcaaaacaccauuugacauaacucacucuccaaagaaacuagaaguuuccacuucagagguucagugcauugucaucaaggcaggagcgugguagcaucuaagcaggcauggugcaggaagagcugagaguucuacgucuuguuccaaaggcggacaggagaagaccagcugggaugaggguccuaaagcccaugcucacagugacacaccuccaaauagugccacucucugggccaggcauacucaauccacugccgaggcuaugauaugcuacauagugaguuugaggccagccugagcuccaauauaaucuguguuucaaaagaaaaaaaaaaaaaaaaaaaaacaagaauaacauagucauguaguguuuaaccucaaaugcagaaaguuacagaauuuaaauuaccuguccugacauauaaagguacaguuuaggggcugcugagauggcuuaguggguaagagcacacugacuguucuuccgaagguccugaguucaaaucccagcaugguaaugagaucugacgcccucuucuggugugucugaagacaacaacagaagacaacaacaguguacuuauuuauaauaauaaauaaaucucuuuuuuuaaaaaaaagguacaguuuagagcuggagucuaucacaguaguaaaguccuuaaugcaaccgaaaacaacagauuuacauguugaaauauguuaauuuaaauaacugguuaggaacuuggagcgauggcucaggaguuaggagcacauacuguucucacugaggaccugaguuugguucccaucucacaacugccuauaacucagucuccaggggaucccagggcaccugugucaaaugcauauaccacccccacauguacauaauuuaaaaaguaaaauuaaauuguacguuacaaguaggucuucauggcauggaguuaauuggcagcauuugaggaaaguguuguauguguuuuuaaaggggaaaaaacagaaacagguuagaaaaagccauucugagauuucagaguggagcuuaugaccagagagaagggacaugaauauuugugccagaaagaccagauauuaaaugaaauguuaaucacauuuguugaaauacugcuugcuauguauuuguaugcauacauaauagaaguugauuauauguauacauacauguguguuacauagauaacuuuuuauucauauuuucuuaaguauauuuaaaccuugaauccuauuggguuugcuaggaaaaucaaaauacccgugagacuggcugaaauuaaugggcaggaggaguugguuugcucaguagcaguauacuugggugucacgucuggaacccugaauuuaauccucagcaccacaaaagaagagagggaaggaagaagaaauuaaagacugacuuauguuggaaacagucagcuuacucgcagcugucuggugacuuucagcucagccuggacugucuccagcacacugggcuaggcagauggcuugcuggguaaauguuugcugcacagucaugagagccugaguuggcuccccagcacugggaggugaaaacagacagauucugugaucucagaggccagccagucaagcacacaccaagaguuccagguuccuugagagacugucucaaaaaauccgauagagagguaaagacgcccuaugucagccuuuacuuguacaugcacguaagcgcccuucucaaacaaaguguauucauaccucagcuuaaaauaguuugugguagagcuagaaagauggcuuagcaguuaagagcaugugcucuugcaaagaaccuggguuauccucccagaagccacaugguggcuuacagucaucuguaacuuaaguuuugagggcgcugaugccuucaguagguacuaggcaugaacacagugcacauauucauucuuuuuuuaaaaggauaauuauggaagggaucugcaacccuauagguggaacagcauuaugaacuaaccaguacccccagagcucgugucucuagcugcauauguagcaaaagauggccuagucggccaucacugggaagagaggccccuugguauugcaaacuuuauaugccccaguacaggggaaugccagggccaagaagugggagaggguggguaggggagcagggcugggggaggguauaggggacuuuugggauagcauuugaaauguaaaugaaggagauaucuaauaaaaaaauauuuuuuuaaaaaaggaugauuaugugaaucagcaauuagucugaaaaaauuauguacuaaagcucaagaaaaccuagaaucucuuuagaaaaacauuacauugaauaaguagucucuaauguaccccaugguggcauggaggcugagguaggaucagaucacaaguuuacggccagccugggcucugccucucugaugaaagauuccagcacuaagggcguuuacugucgagaugguugcuucacagucauggugaguagcuuagugaguaacauacugaaaaccaggaagagagcuaagaacagccuuuucuucaucccaggguuaugcgggaaagguugggugauuauauaguuuuuagcagauaaccuuugacucaagugacuuaugcaacuugcguggcuucuaaucuccuggugagagcccuccaucugauaccacagugcugagcucugcaaccuuggaggccugugucaguuaacuugcagacugagacaucuguagauguuuuugaucagugucuuucuagaccaucucaucaaaagucauaaaaggaacuggagagaugguucaauaauugagugcuuacuacuguuuuagagaacacgaguuccauucccagcacccacauaggguucucauaacugacuauaacucuagcuccagaagaucugaacccugucuagccucugcagguacccuguauacacauaaauaaaaaauaaaaucuuuuaaaaagaaaugcaucacaggaacagaaaugagaauauagccugcugaauuggcacaccuguaaucccaguauucacuagcagggggcaguggguaugagggcagccugggcugcagagugaauucuaggacagcuuuugcugaauaaccaagagccugucugggcuuaguggggggaguccagccauacuucacuacauugucuguauaggcugucuuuguuacagaaauauaaauaauaccuauacauuuuaagggugagaggguaagugagguucguuuauaguucuacauacaaaguuggcucuuaaauauuuaugacauaaaaaguauaucaugcuguguuaaaugaaaacaaaauuuagucacuauuuucacuauggguuugguuuuguucuaagucauagauaugccuggucugaugacauagcuaagcaguagaaugcuucccugugugaccccuagcaccacagaacaaaagcaguuccuaggccugcaagagugugcaaggcugacaagcagaggcuugaaaucccauaacucaagugaauguggaaggagcaguguacuccaccaagcuguccucagacuuucacacauguuugaaaacaaaguuccagaagauacacauagauucaaugcuucugauaacauagacuggccuacaccugggaauugauaauagucuccaaaguauuuguguuccauaugagaauuauaaguaauuuuuaagguguuugauuuuauuauaaauuuccuacaguguguauuuuuaaaguaagggaaauuaaguauuuuuauuaaaccaaauaauuuauucaagcauaguggugcaugccuuuaauccuagcauuuggaggcaguggucauccuggucuacaaaggaaguucuaggauauccaaggcuacucggagaaacccuauuaaaauuaauuaauuaauuaauuuuaaaaacuaaauuacuagagaaauaaugcacuggacuaaacaagaaugacuuaccaggccucaugauguuuucugucaaugguugccacagagacuccuuguuagugaaacagaggaacaguuuauugcccacagcaguaggagugugguguacauuugaaucaagguuuuagaccuucuuccugagcaacaaaccgcagaaauuaaauugauguuggaauuguaaaauauaguauuugucuucuguagccaccauggcuuuauaugacuucagggguucaaacuugggucuucacaagggcacagcaagaauuuuguccacuaaguuaucucccaaacucaaguuuuauuuugaugaaaagcuauuaauauaaaguuaacccugacuaacaaugggacuauaaagccugaacucugacucugugcgucugacucauguguguucuguagcagugugccaccugucucucugcaggaagaaggguacuguggccuuaccacaauugugaaaggcaggccaagcuacauacuggaaucugcugucuuuagagccauaagcuugucuguucuuggucuucgugggaagucguucaaaccugccuguuuugcaggaccuggagaaggagagugacacgccccuucagcaagugucuauugaagagauccuagaggaacagagggugcaacagcagaccagacuggaggcagagaagcugaagguccagacccuuaaagaucggggccuuuccauuccucgcgcagacacucuggacgaguacugaguccuugcucagagacugcucuagagagcaggugcugucaccuggucaccucacacauugaccagaguaucacgcugaaaagugaucucauucuuucauggaugccaacaugaagaaaucaugggauuuugguuuuuuuaaacaaaaucauuguauauuaguuuugcuuuucuucuucagucucagcacauaguccuggcugaccuagagcucacuguguaaaccagggugaccuuuagcuugugggacugcagguggccuccaccuccaccagcccagcuuuacugucuaaagaaacaguggcgugaccucccucacacaagucacuguggagccaagaacuaugucuuuauauugcuuaucucagaguuuacauuucuuuuuuaaaaauauuucauuuacuuguaaauaaaaaaugauucucagaacugucacaaaauggaguuucugguggagagucaaaauucccuacugcaacauaaggcuguauacauccuaauguauacacuaggaugccuacuguggauauagcuggcuccucaggaggacauuucauacucugcugcuuccuaguucccauuuucauguuuguacuuggcagaaguuuuaagcuugagaagggaguuuucaaggaacugguuacaacagaauccucagguuuagaaaacuugagcccugauuuacccacaguuuuuccaaacuauaagaauaugcuuugcucucaaucuuacauuaacuuauccagauuuucaacuccuuuugaucaucuuuugcuuagauuaucaucuauacaagaacaacaacccucccuacacacacacacacacaaaagcccucaaauggugcuuaguaacaauugauucaugaugacagcacguuuuguuggcuugauuguuggagaguaauaauugcguaggaagucugacagaugacacuuuagaagcaguguguuucaguacacagagugagcaaugaggcaacagcauagaaauuggcuuauuggcacacugaaauguuucucaguaauuuaucucggauauaucauuuuuuauaaucuuuugaacaguaguacucuucucuuuccuaagagguuuguggacuuuuucauacugcaauaugaaauacacuuuuuuauguucucagguguuuaaaaagaaaaaaccuacccuggaagccauuuggcacgugaauucuuuauuguugaguugauuuuacaguagauacuuuuugaaguuauuguccuuggauugaggauguggcucaguaaguagcagaaugcuugcuuaggauaugcaagguccacaugucacaugccuaaguacagugacauccuaguucagggacagcagagugacugguuaauugagcucugcguaggucacuuaguuauuucagcaucagucagacaauuccaguguagcagcagauaugaguuacaaagggacauuccugcccuugacaccuacguucuuugcaagguucagcugugugagguuuccaguccaggucaugcagcagccuggaaguggucuuaaaaguuaacacugucgggccugcuuccccucucuccccuuggguucucagcugagggccugcuucugcugcccuucccuguguucguacugagaggcagugcucugaccaaacuggccgucgcaggagcaaauccaguucauacugaaaguuccuaccagcuggggggauucgauuccccagagcccugcguguagccaugugcauucugaaacuacugcgcauggcugcuucaggcucuuuuaaugucucccgaggcccuucauauucaauuucaugcucucugcuuauuaaaccacaauauccucuccccucuacccugaauagaauacaaaagaaaaugua

SEQ ID NO: 4362 - RNA, 9431 nt, Mus musculus
agcuggaaggaacaccagugagggaguuuccugaaccaaaggugugugcccgugucccuugcugcuucccuaaguaaggccccaacagaggaacaagaacacuguccucauaggaacugagugcuggagccaacaaguuugagagggaaguagucaguaccugugggaauuaaucccaaagaaaaagauauggcagaccaugucuauaggcaggaaaaucagaauuucauggcuugucugagauaccuagcaaguucaaggacagaccagguuagacuuuuuuuuuaaagaauuauuuauuuuaugaguacaccguacuucagacacagcagaagagggcaucagaucccauuacagauggauguaagcuaccaucugguugcugggaauugcacucaggaccucugaaagagcagucaguggacuuaacugcugagucaucucuccagcccaacacguuugucuuaaucccacaaaagaggcaagaacuagguuacgccucuccaguggacacugauugggagggugugcacuagggggacaagcuacuagaaaccuguaauggacaaagugagcccuggcacaagaguaggccuuugggauuagaccuuggagccuuagaugccucaugacaguagcucccacaaggccucucauacaaacucaacaggacagaaauguaggcuguauccauauauaaccauuuauccaguugccuugaaggagucuuguccugccuugggacaguaaugacaagguucaaaaguauccugcuggcggcagggucuggugcagagcaaaucuaaugagacuuuacugaugacauucaugacauaugaauuugguuuaaaaguagccucaaagguacuuggaaagaagagaucuuggcagggcagggcugggugguagagcuuuucccugccuggugugucugggagcaacugaggcaauuaauucuaagguucccuggaucugcccaguaccacagggaucacauaccugcagggacugacaacagucaauguccaaaugauuuguguuucucaccuuugugcacaggucaggaccuguagcagggcaggccagccuuagcugcaugaggaaagggugagcuugcaggguggaacccaggccuaaguuacucucugccuugagagcuuacugggugggucaucucauuuccagagaguucccagaaugagaaguuagaguggaguugguaucaaugggugagcaaauaaaugaaaacugaacacauggggugcucaggaggccccacauagaaggaaccaaggccagcuagaggacuugagcuauuguccuauauugcccuagcccugacacuggcauccuguuugucuuugagccagccauugauacccuccagaccugauggacggucuugcagguuuuguuuguuuguuugucuguuuguuuguucuuuugagacagggucauucuguguagcccuuguuguccuaaaccuuacuauauagaccaggcugggcuugaacucaccagagaucuacuugccucugccagggagaguaugugccaccaugccuaccucuggucuuguugcaagaacucacucuuugacucuuuuacccuggcucccucucuuggccagagcuucuauauacuuuuugaugcaccucaguuacugggcauuuaagcggaggacagggcuugaagucuacauuuacaacuuuagagaagcuauauauacauauccucugccccaucuccgugaccccugcuuuccccuaccugcagagucugguccucccuuuacacagucugcucccucccaccuuggccagcacugcaggaugaggcaaucauuccauccuugacccucugcacaaugacugaugacuuuuuuaucucaagugaugaugcacagccuuccacgggaagcauuuaaggcagcgcacuugaucugcgccacagcugcaggacucaggaccuugaaaggcucaggaagaacaacccuugagcaccucagcacucagcauguuccucgcuacguucaagcugugugcuggaagcuccuauagacauaugcggaauaugaaaggugagucuggguuggggaggagggaugagagcuugccaaaagccuguaggcaacauaguuuugugggaaagcucuugggcaggggaauaggccaccucagcuucgaucccagcuaugccucuuaacugggggagccuggguaaagcccuucuucucuggaccucagguuuucaccuaaaaaauuggccuggcuacuaaggugccaccucucauccaaauucuguaauuucuaguuucuacucuaaggcccuaguuguucuggagcuaguacugauguugccucccuucacgaguggauuaagucuguaccaagggucccaggcaagucuuugccauagugguagagaaauacagaagcuaguccuuacucuaagcagugccuggcaaguccgagacacugucugggaagaagagcagaagacaggagaguugagcagcagaaguacaaggcaaaggauggugggggugacucuugucccuggguagcugguugucccuugguagggcaacccucaggagacggaguacauccuacucaauauccaggggcuacccaagcggcccagggaaacuucuguggccagguagggccaggucugaccagcccaccccuauuuuccaugauggaaaagagaucugggcccuggaaguucgagagaaaguuuaacacugaacuugagaguuagagauguggcuggaguuugagucccugcugggaucugugucccugggccgguuugcucaucugugaugaguggacagaacugucccucucccagagauugccuagcuacuugacaaauguuucuuucccucccugcaggauuaaggcaccaagcugugcuggccauuggccaagagcucaacuggagagcacugggggauuccagucccggguggaugggucaaguucgacgucggagcucucugcuugguaaauaaauauuggggcuuucugagcuucugccagugaugggucuuagggugcaugaggccuguccccuaccuguaguuaccuaacuccugugucuaccuugaccugcaagcagagcccuauggcuaugaucgugucucuucugaaggcugaacacauucagagggcagagggaugagagcuguggauuggcuaggaccauuguacccacguuuucuuuuuccuuggcuauguaugcagguucucaacuggaagcaacacucuauagugaccaggagcuguccuacauccagcagggagagguggcuaugcagaaggccuugggcauacucaacaaccaggaaggcuggaagaaggaaagccagcagguaaguaaaggcagcugugagaagccugcaguuacugauggucccacuaccaugcucaaagccugccgggauucccacugcauucacaauugauaaacagucaaaaaguuuuggucugagaacucuccuaagaauauaucaucagguggggugagggugcauaccuuuuucaucucagcacucaggagacugaggcauguggacgucugggaguauacggcuagccugguuuauguagcaaguuccaggcuagccaggcccgcauaguaauacccuuccucaaaacaagcaaaccaaugaauguguucucagauaaccuuuccuccugaagacuaacugagaaacauuauuccuguuuuuuaacuacucucugaaugcuguaaacucauccaguaaaaaaucugaucucauccugacacacagaagcaaaaccuacguuaaaaccaguagcucuauuauuagaucuacucugguggccuuaucuucaacaacaguuuacacacuguccauuaccccaaguucagaugaaacaucucguugcuccagcuccuacaguaacggagauaagacacuaauaggaucugauccacugauccacugauccgggauccaggcuuagcaguguaucugugcugagcgucuugggcagaucacugaaaccuucaggccccagguucuuccaaagugagucaacuaaucaaaaagcccagccuucucuuuaucuaguuagcugcuguagaccaguccguccuucaggucauuucaguuggaccuacccauacuaccaacauucaucacuaaaacaauaggcgugguaccucuuccagcuuugaguggacauacaaggcuuuuggccgcagugucuacccacugggucuucaccagguagagauccagguaccuauugcucaucguaggccuacugucucuguucugaguauugucugaaaccuaggcuaggaauaauguucucuaaccguaaccccauggcucucuuuugucccuaacaggagaacggggacgaagugcuaaguaagauggugccagaugugggcaagguguuucgcuuggagguggugguagaccagcccauggacagacucuaugaagaacuuguggaccgcauggaggccaugggagaguggaacccaaaugucaaggagaucaaggugaggaaagcccaagugugggcggcagggaaccaagcgaaugcaguccugaacagcaggugcuuagccuaucaguggcugaguccaggcuccaacucccuugugcuagguccugcagaggauuggaaaagacacggucaucacucaugagcuggcugcggcggcagcaggcaaccugguggggccucgagacuucgugagcgugcgcuguaccaagcgcagagguuccaccugugugcuggcaggcauggccacacauuuuggggagaugccggagcagaguggugucaucagguaaaacuuggcggcagucuccaaacugcagugucauaaucuugauccccacuuccaagcaaccaauucuuagccccacacucagcuuuaaaaaaaaaaaagcaauggccagaguagccccacuuccgcagcuaggugguuuauucuacccucccaggaacuuuucuaagaauccuaauaauuuuccaaagcuaggagcaggccucuuuggguucuaacagugguggcccagcgagaagccuccagccacaaccagcagguucugaugagcuaguacccaugccaacuguuuaguauucuugguaaaguaccuccugaugaaaguuaaaaaucaagggacucuaaguaacuaaccagucuaggaauucucaccugucuuccugccuugccagagcugaacacggccccaccugcauggugcuucauccacuggcuggaagucccuccaagacuaaacucacuuggcugcucaguauugaccugaaggugagaggccugggggggauggccugagugggaaguagugacaacaguaugcucuuguccccagcauagauagagaagccucuugcagguuuucuugacuuucaaagcacauuguuguuguguaugcaccauguguaugugugaauguaggugcucaugugugacagcaagguggaagucugaggacacuguugaucuggggcucuuccuccucuacgugggccccaggaacuuaucagauggccaggcauguacucugacccacuaagcugccuugucagccuuccucuugccuucugauagagucacaggcuguuggauaggcaacggacagaagcauggcuucguauucugccaguguggaagcuugcaaaaaagcuuccacaucuaaaaagcuaggugcaagcugggugugguggcgcacgccuuuaaucccagcacucgggaggcagaggcaggcggauuucugaguucgaggccagccuggucuacagagugagcuccaggacagccagggcuaugcagagaaacccugucucgaaaaaccaaaaaaaaaaaaaaaaaaaaaaaaaaaaaagcuaggugcagugucauaaacuucaguacuuuagggaagaaauaggaagaucacauuugagauuccaagauaguuuuuuuaaaaucaguuuuauauauaaucaugaccauuuacaaaggugauccuaggcccaguacauggggauucucaccuuucaggugacacagaugucucgcucggggucacacauccuaucuuuaaccauaaggcagcuaaggcccccuuauccagcaagaccaagcuugaggugccccugccuaugugggguacagaacugugcucaggaucccagugcucuugugucuaccccagggguggcugccgaagacaaucaucaaccagguccuaucgcagacccagauagaguucgccaaccaccugcgcaagcgccuggaagccagcccugccucugaggcccaguguuaaggacuguccaccacauugaccugcaaaucauuggaagcucucacaggaagccugcaagucuguccaucuucagcuaacagcaucgggaggggugguagucaggagacacuaggacugacugguaaaaucaggaucagcaaaauagaaaugaggcuuagaauaaaaguucucuagugucucccacugcauagcugugaaggcuaagggauaaguagcuaugaaaccuuucaucuaggcuuguauaugcugaccuaaaagacaccagcagcuacgaacaggggaugcuaaggaucgggaacuguugucuuaccagcuccaaaugucacuaccugaaggcagugugcacacaaagcaaggucuugccuaggaaacucuguaaaaguucuccucuguaaaaggccagaacuugaaugaaacuaccuacaaagggccuuuccagaguauuccaacuuuucucugaggagaaaugaaaccaucauugugccgacuucccuacuaaucccaugacaauaaagaacauacaugcacacuucagccuguacaugucaggucccagccugaggaaucacagcuucagcagaacucugcgcuuaaaucuccuagcucacaaaaggggacaaaacguccggagauuuaugucauuugacuguuuagauucuuuccuaaaaaggcaaucucauaauuaaaggcacgugccuuuaaucccaacacucaaguggcagaggcagguggauuuuuucuaauacugaggcuaaccuggucuacacagaaggauagccagagcuacauaaugagacugucucaaaaccacaaaacccagggauugaaaagauggcugaccuguugggagcacaagcugcucuuccaaggaauccagggucaaucuccagcauccacacagcagcucccaacucuaauucuagucccagggaaccugaugcccucuuguggccgccauggggaccagguaugcaagugguacauagacauacagauauguaggcugaacacccauuaacauuaacaacaaaacccuugucgggcacgguggcucaacagcuuuaaucucaacacugcaaauggugacaccagugaaucgcuccaaguuccaggccagcuuggaccccagugagaccgucucacaaaagcaggaacaaaaucuugggaguugguaguuaagauuaacagcauccuggcaggaagauuaugacgggauuuucauuuaccuauacugaucaaauaauacugaccaauaauguuaagauaaagugacuguucuauuguuuauagacagauuagaugccagccuggcucagagcuagcagcuuccuuauuugaaaagguuaaaauguuauguuaccuucuaggaagacaaauagcuagaagucaguagagcuauaacauuccuguuccaggauuuggagauauuacacuuuaaggguauaaauugggagccaggugacgguggcacacgacuuuaaucccaguagaggcagguggaucucuugaguuugaagucagccugguuuacagaguaaguuccaggaaagucagggcuguuaaauagagaaaugcugcucaaaaacauaaaaaaauaaaaaugacaaaaauauaagugugaccagcaaaaugacucaggguguaagugcuugccaccaagucugaugauggcagaagccacagagauggaaggagagagaugaaaaacagagguccuuauggcugcuuaucuacacuaaguaccuuacacacauaaauacugguauauauuggaauuccuuuccgaauguguuaaggaugaacaauucuaacaaccgaaagcuuuucauucuaagcaugaaaaaaaaaaaaaguaaugucugugugagugugcaugggccccagcagacacguggaggucagaggacaacuucaggagugugccuucgacccccacccgggucuuggguccuggauuguuaggguaggcagcaagcacuuucauccgcagugccauuuugcuggcccacuuuucugucccuuaucguguggguaacccccaucauuugcaaagaacugagcuuauuuaugaauagaacaauguggaacauguacuuauuuauugaagucuuaagccuucacugauauuuauugcucaccucggugcuuuaaggugagcgagggcagcuguagaguguuucugauagaaccaucccgggaaucaguuaagagagcagccacuugggugcugaaagacccaugugugccggccucgagacaacaggcugccaguggagaagcgccuucagcaaacacuguggcuuugauuggauuaguguuugcuccuauacacaccgucacucuaucucugccgucugggauguuugacccauuuguuuaaucuuauauuuuaauaaaagcaguugucacuggcauucugauaccuauagauggguaguaguucuuuuuuaaucuuucaaacgaaccuuauuaacacauucaaguuuacaacuguacacacauuuuuuuuuucuuguuucacuucaauuguucuuuugagacaggaucuucucacucauucuguagcccaagauggccuggaacuuauaucaacccuucugccucugccucucaagugcugggauuaaugguggggccugcaggcaucugggcauuuuuuucagacacugcuaaguacugucaagcaccuugauaacuucuaaugcaggaaagccagguacacaaacacguagguagacaggagaccugggcaugguuaugugccaacacccacucauacuucuuccaagaccaucacuucacuuucuucagaguccuucgaacaccgaugagcucauucuacaagcuggcuuguucuuucuuggacuaguccuugcauuagugguuaucuagcagcugguaggcugugaccccagcuuuaaauaaugcagacaccccaaagaaggcauagcaagacagauuucugucaguuugaagccagucaggcuauauggacagaccuugccucaaaaaagcaaaaaaagauauucaauguaugaaagaaguuugggggauucagcagcagacaaguauauuaaauuguguuaauagucauuca

SEQ ID NO: 4363 - RNA, 9431 nt, Mus musculus
ugaaugacuauuaacacaauuuaauauacuugucugcugcugaaucccccaaacuucuuucauacauugaauaucuuuuuuugcuuuuuugaggcaaggucuguccauauagccugacuggcuucaaacugacagaaaucugucuugcuaugccuucuuuggggugucugcauuauuuaaagcuggggucacagccuaccagcugcuagauaaccacuaaugcaaggacuaguccaagaaagaacaagccagcuuguagaaugagcucaucgguguucgaaggacucugaagaaagugaagugauggucuuggaagaaguaugaguggguguuggcacauaaccaugcccaggucuccugucuaccuacguguuuguguaccuggcuuuccugcauuagaaguuaucaaggugcuugacaguacuuagcagugucugaaaaaaaugcccagaugccugcaggccccaccauuaaucccagcacuugagaggcagaggcagaaggguugauauaaguuccaggccaucuugggcuacagaaugagugagaagauccugucucaaaagaacaauugaagugaaacaagaaaaaaaaaauguguguacaguuguaaacuugaauguguuaauaagguucguuugaaagauuaaaaaagaacuacuacccaucuauagguaucagaaugccagugacaacugcuuuuauuaaaauauaagauuaaacaaaugggucaaacaucccagacggcagagauagagugacgguguguauaggagcaaacacuaauccaaucaaagccacaguguuugcugaaggcgcuucuccacuggcagccuguugucucgaggccggcacacaugggucuuucagcacccaaguggcugcucucuuaacugauucccgggaugguucuaucagaaacacucuacagcugcccucgcucaccuuaaagcaccgaggugagcaauaaauaucagugaaggcuuaagacuucaauaaauaaguacauguuccacauuguucuauucauaaauaagcucaguucuuugcaaaugauggggguuacccacacgauaagggacagaaaagugggccagcaaaauggcacugcggaugaaagugcuugcugccuacccuaacaauccaggacccaagacccgggugggggucgaaggcacacuccugaaguuguccucugaccuccacgugucugcuggggcccaugcacacucacacagacauuacuuuuuuuuuuuuucaugcuuagaaugaaaagcuuucgguuguuagaauuguucauccuuaacacauucggaaaggaauuccaauauauaccaguauuuauguguguaagguacuuaguguagauaagcagccauaaggaccucuguuuuucaucucucuccuuccaucucuguggcuucugccaucaucagacuugguggcaagcacuuacacccugagucauuuugcuggucacacuuauauuuuugucauuuuuauuuuuuuauguuuuugagcagcauuucucuauuuaacagcccugacuuuccuggaacuuacucuguaaaccaggcugacuucaaacucaagagauccaccugccucuacugggauuaaagucgugugccaccgucaccuggcucccaauuuauacccuuaaaguguaauaucuccaaauccuggaacaggaauguuauagcucuacugacuucuagcuauuugucuuccuagaagguaacauaacauuuuaaccuuuucaaauaaggaagcugcuagcucugagccaggcuggcaucuaaucugucuauaaacaauagaacagucacuuuaucuuaacauuauuggucaguauuauuugaucaguauagguaaaugaaaaucccgucauaaucuuccugccaggaugcuguuaaucuuaacuaccaacucccaagauuuuguuccugcuuuugugagacggucucacugggguccaagcuggccuggaacuuggagcgauucacuggugucaccauuugcaguguugagauuaaagcuguugagccaccgugcccgacaaggguuuuguuguuaauguuaauggguguucagccuacauaucuguaugucuauguaccacuugcauaccugguccccauggcggccacaagagggcaucagguucccugggacuagaauuagaguugggagcugcuguguggaugcuggagauugacccuggauuccuuggaagagcagcuugugcucccaacaggucagccaucuuuucaaucccuggguuuugugguuuugagacagucucauuauguagcucuggcuauccuucuguguagaccagguuagccucaguauuagaaaaaauccaccugccucugccacuugaguguugggauuaaaggcacgugccuuuaauuaugagauugccuuuuuaggaaagaaucuaaacagucaaaugacauaaaucuccggacguuuuguccccuuuugugagcuaggagauuuaagcgcagaguucugcugaagcugugauuccucaggcugggaccugacauguacaggcugaagugugcauguauguucuuuauugucaugggauuaguagggaagucggcacaaugaugguuucauuucuccucagagaaaaguuggaauacucuggaaaggcccuuuguagguaguuucauucaaguucuggccuuuuacagaggagaacuuuuacagaguuuccuaggcaagaccuugcuuugugugcacacugccuucagguagugacauuuggagcugguaagacaacaguucccgauccuuagcauccccuguucguagcugcuggugucuuuuaggucagcauauacaagccuagaugaaagguuucauagcuacuuaucccuuagccuucacagcuaugcagugggagacacuagagaacuuuuauucuaagccucauuucuauuuugcugauccugauuuuaccagucaguccuagugucuccugacuaccaccccucccgaugcuguuagcugaagauggacagacuugcaggcuuccugugagagcuuccaaugauuugcaggucaaugugguggacaguccuuaacacugggccucagaggcagggcuggcuuccaggcgcuugcgcaggugguuggcgaacucuaucugggucugcgauaggaccugguugaugauugucuucggcagccaccccugggguagacacaagagcacugggauccugagcacaguucuguaccccacauaggcaggggcaccucaagcuuggucuugcuggauaagggggccuuagcugccuuaugguuaaagauaggaugugugaccccgagcgagacaucugugucaccugaaaggugagaauccccauguacugggccuaggaucaccuuuguaaauggucaugauuauauauaaaacugauuuuaaaaaaacuaucuuggaaucucaaaugugaucuuccuauuucuucccuaaaguacugaaguuuaugacacugcaccuagcuuuuuuuuuuuuuuuuuuuuuuuuuuuuuugguuuuucgagacaggguuucucugcauagcccuggcuguccuggagcucacucuguagaccaggcuggccucgaacucagaaauccgccugccucugccucccgagugcugggauuaaaggcgugcgccaccacacccagcuugcaccuagcuuuuuagauguggaagcuuuuuugcaagcuuccacacuggcagaauacgaagccaugcuucuguccguugccuauccaacagccugugacucuaucagaaggcaagaggaaggcugacaaggcagcuuagugggucagaguacaugccuggccaucugauaaguuccuggggcccacguagaggaggaagagccccagaucaacaguguccucagacuuccaccuugcugucacacaugagcaccuacauucacacauacacauggugcauacacaacaacaaugugcuuugaaagucaagaaaaccugcaagaggcuucucuaucuaugcuggggacaagagcauacuguugucacuacuucccacucaggccaucccccccaggccucucaccuucaggucaauacugagcagccaagugaguuuagucuuggagggacuuccagccaguggaugaagcaccaugcagguggggccguguucagcucuggcaaggcaggaagacaggugagaauuccuagacugguuaguuacuuagagucccuugauuuuuaacuuucaucaggagguacuuuaccaagaauacuaaacaguuggcauggguacuagcucaucagaaccugcugguuguggcuggaggcuucucgcugggccaccacuguuagaacccaaagaggccugcuccuagcuuuggaaaauuauuaggauucuuagaaaaguuccugggaggguagaauaaaccaccuagcugcggaaguggggcuacucuggccauugcuuuuuuuuuuuuaaagcugaguguggggcuaagaauugguugcuuggaaguggggaucaagauuaugacacugcaguuuggagacugccgccaaguuuuaccugaugacaccacucugcuccggcaucuccccaaaauguguggccaugccugccagcacacagguggaaccucugcgcuugguacagcgcacgcucacgaagucucgaggccccaccagguugccugcugccgccgcagccagcucaugagugaugaccgugucuuuuccaauccucugcaggaccuagcacaagggaguuggagccuggacucagccacugauaggcuaagcaccugcuguucaggacugcauucgcuugguucccugccgcccacacuugggcuuuccucaccuugaucuccuugacauuuggguuccacucucccauggccuccaugcgguccacaaguucuucauagagucuguccaugggcuggucuaccaccaccuccaagcgaaacaccuugcccacaucuggcaccaucuuacuuagcacuucguccccguucuccuguuagggacaaaagagagccaugggguuacgguuagagaacauuauuccuagccuagguuucagacaauacucagaacagagacaguaggccuacgaugagcaauagguaccuggaucucuaccuggugaagacccaguggguagacacugcggccaaaagccuuguauguccacucaaagcuggaagagguaccacgccuauuguuuuagugaugaauguugguaguauggguagguccaacugaaaugaccugaaggacggacuggucuacagcagcuaacuagauaaagagaaggcugggcuuuuugauuaguugacucacuuuggaagaaccuggggccugaagguuucagugaucugcccaagacgcucagcacagauacacugcuaagccuggaucccggaucaguggaucaguggaucagauccuauuagugucuuaucuccguuacuguaggagcuggagcaacgagauguuucaucugaacuugggguaauggacaguguguaaacuguuguugaagauaaggccaccagaguagaucuaauaauagagcuacugguuuuaacguagguuuugcuucugugugucaggaugagaucagauuuuuuacuggaugaguuuacagcauucagagaguaguuaaaaaacaggaauaauguuucucaguuagucuucaggaggaaagguuaucugagaacacauucauugguuugcuuguuuugaggaaggguauuacuaugcgggccuggcuagccuggaacuugcuacauaaaccaggcuagccguauacucccagacguccacaugccucagucuccugagugcugagaugaaaaagguaugcacccucaccccaccugaugauauauucuuaggagaguucucagaccaaaacuuuuugacuguuuaucaauugugaaugcagugggaaucccggcaggcuuugagcaugguagugggaccaucaguaacugcaggcuucucacagcugccuuuacuuaccugcuggcuuuccuucuuccagccuuccugguuguugaguaugcccaaggccuucugcauagccaccucucccugcuggauguaggacagcuccuggucacuauagaguguugcuuccaguugagaaccugcauacauagccaaggaaaaagaaaacguggguacaaugguccuagccaauccacagcucucaucccucugcccucugaauguguucagccuucagaagagacacgaucauagccauagggcucugcuugcaggucaagguagacacaggaguuagguaacuacagguaggggacaggccucaugcacccuaagacccaucacuggcagaagcucagaaagccccaauauuuauuuaccaagcagagagcuccgacgucgaacuugacccauccacccgggacuggaaucccccagugcucuccaguugagcucuuggccaauggccagcacagcuuggugccuuaauccugcagggagggaaagaaacauuugucaaguagcuaggcaaucucugggagagggacaguucuguccacucaucacagaugagcaaaccggcccagggacacagaucccagcagggacucaaacuccagccacaucucuaacucucaaguucaguguuaaacuuucucucgaacuuccagggcccagaucucuuuuccaucauggaaaauaggggugggcuggucagaccuggcccuaccuggccacagaaguuucccugggccgcuuggguagccccuggauauugaguaggauguacuccgucuccugaggguugcccuaccaagggacaaccagcuacccagggacaagagucacccccaccauccuuugccuuguacuucugcugcucaacucuccugucuucugcucuucuucccagacagugucucggacuugccaggcacugcuuagaguaaggacuagcuucuguauuucucuaccacuauggcaaagacuugccugggacccuugguacagacuuaauccacucgugaagggaggcaacaucaguacuagcuccagaacaacuagggccuuagaguagaaacuagaaauuacagaauuuggaugagagguggcaccuuaguagccaggccaauuuuuuaggugaaaaccugagguccagagaagaagggcuuuacccaggcucccccaguuaagaggcauagcugggaucgaagcugagguggccuauuccccugcccaagagcuuucccacaaaacuauguugccuacaggcuuuuggcaagcucucaucccuccuccccaacccagacucaccuuucauauuccgcauaugucuauaggagcuuccagcacacagcuugaacguagcgaggaacaugcugagugcugaggugcucaaggguuguucuuccugagccuuucaagguccugaguccugcagcuguggcgcagaucaagugcgcugccuuaaaugcuucccguggaaggcugugcaucaucacuugagauaaaaaagucaucagucauugugcagagggucaaggauggaaugauugccucauccugcagugcuggccaaggugggagggagcagacuguguaaagggaggaccagacucugcagguaggggaaagcaggggucacggagauggggcagaggauauguauauauagcuucucuaaaguuguaaauguagacuucaagcccuguccuccgcuuaaaugcccaguaacugaggugcaucaaaaaguauauagaagcucuggccaagagagggagccaggguaaaagagucaaagagugaguucuugcaacaagaccagagguaggcaugguggcacauacucucccuggcagaggcaaguagaucucuggugaguucaagcccagccuggucuauauaguaagguuuaggacaacaagggcuacacagaaugacccugucucaaaagaacaaacaaacagacaaacaaacaaacaaaaccugcaagaccguccaucaggucuggaggguaucaauggcuggcucaaagacaaacaggaugccagugucagggcuagggcaauauaggacaauagcucaaguccucuagcuggccuugguuccuucuauguggggccuccugagcaccccauguguucaguuuucauuuauuugcucacccauugauaccaacuccacucuaacuucucauucugggaacucucuggaaaugagaugacccacccaguaagcucucaaggcagagaguaacuuaggccuggguuccacccugcaagcucacccuuuccucaugcagcuaaggcuggccugcccugcuacagguccugaccugugcacaaaggugagaaacacaaaucauuuggacauugacuguugucagucccugcagguaugugaucccugugguacugggcagauccagggaaccuuagaauuaauugccucaguugcucccagacacaccaggcagggaaaagcucuaccacccagcccugcccugccaagaucucuucuuuccaaguaccuuugaggcuacuuuuaaaccaaauucauaugucaugaaugucaucaguaaagucucauuagauuugcucugcaccagacccugccgccagcaggauacuuuugaaccuugucauuacugucccaaggcaggacaagacuccuucaaggcaacuggauaaaugguuauauauggauacagccuacauuucuguccuguugaguuuguaugagaggccuugugggagcuacugucaugaggcaucuaaggcuccaaggucuaaucccaaaggccuacucuugugccagggcucacuuuguccauuacagguuucuaguagcuugucccccuagugcacacccucccaaucaguguccacuggagaggcguaaccuaguucuugccucuuuugugggauuaagacaaacguguugggcuggagagaugacucagcaguuaaguccacugacugcucuuucagagguccugagugcaauucccagcaaccagaugguagcuuacauccaucuguaaugggaucugaugcccucuucugcugugucugaaguacgguguacucauaaaauaaauaauucuuuaaaaaaaaagucuaaccuggucuguccuugaacuugcuagguaucucagacaagccaugaaauucugauuuuccugccuauagacauggucugccauaucuuuuucuuugggauuaauucccacagguacugacuacuucccucucaaacuuguuggcuccagcacucaguuccuaugaggacaguguucuuguuccucuguuggggccuuacuuagggaagcagcaagggacacgggcacacaccuuugguucaggaaacucccucacugguguuccuuccagcu

SEQ ID NO: 4364 - RNA, 2516 nt, Mus musculus
accgaggugagcaauaaauaucagugaaggcuuaagacuucaauaaauaaguacauguuccacauuguucuauucauaaauaagcucaguucuuugcaaaugauggggguuacccacacgauaagggacagaaaagugggccagcaaaauggcacugcggaugaaagugcuugcugccuacccuaacaauccaggacccaagacccgggugggggucgaaggcacacuccugaaguuguccucugaccuccacgugucugcuggggcccaugcacacucacacagacauuacuuuuuuuuuuuuucaugcuuagaaugaaaagcuuucgguuguuagaauuguucauccuuaacacauucggaaaggaauuccaauauauaccaguauuuauguguguaagguacuuaguguagauaagcagccauaaggaccucuguuuuucaucucucuccuuccaucucuguggcuucugccaucaucagacuugguggcaagcacuuacacccugagucauuuugcuggucacacuuauauuuuugucauuuuuauuuuuuuauguuuuugagcagcauuucucuauuuaacagcccugacuuuccuggaacuuacucuguaaaccaggcugacuucaaacucaagagauccaccugccucuacugggauuaaagucgugugccaccgucaccuggcucccaauuuauacccuuaaaguguaauaucuccaaauccuggaacaggaauguuauagcucuacugacuucuagcuauuugucuuccuagaagguaacauaacauuuuaaccuuuucaaauaaggaagcugcuagcucugagccaggcuggcaucuaaucugucuauaaacaauagaacagucacuuuaucuuaacauuauuggucaguauuauuugaucaguauagguaaaugaaaaucccgucauaaucuuccugccaggaugcuguuaaucuuaacuaccaacucccaagauuuuguuccugcuuuugugagacggucucacugggguccaagcuggccuggaacuuggagcgauucacuggugucaccauuugcaguguugagauuaaagcuguugagccaccgugcccgacaaggguuuuguuguuaauguuaauggguguucagccuacauaucuguaugucuauguaccacuugcauaccugguccccauggcggccacaagagggcaucagguucccugggacuagaauuagaguugggagcugcuguguggaugcuggagauugacccuggauuccuuggaagagcagcuugugcucccaacaggucagccaucuuuucaaucccuggguuuugugguuuugagacagucucauuauguagcucuggcuauccuucuguguagaccagguuagccucaguauuagaaaaaauccaccugccucugccacuugaguguugggauuaaaggcacgugccuuuaauuaugagauugccuuuuuaggaaagaaucuaaacagucaaaugacauaaaucuccggacguuuuguccccuuuugugagcuaggagauuuaagcgcagaguucugcugaagcugugauuccucaggcugggaccugacauguacaggcugaagugugcauguauguucuuuauugucaugggauuaguagggaagucggcacaaugaugguuucauuucuccucagagaaaaguuggaauacucuggaaaggcccuuuguagguaguuucauucaaguucuggccuuuuacagaggagaacuuuuacagaguuuccuaggcaagaccuugcuuugugugcacacugccuucagguagugacauuuggagcugguaagacaacaguucccgauccuuagcauccccuguucguagcugcuggugucuuuuaggucagcauauacaagccuagaugaaagguuucauagcuacuuaucccuuagccuucacagcuaugcagugggagacacuagagaacuuuuauucuaagccucauuucuauuuugcugauccugauuuuaccagucaguccuagugucuccugacuaccaccccucccgaugcuguuagcugaagauggacagacuugcaggcuuccugugagagcuuccaaugauuugcaggucaaugugguggacaguccuuaacacugggccucagaggcagggcuggcuuccaggcgcuugcgcaggugguuggcgaacucuaucugggucugcgauaggaccugguugaugauugucuucggcagccaccccugggguagacacaagagcacugggauccugagcacaguucuguaccccacauaggcaggggcaccucaagcuuggucuugcuggauaagggggccuuagcugccuuaugguuaaagauaggaugugugaccccgagcgagacaucugugucaccugaaaggugagaauccccauguacugggccuaggaucaccuuuguaaauggucaugauuauauauaaaacugauuuuaaaaaaacuaucuuggaaucucaaau

SEQ ID NO: 4365 - RNA, 2395 nt, Mus musculus
caaaagcucucuuccauuaucauuucccaaguauuuagugagcugcuacaguaugcaugucaauuuaaaaacacuuuaguaauuacccagguuuggcuccuccuacagagcaccacauugcaggcaaggcuuucaucauucacaaagcuucugacaagauacuuaaacacauaccauuuagguucccacuagcagacacagcacugcuuuguuucugguugucauaagcaggaccaauauuacuaagauccuagaagaagaaauauccuaguaaaaaaaaggccacaugagcaaauuaaucuggcaacugcuccaaaaauggacaaaauuagagcacagaaaaucaaagucauguccuaaacagcaagcugcaagguccucaacuuggaugcuucaacaacucacgaaggagcaugugccaugagucagggucagaaugguuccaggagggaacugaccaaucaaccgguaggcgggagcugcacagcaggccaggacgaugaaguccccucacucugcccucacagcugagcugucccacuguaugugacagcaaccugaaucuucacuguccaugcuauaacagugaccaccuagaggcaccgcagcucuucaaucugcauggguagcagugagcucccaccucagcgacugggaagguggcugaggacagagguccccacagugucaugcuacacugacagaucucaucucaaaaaaggcagcaagucagacacuuuaaggcaaaucuucuuaguugccaauguguccuuugcaacaaaaaauggaaauuucuuuuucccauaaggaucuaacaacagauuccccagaaauuucuucacacuaaagaaugcuuuuagaagcaaaauuucagauaacaggaagauuagaaaaaaacuuacaaaaaguaaucccuaacaccgaggaacaaccagaaucaaaaccgguuccugagccaggcacugcgccucacacacguaaccccagcagagagagccaaggcaggaagaacagucuugaguuuaagcuaaccugggcuacagugagauccugugacaaagagaucaccacuaacuccugggaaccggggagcuggggauaugaacucuuauuuuaaggcuugaacacuuuuuauuugagucaaggccucauguagcccaggcuggccucaaacucgugcucuuccuuguuugcaccuccucacugcaucaccaugaacacaccaggacucccaggcaaggacugcucucaacucggccacaucccuggccacaugcuucaccgccccuaaauggcuucugauuaaaaaaaaaagacuauggggcaggagagauggcucaguggcuaggagcacugcugcucucccagcagucccagcuuggaguccccagcacugcagggagcucacaagugucuguaacucggguuccuagagcucugcuccacucccucgucuggccucugcagccacacacaaacacaaugcacagaccucauacgggagagagagacagagagacaaagaaggaagauuaauguaccugauccaaaaguccaaacuugggguaaucuucuucugggucuuugcuuccugggucaggguguuccuuuaccaagaacacaucucuuuccuuacucuaaaaggaaauggcaucuuagcaagaaugagcauuuuacucacaaguguggggauacucacucaccaacugccaaugucaaugucuaacuguacucuccaaacccaucagaaaaucagugcagaccauaacaagucaagugagagcacucagagcccggucaggcugggaggcaggaagaccucagugugagcccuagcaccacaagaacaccaagcauggcggcuccacacggaaggccagcacaaggaacacagaggcaagaggagagacaaugaguuacaugaguuacaacuguacuggcacucugcagggagaaggccgggggucggucacccuuggcuacacacugaguucaaugccugggcuacaagagaccuaaaaauaaccaacaggacagugagggccagugccccacaacccuccucucuccucuugccuggguuaagcagacuucuaaagucaauguucagaacaagacuuuucuuaucuaaugaaaaaauuuaaaaauguauccaaauuuaauuuaaaauuaaaucugcaaaagugugguggacagagauggcuggaccagagggauggcucagugcuuaagagcaccugcugcuuuccagagcauccagguuuaguucccagcaucaauaucaggugacucaaagccaucuaacuccaauuccagggauccaaugccccuuucuggucucuauagguacacauacacacacucaagcauauacauauaaaauaaacaaaucuua

SEQ ID NO: 4366 - RNA, 2395 nt, Mus musculus
uaagauuuguuuauuuuauauguauaugcuugaguguguguauguguaccuauagagaccagaaaggggcauuggaucccuggaauuggaguuagauggcuuugagucaccugauauugaugcugggaacuaaaccuggaugcucuggaaagcagcaggugcucuuaagcacugagccaucccucugguccagccaucucuguccaccacacuuuugcagauuuaauuuuaaauuaaauuuggauacauuuuuaaauuuuuucauuagauaagaaaagucuuguucugaacauugacuuuagaagucugcuuaacccaggcaagaggagagaggaggguuguggggcacuggcccucacuguccuguugguuauuuuuaggucucuuguagcccaggcauugaacucaguguguagccaagggugaccgacccccggccuucucccugcagagugccaguacaguuguaacucauguaacucauugucucuccucuugccucuguguuccuugugcuggccuuccguguggagccgccaugcuugguguucuuguggugcuagggcucacacugaggucuuccugccucccagccugaccgggcucugagugcucucacuugacuuguuauggucugcacugauuuucugauggguuuggagaguacaguuagacauugacauuggcaguuggugagugaguauccccacacuugugaguaaaaugcucauucuugcuaagaugccauuuccuuuuagaguaaggaaagagauguguucuugguaaaggaacacccugacccaggaagcaaagacccagaagaagauuaccccaaguuuggacuuuuggaucagguacauuaaucuuccuucuuugucucucugucucucucucccguaugaggucugugcauuguguuuguguguggcugcagaggccagacgagggaguggagcagagcucuaggaacccgaguuacagacacuugugagcucccugcagugcuggggacuccaagcugggacugcugggagagcagcagugcuccuagccacugagccaucucuccugccccauagucuuuuuuuuuuaaucagaagccauuuaggggcggugaagcauguggccagggauguggccgaguugagagcaguccuugccugggaguccugguguguucauggugaugcagugaggaggugcaaacaaggaagagcacgaguuugaggccagccugggcuacaugaggccuugacucaaauaaaaaguguucaagccuuaaaauaagaguucauauccccagcuccccgguucccaggaguuaguggugaucucuuugucacaggaucucacuguagcccagguuagcuuaaacucaagacuguucuuccugccuuggcucucucugcugggguuacgugugugaggcgcagugccuggcucaggaaccgguuuugauucugguuguuccucgguguuagggauuacuuuuuguaaguuuuuuucuaaucuuccuguuaucugaaauuuugcuucuaaaagcauucuuuagugugaagaaauuucuggggaaucuguuguuagauccuuaugggaaaaagaaauuuccauuuuuuguugcaaaggacacauuggcaacuaagaagauuugccuuaaagugucugacuugcugccuuuuuugagaugagaucugucaguguagcaugacacuguggggaccucuguccucagccaccuucccagucgcugaggugggagcucacugcuacccaugcagauugaagagcugcggugccucuagguggucacuguuauagcauggacagugaagauucagguugcugucacauacagugggacagcucagcugugagggcagagugaggggacuucaucguccuggccugcugugcagcucccgccuaccgguugauuggucaguucccuccuggaaccauucugacccugacucauggcacaugcuccuucgugaguuguugaagcauccaaguugaggaccuugcagcuugcuguuuaggacaugacuuugauuuucugugcucuaauuuuguccauuuuuggagcaguugccagauuaauuugcucauguggccuuuuuuuuacuaggauauuucuucuucuaggaucuuaguaauauugguccugcuuaugacaaccagaaacaaagcagugcugugucugcuagugggaaccuaaaugguauguguuuaaguaucuugucagaagcuuugugaaugaugaaagccuugccugcaauguggugcucuguaggaggagccaaaccuggguaauuacuaaaguguuuuuaaauugacaugcauacuguagcagcucacuaaauacuugggaaaugauaauggaagagagcuuuug

SEQ ID NO: 4367 - RNA, 6260 nt, Mus musculus
uaacaauaaccauauuuuaagccuuaauuuuuuuuauuucagcaugaguuauuuaaucaaaacaaaucuuaaaauauaguugcucuuuacguuuaaucuucauuuuuuucagaucuuaaguuucagaucuuacgaauguuguacuuaugucuaauuugggaauguggcacuugccuaaguuucuacaauccauguuccguauaaaccaagcuaguccauauccacuugauuuaaaaacaugauuugaccacacagugaaagggaaauguuuagcaucuuuuuugcuaagguggagucacauagcugccccauguagaacuuguguccucuugcaagagcagccagcuaagccaucuguccaguuccaaggauuugggauuuuuauccucauauaauaaaggaauuuuuuuuucuauagauaacugucaacuugauucagcuuuguguuuaacagugaaaccuaugugacaucuagggucaucccagaacuugggagccugaggcuggaaaaaugcaaguuggaagcuagccugggcuaugcaaugagaccuuguuucagcacuuaggagacagaggcaggagaucucucugaguucaaggcuagccuggucuacacagggagacccugucucaacaaaauaaaauaacaacaaaaaaagagugugcaaacaaaacaggaugggaagugaggccuuuuaccuaggauaaucaagacccuacgcccagucaguaguaccgaggaaguaguaccagucaguaguacugaggaaguaguaccagucaguaguacugaggaaguaguaccagucaguaguaccgaggaaguaguaccagucaguaguacugaggaaggagcggugaaugaaugaauacaucaaugagugaaugaaagaaugaagugggauaucugaaucuauaacaauuauuaaaucauuuucucuucuccuuuucaugacuuaaagggcuuuuuuuuuuuacccuuguuaaaauacaguccugucacaauuaaaauuguuuguuuguuugauaauugguuugauuuggguuuuuguuuguuaguuuguuucuuguccacccaauuuuauuauuuagaaagaaguuucagagcuuacuuuuuuaaacugauuugaauauccuauuguuuugaaaagaggaaggcuauucucaaugcauucaaugcaucuaacacaauauuuuacuuuuuuauaaugcauauuuaagugauugauguuuuucauugaguguccaauuuuaacacaauaaugauuuaacuuuuuuaaugaauacagcucucaaaagucuauaagauaauuugucagucacuaacuugcuuacuauacacagccaauuucuaacccucuuggucacuucaccucgucagccuugugguuaggguccuguguauaaaauaaaagacaacacaaauguaauaccauuucuugcuuguaagucauuaaucaugucaugggauguguguacugaugguuuuuaaaaacaccuuuucgguucaauuuauauuauuaugaauaggauaccauacauuuuauauuuaaugguuuuuaaauaugaauauauguggauucuuuaauuacacuaaaguaauagagggacauugguuugagaaaugagaggccuaaaccuaauuauggauuguauaugaaguuugggaauuauguggaaauccauaaauauauaugaauuauauauuuauguuauauaaaucuugcauauguauguauauauauauauauguauguauguauuugugugcacauauauauguauguauacuuagaacuagacauuaccaagauugcuuuacaugucucauuucaguauuuuucaauuuucuuacagauuuaguaauguccuguaagguuaacucugaauguaguauguaagugagaauagaaauaaaagaaaguaaucgauggcuauuaaggcaaauccauuuuagagaggagaguggauagugggauaaaagguagccuaauuaacgaauauuuaggccaagagaaguauucaaacaguaucauaguagcugucccuuaaucuuagucaacaaaauagucuauaauauuguuauuacacauuuaucugauaaaagaugaaagaccaaaacuaauuucuaauuguguuuaggugaguauuaacuaaccauauaaucuauauguuagugggagggaaaacauuucuuuucuuuuuauaacuauuaagcaguuacuacuuagucuaacaguugaggaauuugggauguuaaacuuugauuugaugaggugagaagaaauuuaugauggcugaaauuaucaccaacuuaccaacagauaucuauaucauacuuuuuauaguuugcaaacuguuguuuuaauauuauuccccccuaauaauauguuauaccuccauaaaauaucuguaaaugaagacaaaaguggacuuuaaaaaguaagccuuuacguguuugauucaguccacugcuacaggcucacaagcagguguuuaugucugaaauuggagguacccauuaucugaaaauuccucucccauaagguaggaauuauucaaacccaaauuauaucuauuucaaaugugaaagaauuaaaugccgugagaagaacaagcgagugaguaaaagacaauccccaggcaugcagagggcacugcccauacccgcagaugucuggucagacucacugcgagagcucugagcugacggcaaacuggaaagagcccauguucuuccugugcuugcaagccuccucggggaccacugugaguccuuguguagucuguuucauuaggauggcaucuuacuguuaucucccacccucuccugcauagguuguuuaucccucucuacaaaggcucuagcacguuacugggacuggauagugcuccauuucugcuguacgugcuguuuccuguuggcaccucagucucaggauucagagucuggaaacacgcuuauaacugggaagucuauuuuauaacaaugcugugaagccagcuuuugggguuugugcuaggaauugaagcuagggccucgugcacuccagggcaagugcucuacucacuaaacacuuuucuguugaaugagauuuuucuuacccuuuaaggugcugucuccuaaaauaaaaaccucgagacugucccuacuuguugcucacacacacacacacuauugcaaaucccaaagagagaaggaaacaagauauuccaguaauuaagcaaucagaucggcuaaaaacggaggaaaggugauuucaaaaggaaaucgguagaggugccagguauugcagaaauaguugcuauacugagauuuguuuucgguuuuuaccuuggcuuuuuucuuaacuuuaacuugcaaagguuucaucuuguacugguagugaguuuuuuagacccagaauuuuuccauuugcaacaugaaaguagcagucauguuagagaccacacgcacuggcgcuuguuucacgcaugaugacugccagagaauggggaaacuggcucauaaaaacacuuaauguugguuuugcuuuguuuuaaaaagauaugcauguuuuaguacuguaaaaaguugguguguuuugggccaaggaaccuagcuccaguagcagaauauguggcuaaauugcacaagacuaccuggcuccaguccagagucaaucaaucaaagucugucggcuggcaagcacacccugcccuccccccucauacucacauucacacauacucacacacacacacacucacacacacugaugaaguuuacuucugagucagucacauagaaggaagcagcguugaaguagagacguccacauucagcuuuaaggaaauagagaccuuguucuccuuuccagaacuaaaacuuagaaagccaggaugguggcacacacccauaaucccagcagcaggcucaggcaccaggaucacaagugugaagucagaugaggcaacagaaaaugcaaauccagccugucucaaaacugaagcaaaagugcaggaguacaaaaccacagaccguguuuuaagcauggucucuguaaauguuccuagcuauccuaacuucgagcuucuuuuuaaucuacucagaguggguucuaggccaagucuguaccuccugccauguguaauagccugugauucuagcacuugaaaggcugggguaagaggcuuucuacaaggcgaggccauucagggcugcauggugaaauuccaucuccacuugauacucuaaucauuucucaguuguucaguguucaggcguggccagugggcagcauggauguaggccauuccuucagugcagaaaacugugccagaaaaggaaagaaaauacaggucagcucacuagaaguugcuaaagggauuaacaggugaaaaguauuucuuauaaaaguuuuauaccaauauuuuggccuugggaaaagaaaugaaagccucauauugugacuuuuuuaguauacucuucccaacaaauuaucaaugaguuaucaauugauauaauuaaaucauuuuauaaauuauuucauaauauuuucacucauuucuuccuuucauauuuuuaaauugacauuaguugucauccaggagaaacugauaauaaauauuuaacuuauacucaaauaaaaguuaguuagcaucauagcccuauauuauuuaaaucuauuuauaucuuaugaaagucaccguuucugcccuauaagcuguacauucaugauuggcugucuucuacuucaaaaguacagucagggccaagucguuagguuacucggcccccagcucguaccugcuucaguggugaaucagccaaccuuuucugaaugaagcagacauuugcuguuacagaauaugauuaacuaugaaaguauuagaaaugugaacugaguuuccuucacuauacuaaaguacuucauuuaauuuaaaggauuaugcugaacguuuucaaaucaaacuaagggacgucuuuuaaaagugucugacucuguuaguuuuguuuuguuuuuugcuuuucuggaguuuugcaguauuggagauccaaccuaaggccuugcauacuagaauacuuuagugaucauauuuuuuuuuuauuuggaggcaucucucuuuuuagccucggcuggcccagaacuuccucagcuccuccugccuccgccuccugaguaccaggguuagagguguagaggugugcucuaccacucucggcuaagacugagcuuagugaagccuuuccugcccaggcgugaucgcacuuucucuuucucgucugcguugaugaucaggcagcagaaucagaacauuauugucaauuuccaaacaagucacggggucguuacuguaacucaguacagaagagcaaaugguaggaguucauucuuuuguuuucucgggagccuaauugaauauguauucuacaaagacucauuagucacggauaauuucaguauguucuaagugacaucuuauuauaaauguagaaaauggcuguacacagaugccaaucagagaccuggcacuuaacuuucauaacaauuuacuuguuuucuuuuuucccauagauuuaguuauuugcaauuaagauguacuaaaauaucauugucauuccuaauuuuggcauuuauggauucuauaauucauaauaauuuguacugugaagaauaacuuccagguuuguugcaguucucucauuguuagguugccagccguuuauaacgucccuccuuuguucuguaagagauucccccucuggcugacaauucagucgagaguucugaggauauauuccucaucaucguaaucuagaaacgauguccacuuugggcucugcauuccucgccucaacucagauuuaacaaaacuguguucaaguauuucccuccugcuuacaaaaguuugcccgucuugagucuggugaguuuccccacuguuuugcugaggaaaaugacuuguuagagacuucaguuaaaaauguaaguaaagucacaaaaacgaacuugugagaaaccaucagaagguaggguuuuuugcuuguuuguuuguuuguuuuaauccuacauuuccuuuugguuuauuuugauuuuaugacugccaacuuguuauauaugaguguuuauauaugcauauaauauauguauaugaaaaagugaagauuuggucaaacuauauuuucccauucaaguacaaaaaauguuuucaaggcugcaaaaaguguacaguuguuaaacaaguuguaaauaaagacuuguauaaaaauccaguau

SEQ ID NO: 4368 - RNA, 8846 nt, Mus musculus
aaauucacaaaauuaagucuuaauuuuuccaaaggaagauuuguacuuaauuucuggaaugaaaaggauuucauaaauuuuaagccauaauaaguggaauuaauuuuccuaauaaauuaugcuucgcuauucauuguaguaaaaauuauuuaugcauggugauaguuauuuuuguagaauauuccauguuuucaccaaucgcuauuuuucuucuaauauuucagggaaugacucuacauaaaaaggcggcugaagacagacuagcuagcacagguucagggcagucauuucuggcuaggcaaagacaagcaaccagcacaagaagauccuacccaggccauguccagccagccacagcaagguagaaaggucuugccacuaggaauuuuuaaaaagcauacuucuguuacauauaacaacauuucaggaaauucagccagcuuguuuucuuucucuccuguguuaauauuuaguguuucucaugaggauuccucucucuccuaucuuugguuacuuuguccuuuacuuuguggucuuuucaguuccuuuuaaugugccaaaaauuuguaaauguacaauuaaaaguguuguauaauaguguaauacuuuuucuuuguaugaaaaugucuucuuccccauuugugugggcuuuguaaagaaucggguuuucugccaauaauugauacacaauuuauauucuuuaucgugccuacuguguuaccauacuuuauaagaaugucuuuguuuaaagggaauuaaucuuuuuaugguguauuaaucuguguuuucgauuguuuuccaaaugcacuucagauaacuuaaauauuuacuguacuauacaaaguggugucaaaugcacuuuuugcaaagacgacuacauuggcagaggugcuagucagaccuguggcaccuggcaggaucacucagaggggagaaauuaaacguauucuaagguuugaaguucuuauaugaaauuucauucuuuccugcuguauuguuugcuggcagaagugaaauuggugaagauauuuggguggaaauuacagagaagaagaacuuggcaggauuuuuuuuccuuccuuuggaauaucuuaguagcuaagaaccagauucuagccaugcacuuuuaauugcucuccacauguaaaagauuuauuuucauauagguagccuuaucuuuggggcaguucuuugacuaugccucauauguuuuauauauucugugagacuuuccuuuucuuaguuagccuugauagcuagcaucuuaaugcgauuuguuaacaucagcacauggcucgguguguaauguuauaacagagcucuauaguuucucuucgcucuaccuacagcuccaagaauugguaacaggagagauuuucuugguauuugguuguucaaagugcuuacauuauaugccacauuuauuuacauagaugaaugucuauuaagcaaucaugugaaguacuuugucuauauaaggaaugauauaauuuuaaacuaucauuuauuugaaaauaaucuaccuuugucuuuuucuauauugauuugugaauuugaucccaaauuauauugaagguuuccuccagccuuuuucuuguuucauaccauauuuuuugaaagaaaaaauaugaaauuaagucagaggguucuuuaguuuguuuuuacauaaaucaucuuaaguggaagauguuauuuauggacuugguguuuggaaguucuggugucauuuaguucuguauaaaagacaaauaacuaacucaacuuuacugugaugaagaauuuucagaaaccauauucaagugcuucauuuuaacucccuccuguuuuauaggaaaauugaccuagaaauucguccugcauguuuugucuugguuuuguagacggagucuuuauguaacccaggcugccaugaacacauggucuucuuggauuauacgcaugaaucguaggauuuuuuuuuccuugaaaggacacuauucaucaugaagcauuuauuuaaaaacaaacaaacaaacaaaaaaaccucacaaaaacaaaaacaacccuuccaacaaauguucaagcaggcugugaggcauccgccugggcagaccaaagcagcaggcacaggaaauaguggagagcacuacagugggacagagagcagcaggcacaggagauaguggagagcgcuauggugggacagugcucugugggauuucagguacacacaccugacacucgaggucugcuuuuuuuguuguuauuguuuuaagacaaucuagggauauuauccagaccuuccucaacuucuuugacucaagacuauucuccugccucugccucccaagaggcugagauuaagguaugugccaccauguccacaggguagauugaguuugaaaauaaaagaacaaaaacuggggccagcacaauggcucagcaggaagcguagcacuugccugggcucacuuccuggggccuaggugacaggggacagcaacucccaaggguuguccucuggucuccacacucaacagaugccagugcacacacaaauaaguaugcuugaaagguuuuaaauaguucucacucuaccuuuagcucacagaauaucugagauucaaccacuuguaaaucaaauuagucuaugguuccuacuccuuacaagauuguugguuguugagaaauuauaccuggagaauaaagugaaugugaauacaagagacgcuugaagcuacccuucaguagaucuuacccugagggaaaacagcucacuguuuugauuuuuauuuucuauucaccugcccgcucuauagacauacccaccuacccagauauuuuauguagauguuuuggaaaggccucaagcuuucagaaggaaguuuagcuucugcuuuuuguuuuguuuuguuuucagcaucuguuuugugcuaauuucagugucuguagccucugcuguuguuugcucugucuuuaauguuugguggauuuccuucaguaaaugggagaaauaucgcucaugauauuucagaauaaaauaaaacaugcuuucauaagaaauagcauccgucuauacuuuagacgucauaaagccaggaauacaacuuaccugugccaguggcaccuuucccacuguguggcuuaggucaggauuuaggggacuucaguuucucccguggagaucagggaaguugcaggugcucugguggugugugguaagccuccugugcuugccccauggaucuuguccuggcauuagcaagggaugaggacacugucacugugucagguagggaggaccugucaccagcaucugaguucuuauaauaagcuuauuuucugugccuucuaaccaggguuuaccaagaaaaaagaaaaaacuaaagcagacuacuaaaaaaaugaccauuuuuguucuacaguauuauuaaucuuauuaggauuaauaagaaaacaauccaguaaauguaaucauuucuugcaucugaaaugaagauaacuaauacacuuauauuaaauauuuaaaaauauuuuuuaaaaaaacucugccuggagcguuggcucagcauuuaagagcauuuauuguauaacacaggugcaguuccugauguggaagcuuauaaccagccaucucuaacuccaguuucagggaaucuuccaaugccaucuucugaccuccaugggcaccagguacacaugugccauacagacauacaugcaggcaggcaaaacacucauucuuauaaaacaagucuauaaaaagaaaguuuaagcugggucauaauuuucuuuugucuaauuacuuaacaguaauaaaaaugaguucugagucccuaaauaaaugauccauauuccaaaguuaaucaagauugaauuauuucuguuaacuugguaaaaaucagcugaaugcagugacuaaguuauaaugaggauaacauggcccgauuuucaugcagcuguuugguuaauguaacuagggcucagcugcacaaaggcaagcuagcuugucagugaggaccucgaguccugcuuucacugucguuagagauccacacuguacaagaacaugcaaauguggggguccaguugggacaaggcaggugaagucagaugcccucuguggaaaauguuauuuaccuuuucaggagcagucucaggcuugugagguaaaagugaaaauauuugugagggcuaggaugcagcucagcugguauaauaauacuugccuaauauacgugaaguacuagauucaaccccuagcgucauaugaacuggguauauaugucuguagagagucuggaauccguuugucuauaugagauucugucuucaaaaaaauaaauaaacgugugugugagugugugugacaguguguguguguaugugugugugugagagagagagagagaacaugugugugugucugugugugugcaugugugucugugugugugcgcaugugugagugugugugugagagagcaugugugugugagugugugucuguguguguguguaugugugcgugugugucuguguguaaaauucuuuuguagacgcuucugcuuucacauaagcauugaucuauuguucuaacaauaaccauauuuuaagccuuaauuuuuuuuauuucagcaugaguuauuuaaucaaaacaaaucuuaaaauauaguugcucuuuacguuuaaucuucauuuuuuucagaucuuaaguuucagaucuuacgaauguuguacuuaugucuaauuugggaauguggcacuugccuaaguuucuacaauccauguuccguauaaaccaagcuaguccauauccacuugauuuaaaaacaugauuugaccacacagugaaagggaaauguuuagcaucuuuuuugcuaagguggagucacauagcugccccauguagaacuuguguccucuugcaagagcagccagcuaagccaucuguccaguuccaaggauuugggauuuuuauccucauauaauaaaggaauuuuuuuuucuauagauaacugucaacuugauucagcuuuguguuuaacagugaaaccuaugugacaucuagggucaucccagaacuugggagccugaggcuggaaaaaugcaaguuggaagcuagccugggcuaugcaaugagaccuuguuucagcacuuaggagacagaggcaggagaucucucugaguucaaggcuagccuggucuacacagggagacccugucucaacaaaauaaaauaacaacaaaaaaagagugugcaaacaaaacaggaugggaagugaggccuuuuaccuaggauaaucaagacccuacgcccagucaguaguaccgaggaaguaguaccagucaguaguacugaggaaguaguaccagucaguaguacugaggaaguaguaccagucaguaguaccgaggaaguaguaccagucaguaguacugaggaaggagcggugaaugaaugaauacaucaaugagugaaugaaagaaugaagugggauaucugaaucuauaacaauuauuaaaucauuuucucuucuccuuuucaugacuuaaagggcuuuuuuuuuuuacccuuguuaaaauacaguccugucacaauuaaaauuguuuguuuguuugauaauugguuugauuuggguuuuuguuuguuaguuuguuucuuguccacccaauuuuauuauuuagaaagaaguuucagagcuuacuuuuuuaaacugauuugaauauccuauuguuuugaaaagaggaaggcuauucucaaugcauucaaugcaucuaacacaauauuuuacuuuuuuauaaugcauauuuaagugauugauguuuuucauugaguguccaauuuuaacacaauaaugauuuaacuuuuuuaaugaauacagcucucaaaagucuauaagauaauuugucagucacuaacuugcuuacuauacacagccaauuucuaacccucuuggucacuucaccucgucagccuugugguuaggguccuguguauaaaauaaaagacaacacaaauguaauaccauuucuugcuuguaagucauuaaucaugucaugggauguguguacugaugguuuuuaaaaacaccuuuucgguucaauuuauauuauuaugaauaggauaccauacauuuuauauuuaaugguuuuuaaauaugaauauauguggauucuuuaauuacacuaaaguaauagagggacauugguuugagaaaugagaggccuaaaccuaauuauggauuguauaugaaguuugggaauuauguggaaauccauaaauauauaugaauuauauauuuauguuauauaaaucuugcauauguauguauauauauauauauguauguauguauuugugugcacauauauauguauguauacuuagaacuagacauuaccaagauugcuuuacaugucucauuucaguauuuuucaauuuucuuacagauuuaguaauguccuguaagguuaacucugaauguaguauguaagugagaauagaaauaaaagaaaguaaucgauggcuauuaaggcaaauccauuuuagagaggagaguggauagugggauaaaagguagccuaauuaacgaauauuuaggccaagagaaguauucaaacaguaucauaguagcugucccuuaaucuuagucaacaaaauagucuauaauauuguuauuacacauuuaucugauaaaagaugaaagaccaaaacuaauuucuaauuguguuuaggugaguauuaacuaaccauauaaucuauauguuagugggagggaaaacauuucuuuucuuuuuauaacuauuaagcaguuacuacuuagucuaacaguugaggaauuugggauguuaaacuuugauuugaugaggugagaagaaauuuaugauggcugaaauuaucaccaacuuaccaacagauaucuauaucauacuuuuuauaguuugcaaacuguuguuuuaauauuauuccccccuaauaauauguuauaccuccauaaaauaucuguaaaugaagacaaaaguggacuuuaaaaaguaagccuuuacguguuugauucaguccacugcuacaggcucacaagcagguguuuaugucugaaauuggagguacccauuaucugaaaauuccucucccauaagguaggaauuauucaaacccaaauuauaucuauuucaaaugugaaagaauuaaaugccgugagaagaacaagcgagugaguaaaagacaauccccaggcaugcagagggcacugcccauacccgcagaugucuggucagacucacugcgagagcucugagcugacggcaaacuggaaagagcccauguucuuccugugcuugcaagccuccucggggaccacugugaguccuuguguagucuguuucauuaggauggcaucuuacuguuaucucccacccucuccugcauagguuguuuaucccucucuacaaaggcucuagcacguuacugggacuggauagugcuccauuucugcuguacgugcuguuuccuguuggcaccucagucucaggauucagagucuggaaacacgcuuauaacugggaagucuauuuuauaacaaugcugugaagccagcuuuugggguuugugcuaggaauugaagcuagggccucgugcacuccagggcaagugcucuacucacuaaacacuuuucuguugaaugagauuuuucuuacccuuuaaggugcugucuccuaaaauaaaaaccucgagacugucccuacuuguugcucacacacacacacacuauugcaaaucccaaagagagaaggaaacaagauauuccaguaauuaagcaaucagaucggcuaaaaacggaggaaaggugauuucaaaaggaaaucgguagaggugccagguauugcagaaauaguugcuauacugagauuuguuuucgguuuuuaccuuggcuuuuuucuuaacuuuaacuugcaaagguuucaucuuguacugguagugaguuuuuuagacccagaauuuuuccauuugcaacaugaaaguagcagucauguuagagaccacacgcacuggcgcuuguuucacgcaugaugacugccagagaauggggaaacuggcucauaaaaacacuuaauguugguuuugcuuuguuuuaaaaagauaugcauguuuuaguacuguaaaaaguugguguguuuugggccaaggaaccuagcuccaguagcagaauauguggcuaaauugcacaagacuaccuggcuccaguccagagucaaucaaucaaagucugucggcuggcaagcacacccugcccuccccccucauacucacauucacacauacucacacacacacacacucacacacacugaugaaguuuacuucugagucagucacauagaaggaagcagcguugaaguagagacguccacauucagcuuuaaggaaauagagaccuuguucuccuuuccagaacuaaaacuuagaaagccaggaugguggcacacacccauaaucccagcagcaggcucaggcaccaggaucacaagugugaagucagaugaggcaacagaaaaugcaaauccagccugucucaaaacugaagcaaaagugcaggaguacaaaaccacagaccguguuuuaagcauggucucuguaaauguuccuagcuauccuaacuucgagcuucuuuuuaaucuacucagaguggguucuaggccaagucuguaccuccugccauguguaauagccugugauucuagcacuugaaaggcugggguaagaggcuuucuacaaggcgaggccauucagggcugcauggugaaauuccaucuccacuugauacucuaaucauuucucaguuguucaguguucaggcguggcc

SEQ ID NO: 4369 - RNA, 9831 nt, Mus musculus
ugucagccauuaacugugcagggagucccagcuugagccuuagccuggcuuagacaugucugagcaagccugaagaacugcaauguggaccugcuagcaaccuaugugugccugagacaguagagccuccugggaaggaugaaagaaucaggcacaaccuagguaacuagauguugcuuguaucaggaaagaagcgacugaacacuguuuggugaguggccacaacugcauucauccauaacucagcccccacuggacuucuuaggagauguggggaaugaauaugauguguauaggagggggggggggugggaauggggaagaaaggaaggagggaggggggagggaaagauuaugguuuaagcaauacauuguagucacugggaaaugaacucaggacuguuuuguuuuuuuguuucuuuguuugagaauuauuuauuauguauacagcauucugccugcauguaugccugcagaccagaagagggcacuagaucucauuauagaugguugugaaccaccaugugguugcugggaauugaacccaggaccucuggaagagcagacagugcucuuaaccucugagccaucucuccagcccaaggacuugucuugagaauuaaccauaguagagagagguccugcccucaacuuuuuuuuaacaguaauuuaaaguuuauuccagcuauaauguaggugauucugacuucaagguagcaucacauggcauacuucugaguccauucccgauauauucuguuguacuuaucucugucuguuuuauagauccaugcaaucucuggcacuagggggucaucuggguuuggaucacauagcagugaacaaauggauaaaagaacauuagaaacaauuuaagcaggagaccacugugaucuuagaauaucaagacaaaugcugccauuacuguuaauauuuggaugauaaauuuuaguuguaaacgcaaccuuaggugguuugaagggguagucuguagggaaaugaauugucaaaaagaauaaaccaccuugauaugggcugucauuaggucccauaauuguggcuugccaaugaaacaugucaucuccaacuggaccugcagaacauugugcuggagggucaugggccaaaucacuaaguuccuuauuaauucguuucagcgccauagucugugcuuuucgccaggcuccucacuaucccgagguguacucaaagguccggccaaaacucuugauuaucccgacaguggggaaggguugucucuucuucucacaccagcucugccaaacacaggcaccgagggccgaggccucccucgagcugcggccuuggccuccuccccaugcagcaguuggugccucccuggcccuacagggcucaugcacacagcacccugcccucaacuuuuauggcagagccuaagcuucuaaggccuucagcaccuauaguugcaaggacuuuagcacucagcaagagguggcuguuuccaggguccuagaaagaaaccuuaagcaaaccaaggggcagggggaauggucaguaaauagauuuuugcagcucuugggucucaucagaggcaucugucacauuccuuccacaagggcucagggaauaucuuggaagauggugcagaaagauuguaaaagcuagaagacugcugugcucaagaacccacauccacggcuagcacaagaguugcacaagaucaagcuagucaacauucuagcauagaggggcucaugagucccuaccccuagcugaggagcuauuuaacaguuaguugaugacuggcaggggagaaagacuuaguuucuuuaaggguguacuaccugguagaucaaccauaguccaguguauggacccacacccauggauauauggauucuguagaauauugaggaagaagaaagaggaggaggggggagaaaggaggaggaggaggaauuggggauuggguggcagaaguauagauugggucugggagaaguuaggagaaggagaagaggauggauauggucauaauauaugguauacauguauaaaaccacuaaagaaugaauaaaagauuuuuuaaaauggaaaaugugaugauuuguauaaacuuggcccagagaguggcacuauuagaagguguggauuuguuggaguaggugugucacuguggugugggcuauaaggcccucauccuagcugccuggaagccaguauucugcuagcagccuucagaugaagauauaaaacucucagcuccuccuguaccaugccugccuggaugcuaccguguuccugccuugaugauaauggacugaaccucugaaccuguacgcuagccucagugaaauguuguccuaauaagaguugccuuggucauggugucuguucauagcaguaaauccauaagacagcagauuaccaggaaacugucuguaugcuuugagcauauugggagauauccccaauaucuagaaauauuggggauacuuuaaccccaagugagucgugaaaguuaagucaucaucacucaugggauaggauguucauagaucaaggcccaggaggaccaccaugcuggaggauuccuggaagcuacagcucugaguccacaccaaucuugcuacuuucuuuggaauaaauccauacuaagaagccaauacagauugcuagagagguucauaagcaauccaagaaugagucuagucuaacauuguuuuauagacuagaugcacagcaggcuaaaagccgcuugaaguagcauguccaaacucuauauucaguuuucagaagagcaggaacuuuguuuaaggggcagucaagcuuucccuucugauaugaccuuuacucaucccugucuuggaugcugaauccacuaccuucuuguacacauaugguagagcauugaaucaucugccaguuuaggacauuaggcuguaacucuucuaggaggagacagacagacaugguuuuaggcaguuucaugugugccucagcuguaguguggucuguuuccugaggucggugauuaggaauguucugggggaaaaagcauguccucugagaggaauauagacuaugcugggcucagugagaaaggaaccaauggaguaccagccuuguggugcaugcugggaauccccacacaauggaggcagaaacaggaggauggugaguuacuaggcuagccugggcugcauaguugaauguuucuaaaaaauaaaacccaaacuaaccccaaaacaaaaaauaaaucccaaaugagagagagagagagagagagagagagagagagagagaguucuuuaguuacuuuaaaacaaguagaauaauuguccacacagggaauguagugcacagaugaaagaucccuaggaaaaacagagcaggauaacuccucuugguaauggugucccuagaaggaagacugggaggagccuacacagccagugaagucacuuugaugucagacaucauaugaagagugacacuuucaugaauaucuuauuuuggcugggacggucccaacacugguggccuacagauagaaauuucauaaguaagcccaccucuaauccagaauguaccagcagggaccaggccagcauaaacacuuggcaucuuacccauggccaguugacucuuuguaucugcagaagacugcucagugggaagccgagccuggaucugaggcagaagcaagcguugaguuacugauuaucaguucacagaagagaaauaaaucaggagguaugagcacuggcuggcagaauaaugauccucuagacauggcucuaucuuagucuggaaccugcaagcagggccugauauaugugaggauauauuaugagggucaaggaugcagauagggauccaacuguugaucaguuguccuugagaugaaagugugugcccugaauauccaugggcccaauguaaucacaggaguccuuggaaguaaauaaggcaaaccagggacccagaaucaguggcguuguaaaagaaagaguugacuaguuuaaauaaaaauggcucccauaaacuuauagggagugauguuauugaugguguggucuuguuggaguaggugugcccuuguugggguggguguggccuuguuggaguagguguggccuuacuggaggaagugugucacagcggguaggcuuugaaguuucagaagcucaagccagguccaguguuguucucucuuccuguucaucuagauguagaacucggcucuuucuccagcaccuugucugccugagugccaccaggcuuccuaccauaaugauaauagacuagacaucugaaacugcaagaaagccucaguuaaacucuuuccauauaagaguagccauggucauggguucucuuuacagcaauagaaacccaaacuaagacagaugacuauuggauuugaagauggaggagcugugagccaaggaacaagaaugucccuucuaagcuggaagggacauuccaguuccuccucugagcauccgcagaggacuaugcuuugcucaugacuuaauuguugucccccauaaccauuucagaccuguggccauugcaagauaaagacacugcuuuaagucacucuauuugugguguucugucacagcgacaguaggagacucauucagaccccuacuguucuccuguggugcgucaaggaacauuuaccuguguuuaaccuaaggauuuuauccaccugagcacaggucuuuuuuaaagcaggaaggacagaaucaauaaggucacuaagaccuccggccaauuucccuuaacaaagagcuaucaaagggccgucagcaggacaucuuuagaauacaaggacacaggguuugugauuuacuuacaaaguuacaguagguagaaaagggacugugucccacagcagauuuggagcuggacugugacguauuggcaguuggcauuugcuguccugccaugcaacguauccuuggggacagaggguuagccugggacuacccuagguggccuuuggcuaucuuauccaugacuugaaugauacaugaucucaggagaucgcuuugauuaucuguuguuuuaagggugcagaaaugacuccgagagaaaaaccacugugaaggucucuuccucaccaucuugcuccuccuacugccccacccuucuccugcuccuuguucuugagauaagcucucauuauguugcccagcuggccuagaacuuauugcauaagucgggcugucaugggaagaaaugccccugccccaggcucccagguagguguacuaccugggacauauaaaaaccaagcaguuuugucccauguccucauguauuccccacaacaguuccaugagacaguuaugccaggugggaacccaucuuguggaggaggacguagagaauuggagaagcuaagccuauuucuaaaucauuccauuagcugucugaagagccgcaagucaaaucugaugucagaaguccccguguuaacucaugacaccuccugagugacagcuccugggugauacucuuggacuuuuugugaacacggagcaauaagaauaauaguuuuaugcacaaauaugugcaauuuugagucuuacccuggcuuggcuaaaaaaaccagucaugugaucuuggguuaagucauuuccuccuuggggcuucaaguuucuagucgccgauugggaaaaugggguuagacucguuauuuuuaagaauagaagaaaguuuauugaguggucacaaaacagucucccacacuguagucucugccuccccacauucucuucuuggccauacauucuucaccccaucucuugccugcucuugagaaccccuuugcucgauguuuggacuuuuucuuuguuaaagggucacuguagucucucucucucucucucucucucucucucucucucucucuauauauauauauauauauauauauauacauacacauacauauacauacacacacacacacauacacacacacacacacacacacauauauaucugcaagagaggagacaagacaguuuuucuguguugcucacaucccuucugggaacccuaccuccauuuccuuugccaggaguauucaucuugcaaucccuagacaaccuggcucuugugucuucaagacagaaggcagguggcucuccgguuggagcaccaucucucagugagugugacagugguuccauuuuauuucugacacguguugugacacaagagugaucccgacuucagaggucauuacuucucucuucuuuucccccaucuuucuuuucuuccuucaagauaauaaaauuaccagacaagccugucccuccugacccagucuggcuucauagauauuuucuuuuugggcaaauggcucuaaucucccuguccagacuuugucacacaucuaagugaguucaauucuccuccgggucaaaccccuacaugcugugguuuuccuuugagugugaaccuuuugguaucuuuugauaugaaauggccacucuuggccacuggauaugacuggacaaaagaugaagagauuucacuuugagcagaugggaaaaagaaggaucucguucagaacagcuuugggugggacaaauauacacgggaaagaauaagaaggaagaaggaagguccgaugcugguuuuccagguccugagaacuagaggcucacacuagcccuugguagccagucaggaacauaaaggucacagucagauuagccccaugccaugcccuucaggucuccagaaaacaagaacaaugugggaccaaaggcuaacucacacuuggcucuaguguuuagauucugggguggaggagaaccacaaaugacuagauguugggagauuuggugauguuugaaagggagacaucggaauggagauuggagagugauugagugugugugugugugugugugugugugugugugugugugcacacuugugugcauguguacaugcaugugcugugugauagugauuuuguccauggagguggcagagcuauagucuaagugugggaauaaacagaaacaaagguggacacacaggaacaagccugguguggaucuccucuaguccagaccauguggaacuucaagaacuccaagcccagagaaacugugggugcucugcaagagcugcagccaggcucagaagugcugcuuguuucuauguauauacgcugugcguuggcuuuucuuucuugucgaccuuccagucacuccuaaauucgguuccguucucugccucucccugccugccagugcucugugcucccagccaagcagugacauuuccccgagcacagacugugccauuugagagccccagauagacuucauuucagggguuugacuccucccgucuccuacagugccuaugagugugugugugugugugugugugugugugugugugugugugugugucuugaaucccuaauacaaagaaaaagaagagucacuccucuccagggucuaggcuugauaaguaauucacagagcccaacaaacaacaaauagccccacugucccauggaggcuaaaccuggauggaggcagggucaucagccuauugaauuauucugucugaaagccccaacccucuuuugagggugcugggggcaagaggaggcuuaucccacucacuguucugcuuggagacagauggcuccaggccuccuuuccaaguguguucgcccuucucuugguccagcgggccugggagaugguuuugcucacucucuggcuuucuuauucuaccccucaggcauaggaaggcguuacucagucccagcuaagcuugguacuuguucccaagggccagauugcacucugccagcugcaagaagggccuccaggccugugucuggcugugcuugacacagguccgugaauauguuccuugcagaucccuggugccugucugaccuugcucuuccggagggcucugauguggacccccuuuuuuggguuuccauuuucaugcgugguccuugaaggcgucucuucuuucauuuuguugaaguauagauucaugaagaauauggaaccaagaacaggaugcaggcuuuugagaucaguuaucugaauacuggcccuucucucugucaaaggucuucauuucuccuuccguucaaacuugcuguggacuucauuuuuucagaggagggaugcugaaggcucuuucucccuuugaagcaagugccugacaaacucucaggcuucauuauugccuccuuuuucaacugucccaugacgacugaaaggcucuggauuggauggggcuauaggcauggagagacagccagaggugguguggcuggggacgacgugcucugagcugcagauuagcucccaggugaccauguacauugcacggaggguuuggugggaccgugacaggagacauggcaccagaaagaaguguauccauuuaauuuucuaaucuuauuaacuucuauuagugugauuugcaguucuggggaucccauccagggcuuugcucuugcaaggcaaguguugugcggaugagccagaagcauccaaugacccaccugcuucccuuucuuucuccacgcuguuucuccuggagcuggcucggcuggggggagugggagaaaagaugguacuuugaggagggugccguuccugccaagaaagggaacugucagcaggaugaagccaaaauggggugggcaaccagacucccuucccuugggguagcugaggacgacuuucuuggugguguggcugccaggcuggccuuugagcuccugucuuggucucagagaugcgcucucugaagcaugcugggauccucccacuccacccccuuauuuaaaugcaaccaaagaaacguaauucuuuaaggacuguaaguccccaguacagaaagguuguccacugucaucgagaucaucaagaacugaacggaacagcauuccuuaagcauccgcuguggccaaggcuuuaaacaugcggcuuccaucacagggcugcugcugacaacagcugucauuauagugaugggcauguucauagagugccuuucaugugccaggcaugcucgcauccgagcuccacaauaacccuuuuauuuccaacugacagacuaaggaaaccggcuuaaggagcaugaggaacucgcccaaggccauguaacuaccucagcggcaaggcugggcccuggccuuagcaaccacccugugccucaccuucgucaucgagaaguacugaaguccaaguugccacaggcaaguggugugaaaucagaugcauaugauugcagaggccacagggacucucagaggagccggaagagaggaaggugugcaggggcuuccgaaggagcuacggcuugguauggauuuaggcaggugaagggugccucaggucuuucaggauagauucaguuauaugaaugggugugaggcagcugaggaucagggaagagggcagagaacaaugggcgcacagcuuagugaacuagaggggaggaagaggacacuagcagcuaggcacugguguccccaugcacuauauauauauauauguauauguguguauauauuguaauauauauuaauuuuuuauuuuuauuuuuugcagggccuaggggagaaugaacaaaccagucuaaaucccaguucuucaggauuuuuuucuugcugcuuuaacagaaugccugauguuagauaguuauauaaaauagaaggccauuugucugucagugcugaaguggggaaguccagggguaugccaaugguaaaugugacagucaccucagacucgaaggcaaaaauacaaucaugggcgagaaaau

SEQ ID NO: 4370 - RNA, 4134 nt, Mus musculus
cggugugaauauagccaaguauuccauuuauuaacaaaauagucuuagcaagggagagcucuguucaccccacaagaggccccgcagccgaggccggcccgaagccccagcgcugcugcguaagaccgggagggagggaagguguuggggagaagacuuguauuaagucuuuaauccuagccaccgcaggaacccacggaaaccuaaugccagcuuuggcgauugcuggcucaggucugggacauggcgaagggagugcucugauccuagggcucccugaguccccagccugcccccaacagagcuccuaaaguugucuggucugcugacuugaggacugguaagcuuuggagggauccaucaaggauccccgaccccaccccuaucgccaggggagggggcgggucacagucccaacuagggagagaaaaaauaaaauaguaacgauaaaguacuucacaaaauauaaagagcaauuucgugccagcggggccuucuaagacauuuaauuggaugugucaggucccugucagccggcaauuugacugcaccgcaaggugugggucccugaggggccaggaagguagaagucuuggcaggcucaguuggaggccauugggucacugcugguggcacagggacuucccgaacugagcacccuggagggucaaggcugugauuugauuugggggcucagggccuagaaccaagugcucaugugggaaguggggggagggggguuuguuguguaguaccacacagcccaacagaauucugguucaucagagcucaagaccuccagccaccaaguuguucccccuugaacccccccaaauuguuacauuuuuuuuuuguacaaagggaaaaaaaagaauuaaaacuucacauggaaugaaacaagauggggugggaaggaaaagggaagauaugcaguuuuaacaguuaagacucaugcaagagacuucccaagaugggggaaacugaaaguguaggaccccaacucuuccuucauuccuuaacaccaaaccagucaaaaucaaacaacccaaagccuuaaaacauauacccaagaagaagaaaauaagcaaaagaagggagagggguggggggaaucauggaguuaccugggugguuaauauuauuauuugggggagacagacuuuuugcauaccacugacucauguggucauuaaugcacuuauguucccagcuuguaagcuaacauuauaguaaauaaauacacaguccggugggggaggggcugggcuggauccugguagggguaagcgguaguggagcuugcagcgucgaaggcagugggacgugagaggaagggguggguggggaagggcugggaggggccagagcugugguuacugguauccaagcgcagaggcggaggcuagucucuguccauacagugcguauggcgaguaguaggguccggcugugggaagggacggcacugccaggcccccagcuguagauaaguggcucuugccauaggggugguaucggcuuagccccaaaguguguggacuccgcaaggacagcgacccggggcugccuggggcagcgggcggggggagaugcaggugacaagaggcugcggcugcagcggcugcagcggcacugcccaagcucgacgccccgggguaggcggccagaaguuucucugcgcccggcagggcugugugaguccguagauggcugagcagcuccucagagguggcaaagcgcuugucgcagggcccgcuggccgccacccaauugcagcuguguggcagcgguucguucugcagcaugaagccauagguguagagaggauggcccgggagagcggccugggcggcgcuggaggagagcgccgcagguugcaaggggugccccggguacaccagaggguagccacuggccuuaaggcugggcccggucggaucgugcgcgcugcaaguggaacagcuugagccgccgaggugcgaggcgcugugguagccuccuagacaguaggggucacggcauaaucccugcaggaaggaggguggggaggcccccgugagcgggcuggagcuggggggcuugccugguggcaggcccaggcccccggacagcugaccucccaccaaaccagacuugcuaggauccaggccaggaacgaacugagacggguagccggcguaggcgcccacgauggagccgugguaaccgaugcuggagggcgguagugggaacaccgaguggccugguuuguagggugacacuggagccacguggcccgcccccaccagggcggagggcggcucugacuugcgccccgaugcgguggcuuccgggccaccgugagccgaguccccgccgcuaccucggcucccagcggcuggcucgggacuggguuuggcuuccugcucuuucuuguccaguucgccggccccgccgccgccguucuugcagucugagugguguggugaaccuccgcgggagccgccgggagaagacgaguuugaugagguggagaccgaugccccgugcgggggaaagggagggcaggcggcgcuggggacccugaagcccgccuugucuccgggggacgaggaggacgaagaggugguggaggacaccgacgaggagccgcugucuuugcgggagucgccgccuccggagcccuuagaguagggcuugaagcucgacuuguccuccgcgggggagucccccagcugcuugagcgccgcggccgcggaggcggcgccgggggcggagcggcucgggucuuucucggaucccagcccguuggccgccgccgccgcuacggaguugagcuuggaugagggcggcgggucgggcuugccgaucugcgagcaggucugggcuagcagagccaaaggacucuucuuggcguccagcugcgggagacaguggcaaaggggagggagaagggggugagacugggagacucacuaagcgcgcgcggagaagcugagccgagcacugugggcgagcgaagggagcugagcgaggagggucacggaaggagggccuggcucuggccgaguagcugggcggaaugacacuugccuuguggguuaguccccgagugugacaugggcgcuggcgcgcaggagaaauggcucaaccacagcccucccgguuaaaggugacuucucuguaauccggauggugauucgccccuuuccagauaauuuucccaucuuuuugggccagggaaaaacuuaagccuuuaguuugggagaacuucguuugggacggguuucuggugauggcgcucgguguaagagcagggagaggcgccuucuaaaggcagagccgcaguuggcccugugaguagccccucccucucuccuucccucccuuucucccucccucccggggaggacacccagagaaguaagaugaagaaagacccaggaucccgagugccugguugucugcacugugccccuaaacagacgggggaagaugcagagggacaccggguggaggcgagggaggcccagaagccgucuuuggacaggacucuaaggggccagaggaaaaguaaaggacucugggcaccauaagagcaaauccagucgguuagaaaacacgcagcuccaaagggcgacugggcaaaacccuuccacccaugagucuagggagaaccugggcgggcggggaggggggugucugguuccugccuuccgucccuccucaggagguccgccugcguggccagcuucgggccucgcgucgcuacgggagguggggugggguggggggugguggagggagcagagccaugggcccagcauggguggaggagugggguucaguucugggugggcagcgcccggagacugaccucaauugggcugacggguguggaggacagcgguugcagguacuccgggugcaggaggugaccggugugagcgcucagcaucuucaggacccugauagggagccgguucgccuggcgcaggggguccgccgggggcaggagggacaccacugccggcaccgccggccucuucccgccgccgccgccgcugcugcugccgccgccgcugccgcugcuuucggguguccuuggguuagauccagcgggcgaaucgcucauuuggaggaggcagugccacu

SEQ ID NO: 4371 - RNA, 3152 nt, Mus musculus
gccacaugcucccagcagugagcacaagucaccacauacuccaacuggguucauagaugcaugguuuuucaaggaggggcugugcuaccagcacuaguugcuuccagaccaccgugaugagcugagaagguacuugcuccccugccagaaagcuuuguguucucagaggcucagaauccauggaauggaaaccucccgagaccgugaguccaaacaaagaacucagucuuccuucugaacugaucaucucaggcguuucuguaauggcaacggaaaacuuaugaacacaccugcaaugaugcuauggcagaguucuucagccaccacacuguugggugauuuaggcuggguacuucuuauucuccccucccugcauccugacaaguauggaggaggaagcuaucuaucuugugcagcguaagaugugauuguggcucuggugucuaucccuaggggcccaguagcaagcacucugucucacccaggugugacaacaaacacgucccagguguugccaaauguccaucccucccugucuccucguguauugucacaaaaaugucccaguugagaaacaacgugaugggacuuuaaaagugaggcacuaagaacuggaaggcagucucuugcagguuucccaagugugguguacuguaacgugcuguacugauguggcugugucauaggguugagaaggguugugauguaggcaugcucucacagaaggcauauguuagcuuuccaccacugugauaaaaacaccuuagacauagaacccacaagaguuauggcagggcagugguggcacacgucuuuaaucccagcacaugggaggcagaggcaaguagauuucugaguuugaggccagucuggucuacagagugaguucuaggacaaccagggcuauacagagaaacccugucucaaaaaaacuaaaaaacaagcaaacaaacaaagaagaaggauuauguugguucauggugucagaaguuucagucuaugguugcuaggaugcauugcuuuuggucugguagguacaguauguccuggcgggaugugugguaggaggacaucauuguaccucaugcuggcugggaaggagacagagaggagagaggagaggaagggaccagagcucuaggacccacucuaagaguacuuuucuagugaccuaauucuacaaagccccaugccuuaaagguuuccccauuccccauaaccccacaagcuggugacgggcuuugggguauguugaagauccaaauccacagaguucaugaggaagucuugaagaagauggcuuauugggaggguggguuuguauagaacccacaagaacagaacccagucuacgguagugguucucaacccaugggucuugaccccuggcgggggauaugggguggguaaaccucuaucuccaaaaauauuuacauuacaauucacaacaguagcaaaauuacaguuaugaaguagaagcaaaauaauuuuauaguuggggcuccccauaacaugaggaacuguauaaaggaucucaaacaucagauugagaaucacuggacgaggggaugggcgagauggaacguuagugcaagguaggaacuaacguaucucagccaguccuacugaacaaaauuccaaagagaggaaucacuuguuccugggggaagaucaagcuuggggagaggcugggcuguaaauccugggagggcagacuuuaaugcacuucgaaaucaggccugaaauacccauaauguuugucaguuggcauuucaguguucuugagucagcgcacagggcguggggaaugaaguauggcagguauuugauuuaaaaagccggcacagauuuaauguccugauaaaacguauuaaaucuuuuaagguuuuaaugaaucuaguauguguuucauaaaucaagaacuccggcuaaaccgucuccagguuuaauaagagcaaacuaggaaauugcucuaagcagaagcaaaaugcauuuguaucacacugaaaaguaauagauuuuuuaagcugagggggucuuucugggccuuuuaaacuguuugcuuauuacauugcuccaacuccuucaaauauuaaaccacaggcaagcaugugcuuaaccauaucaagauguggaccagcacaaagguaaauaguauuuguaagagggaagaaaacaaggcuggcauuucguuaaugucuuaacccucagucaagggccaucuugauuucugaacuuaaaccuggcuuuguggauccuagauuaaggugaagguuaaaauaguucuuccccuaccuuuucuguucuugggguggcagccaaggacuuguucauguuacuaaaccagugcccaacuacugcucccggcucccagcgucagaaaucuuuauuaauggucuuaagccuucuuucuccacucagauugcuucuacauccuuacccccucuuaacacauugcagacugacauggugaauaugccaagucagccuugagauuuacagcugucugggggugguugucaagggugauggacccagaugcagcugucuagagcaagccguccgaccuccauccccuagacgacgauguuuguuuaucucuauuccucuuccuucuucuagucugauggcugaagcuccagggugggugggaacugccuuaggggacuuaggugccacagauggguaucuccagcagggcaagccagugccccaccacccgguuuccuuuguggaugggcgaggcucugggugagaugguaguugggggaguuggggggaggugguguugaaggaaugaaggggggggguagggcuugaacauuccugugcacaaaagcuggcaaggcuugugagcucugcaggggagggagcaggcuccauaaagcucaguguggagaagccuguccaaccucauuagcugucacgggcaacaauacugaucuggcaauaaaaggcgauuccaaaccuguuggucauuaaucacccgccugacaguuucaaauggaaguggaaaaacuucaccccccuccucccugaccccccuccuauggcccacuggaguuuagaguuaccuccgaguagauguguggguucccuguggcacccuggucucuucuccuguggcgauuuuuucaggucccuucucagug

SEQ ID NO: 4372 - RNA, 17070 nt, Mus musculus
uuaaaaaucggaacaauaauuccuuguuaauuacuuuauguugcuguggggaccucaaggccaaacaaagcucucagaaaaguauaaagggcaacucagaguaggacuguugacuggcgacgucauaaucugcaccuuugaaaguuuccuucggcuaaugcagcaggaaaagaagcgagcagaaggacaagaacgcugcaucgcauugaucccggcuccggaagaagaaaagaaauccagcucggacuugaagcgaaggagaaucucuagcaaccuccgaagccagcgccucggaaggugauaccagagccuugguguccggagcccgcucugccagcccugggcauccuaaaacccgcaagccuaggugcgcagccagugugccagcucgcgagcguccccuggcgccaccgccgaacacugcggcucgcagcgcgagggggcggagcggccggacgagcacagggguguggugugggcggggucuucuuuuuauuuauuuauuuuuuuuauuuuuugcgcgcgcgcggacugauggcgucaucgaagcgacuggcccggaaggaaguagggugcugagggguguggcgguuucuacgguugcacggggguucggcuguguacggagcgccuggagggacagccugguacgcggccgccgccccuccgugcacgcucggcaucgcugaggcucggggggugggcgcggcuggagcugacguccugagcccccucagcucgcccacccgggaguccaguccccugcccacggguccgagcggaagcucucggccgugucugccucgcggaggagggcggggaaagggcaagagguggcuuuggggugguagugaggacauuugcagagaggacacuccugcugcucgguagcugaaggccgcuacgguaaaaaauaaguaaauuagucagaccugagagguggacuccgugcccugugcccggugugcacguccgucacuguaguguuuuccagauccuucaggguucaggaaaugagugucuacauguaacucuguggcaucugggacccuggacauuuggggacaucccaccccaccccaccccacccucacuucggaguaguccagagucuccagccugagacauuuccaguuuccuauaaccauggggcuugcgggggcaaaggauaugggagaauguguuacaguuuuacauagagaucugucccguuuaaguccaaaggaacaacagagaagguggaggacagaucagagagagaauccuacgucggaacucaguugcuugcucuucucucucucccucccucccucucucucuucccccccucaggguccuaagggaaugacuggugguuuccuucgaaauggcaggcaauuagaaguaggaggcucugaccagaaauacauagccacagcugccugucauuugacauccucuguaauuugggccagcacccugcagcugccucucuuccuuacaaguauaaauggcucuguugacaacauguuaacgugaaggggagagaaggcuguguuuugaaccuugcccaaauggcaccaaaucucucuuagguauagcuguuucuggagcuaaugcccccuugcuucaaugggaauuauacuuccacaguuaaggaacggaauguugacugagaacaaggacacagugaguuguagaucuggcaaguaguguguguguguuacagcaggcugccccagaaucacuuuacgugagcuucagcuugguggcucuccuguacgucaggcuacacauugucccauaucuucucucuaggauacagguucacugauggcucaguugggagcuguuguggccguggcuuccaguuucuuuugugcaucucucuucucagcugugcacaagauagaagagggacauauuggaguauauuacagguaaggcagagacagauggcucccucaccgcuuauaaggugcacgcgugucuuuauuuaagucuauaaacuuaaaacugccuuuaguauuuuaaggugcugcugauaugaauuuguggguuuaaaagcaaaaucugaaggaaccauugcucuuccaagaucaucucuugacauaguuuucucuuucaucaccugaagaaucuugucuccacccugcaaggcugcuucuccaaaaguuggcacagucccagugcuugauggcaacuugagaaguguacucugcuaacuugagagacuguuuuaaagugaauguuucaaaaaaaauguaaaggcucuaaggaugauuuguaucagggcagcuuucggggaaugacuccuaaaugaucucgaauuacuuucuuuccaguggcuuuugugaccaagguuuucauuguagguuuuagaaggggaauuugcgugacuaauuguuugguuuguggugcugaggaucagagucacaggcuaaugcaugcuggguaauugcccuaccacuaaauauacccccagcccuugcuguaagccuauaugacaccaccaccacccccucugagacagggucucgcuauguagcucuggcuugccuggaaugcucuacguagaccagacugacuugaacucagaucuuccugccucugcuuccgagguguuaggauuaaaggggugugccaauauguucaucuugaccccuccucauauaugagcccuguaauacuuauuuguggacugccaguagcaagcucuaaaugaucauuaaaugagaguuguagcucuguggaaaagcuucugacuaacauacucaagaccuggaguuuaagaacauacauuaaaaaaagaaauggaaacuuuuauugaguuuccugucuuugguaauuuaucuccaccauucugcuuucgugucccccaaaagcuuugaauuuugucagucauguacaacuugauuaggacuauaugucaaauauauauauuauauauauauuauguguauugaaaugacuuuaaaauuauucuugaaccaguauaguggcucagcaccaguaauuccccacuuggguuagggcuaaggcaagaagauuacuaugaguuuuaggucagccugggcuacauagcaggugcugggcaaaccagggcuauguagcaagauccgucucagaaacggugagauaucguaugccaggccccagaggauucuggagcuuggugagagaaagcagauccuucucccuuaguuaaaucccacuugccucuucuaucacggagucuucucacuuccugcuaaaguuacguaaggagcgagcaagguguagcucaucauggcaaauacuagaaugugugaugcccuggugcccugagcacugcccccaaaacuauucuuuuaauugucuaugucacuggacuccaacaguaaugcugcucguugaaacuggguggagcgcucugguggucaccacaggcacagccgcccuggcagacuucucucuggacccauguguagccagggauucugcugccuuugguuuccuuaggcuccauccuuccuucucugguggaaaaggucugacuaauggucugacuuuuccaucaggcuuccuagaguguugagauggaagaaagggagaaggaguaaccgugucacucuacauuaaauuucuauaggaauacagagauggguggccuuaagucuugaucuaagguagugguucacaaccuuccuaaugcugggacccuuuaauagagacacccauguuguggugaccccauccacacaguuaugcucauugcugcuuuauaucuguaaucuugcuacuguugugaacuguaauguaaaugucugugucuuaagugacccuugugaaagaguuauuugaccccaaagggauugggacccacggguugaagcacugaucuaaggacccucucuugggauacugaaucugcucucuccuccucuauagagguggugcccugcugaccuccaccaguggcccggguuuccaucucaugcucccguucaucacauccuauaagucuguacagguauuuguggcucgugugggauggcuggaucauuucaaauuuggguuguugacuaauacacaauuugaaguuauuuagagguuagaugaauaccuuuucauugacagacuuaaggauucucucucacacacaauuugaaguuauuuagagguuagaugaauaccuuuucauugacagacuuaaggauucucucucucucacacaauuugaaguuauuuagagguuagaugaauaccuuuucauugacagacuuaaggauucucucucucuucccacccccccccccacacacacagucagaggcucuucuguaaugucacuugaucacugaaauagcugaaugaagccagugacuggcuuuggccuaucagccccaaguagagauuauuuccucacuuuuggggaagagcuaaagaagaauuuuuuuuuuaaugaauguuuagaagaaaagucaaguaugugugcauauuauaucauagguuaaacaugacaguuggaaauaaaacauggaauuuugcuuguacuuauuugaaauucaaaacuauaaauauaauuucauggggaggaaaguauauccaaccaagacagggccagagcgauagcugagugguuaagaauacuggcuacugcuaaaggggaggaacaauaugaacuaaccagaaucacccugagcucgugucucuagcugcauauguagcagaggauggccuagucagccaucagugggaagagaggcccuugguauugcaaacuuuauaugccucaguacaggggaaugccagggccaggaagugggaguggguggguuggggagcagggcugggggaggguauagggggcuuuggggauagcauuugaaauguaaaugaagaaaauaucuauuaaaaaaugcuuuuaaaaaacaaaaaaagaauacuggcuacucuuccagaggagccugguucaauucccaguacccacaaggcagcucacagcucacaaaugucuguaacuccuguuccagcugaucuuauucucuuacucaugcagacaaaacagcaguguaaauaaaaauaaauuauauauuuaaaaaaguauauccaacuaagaaaacucagacuucaggaauaacuuuuaaaaccaacucagcaagggacuggggggugucacacagagauagaggccagcuuacaccaggcccugaacucaauuccuaccacaaaagagugaaagagagaaaauuaaauuaacccagcagagcacccgucuucccucugccuugcuguguggccuucacagugcuuuggguaguuuuuucuuaccugagucucacagugaugcugagcagauacuguauucugaagcagguugaaaaggagucugcuacuccagcccuaguaaaacacaccaugcaggcuccaaacugucuuuuuuuuuuuaaaugauccuacccguccauauguucuucauguucucuugugucacacaagaauaggcacuuaaugauuaguuucacuaugcuagaugggacagucauguuuagcaagagcaaagcucaauccaaucgagccaucaguuacgaagacaaaggcuuugggccuuccaaauaguaggugggccucuuugucacugcccguuuuacauucauugauguuuccucugucuccagaccacucuccaaacugaugaagugaagaacguaccauguggaaccagguaaggaacccagaauaaggcuggugagcccagcaaguaagagaggagaggcgggaggccgccgugagagaugcugugagggaaaggcagugcagacugaaguggagccgggaugagaggcaaacugcaggcacccagagugcucugucagaagacacuagugacucagaagauaggaacugcccguucuuuccugacacugcagaggucucacugcuuccuugugcaggucagaagcucugcacaccuccugcugagaggugugagcugccucacguugcacaaacauuauccuccuccuguucacucaugugucucaagucaucuccuuaggagauuucaccagauuccagagcucucugguaacgucauuaccacuucucucuccaauagugguggugugaugaucuacuuugacagaauugaaguggugaacuuccuggucccaaaugcagguaugacuucuagcuuguccauacacucgugcacacaccguuugucugaaccccacaagaacugagaaguacagcugcugagaucguguugagaaguuugaagucuuggcuuuucuuaugcugagcccucuccuuccccacaguguaugauauagugaagaacuauacugcagacuaugacaaggcccucaucuucaacaagauccaucaugagcuuaaccaguucugcagcguucauacucuucaggaagucuauaucgagcuguuugguaagaacguggugccacuccaccccucccugaggccaggcaggcuccagcaacccucucucugucugcuucugagccaccacaccaaagaauggggacuacacagcggccagucacaaagaggguuccagauaauagcaagaacagcccagcagaguugucuauaccuguaauccuagcauucaggaggcugaggcaggaagaaagcaaauucaaugccagcgugggcuacaaaguaagacuuuuucuaaauaaauacccacauccauacccauacccacacccacacccaccaaaaaaaaaagaaaaguuaagaacaauggaagcuccuuggaguaguagggcauaggcauugcaguaagaguggauagagcagccacugcuggccugaacagcagacugggacaguaguguccucacuaccccgaauauucuagaaugagaaugcagugagaggaaucuuacaaggcauguagccuaauguauucuuuuuaaauuuuuuucuucucucauacaauacauuccauccauagcuuccagucccuaccccuucuuccccuccccgcuagaucucucucccccgagagaagaguaggccucccagggacaucaaguaagcuuggcacacuaagacaaggcacaaacccucauggggccaagagcaagaaaaugaguugcugcaaguagaugccagagcugcaaccagacccccuccuccccugucacuugagugguccucccacugagugcugggaaacauugugugugugagaaugguagguuccugcuuaauucuagaaguaaagaaagaaguguagguuuuuauacuuccgcaucaaggucuuucauuagggaagucagagcaggaaccuggaggcagaaacugaaguagagaccauggagaguacugcuuacuggcugaccuuucgcacuuaacugugcgugcauuuuuuauagcauccucccaccucugucauaagcaagcagaugccucuauaacgugcccaucggguuagucuggcagaagcagaucuucaguggacauucccuuuucccaguugucucugguguguguuauguugacaaaaauaaaccagcaugguaucuauuucuucuuguacucuuaagcccauaucaaauggaggggcuaguuuuaugcuuucuuucccucaauacuaagaggcucgugagaacauauucacauguagacacauaacaaacccuugccuaccauagggccguugagaguacuuuuaacacuguaacaaucaaaacauaguauuaagcaggcgucucucucucucucucucucucucucucucucucucucucucucucucucucucuguguguguguguguguguugcuagauagacucauccagggccagaguucugcaugcccagcaagugcucugccgcugugccacucccuaccccacccccaaaccaaaggcucaugcuuugguugcuagcuagcuuccauuguccucaguuugaaauccauaaaaggaaggagacucgcuguucucagaagcuacggcuggggcacagcugacuaaagcacgaggcagcugacaauaaucgugugauucugcucagauaucucagccugcuucuguugacuuuucccagcaccccugugagaucucagugguagaaggcaggaaaggaggcacaggccagagaggcagcuuuacuguugcuguucagaggaggucaguuauggcaugugacaaaggcuacucaaggaaugcuuacaauuguuuuuuguuucuuaagcuuaggcgcccugagagauaugguugaugcuuuaaacaaugaaggggauuuauuuugaggccagaguaacagauuacuucuguauuucacuuccauggaagaguguucuagggucucaccuuagguuucuggcuuggguauagacacuguguuggaaagacuacagggggguugcuggugcuuucuccacacucuucucuccccaccuacaguuaaacagcuccauuugugucuuuuugauuccagaucaaauugaugaaaaccucaaguuggcuuugcagcaggaccugacuuccauggccccugggcugguuauccaaguaagcauugccugagcggggagugccuguauuugacaaugugcuuucucgagggaugcucuguuagcacacugacauccagagcccgucagagcugaugucucugaccacuaucaucuuccuucccaucaguuguuauuugugcccuucuccaggcugugcgagugacaaagcccaauauaccugaggcaauccgcaggaacuaugagcugaugugaguaugcccuggccuaagcuggccccagcccagagccacaagcucugauuccugcuuucuuuagcauguuagucugcugcacuguaagcuugggggcaugucagcacucagggccacagaggagcccuggagagcaguggugcuuuuaaaaagugagagaguccuagaaguggagauucagggacagacaaggaagguuacuggcaggucugcuuuauuaaacuuguuuauguuucuguuuccagggaaagcgagaagacgaagcuucucauugcagcccagaagcagaaggugguggaaaaggaggcagaaacagagaggaagaaggcccucauuggucuguguugguucucuaauccccuuucagggaauaaggguuggggaugguaggaugauguaaggaaggccaaggcaugguuaauucccucaaaaugcuucuggugugcuggggugguguucauauccccaggagcuaaguggaaauuaucagaucauggacauagugagugagugaguguugagucuccgaaguggaagggcauuuucuuaauaggaaugacugccauucacugagaauucacuugauauaugaaauaauucaauugucauaucaccuccagaggaaagugcugucauuugcuuggauuucuuguucauuugauuuccuaaauauuauuuuauuuauuauucuguggggugaggugggaguugggagcuaugccuguauguaggagcugauaugccauggcacaauuguggaggucagagaacaacuuccaggaugcuccucccacuguauacugaggucgcagacugcccagcaagcacuuguacccacucagcaucuugagguccuuguuuguuucacugagaucuguacaugcguccaaggccauguggcaaauaagaaaaagcacugaagcuccggucaaccagagcuauuuccuaaagugaaauggcagagugacuuuaaaaggcugacuuccccuaaacaugcuuucuccugggucagcucccucaguuacugcuugaugcugacgcugugcuccuguguucacggggacaaucgucuuugcucaggugugcccgcuguggacuuggcucuaucugagcaaacccagucagguauuagggcgcucagaucaggggacagguacagucaaucaaggucuuuuguuugacauuauuuguguaagugugggcacaugcaugccauggcacuuauguggaggcuggcggacagccuggcugccugugggagccaauucuccuuccaccauuuggggcuucggguggaacuugcaucagcaggcaccuuuaccacugagccaucucaccucccuagccaagcuuuugacaugucagcaguaaaucguuucucugcuuuauucucucagaggcagaaaaaguggcacagguugcagaaaucaccuaugggcaaaaggugauggagaaggagacagagaagaagaucucagaaauugaaggugagcacucaugauguuguuccugauggagcguggguggcugaguuauuuccugagcucuuuagucucuguuucaggugucgugaugucucugaaacacuaguucuccuccgcuuagacuuagggucagaacuuggagccagcauugacaggaggcaggaauaccggcucagcaaguguugcuuguguggauugugcacggggcauuuucuugagagugaaaagagaaaugaagggcagaugaagucauccaguggguggaagugcuugcugucaaacccgaggccccgaauuuauaccaacaagccuaagggugggaagagagagccagcuccugagagcugucaucugagcccugagcacuccccagggcaugcuugcacaugcacccauacauacacauaaauaaauguuuguaaguaacuaacuaaacagugcuggaagcaagggugucaguccaggcgugguagcauaguccuagagucucagcaccuaggguaaaggcagaacaggguggugggucauaggacauucugggcugcagagcaggacccuggcucagaaaagaaaagagacaagaaaggaagaggaagagaaggaaaaagaucucacagcccccguugagcugagcucaggcugacaagugugucugaucacucugacauuggacccaagcagcagcucuuccugccuuugcucucucuagagccaggcauguugauacacacugucauccauagcaagacccuguuaggggacaggaggcaguugguugcauacuuucaucuuauuugcucuccaggcccacacagacauuagguuagccuuggugacgacccuuuucagcaugugcagcucuggagcugagaaguguuggucacucgcuuccagccaucgcucacugcaguccccuccugggcccucacuuccccacugcccucaccuugcuucauguaguguucuacaugauuuccaggacaaagggauccucaaggaagcuucaggccacaguguuccguguaauuauacacucacuguggagccugcagguuuugcagggaccuaccaagcagcugauuaggaugucacagaucgugggcucucaccagggagcucuugguaaagcaguguuuucauuuccuauaaaugguugucauggggcugagagaggcacagcugcuaagagagauuaauugcucauccagagaaccugaguuuaguauccaguacacacauugugcaggucacaaccaccuauaaaucccacuccagaaggauuugacccucuugguucuguagacaucugcacuuauaagcacauaaucacacacagauacacauacucaaaaauaaacuuuuauaagauggaucauuguguugcuuguguagaucgugcacagggcauuuucuugagagugaaaagagaaaugaagggcagaugaagucauccaguggguggaagugcuugcugucaaacccgaggccccgaauuuauaccaacaagccuaaggguggaaagagaguaauccacugggauuacugggugacauagaaaagcgucucaaaaacaccaguagcgggccagcugagauggcucagcaacggaagcacucacugccaagccugacagcccgaguuagaucauggcagaggagagaccugaguucccuaaguuguccucucaccuccacacaugugccaugcuguccgugcuccaccccucucaguaaauaaacacuguaauaaugaaaagguuuuaauuuuuuuaaaaugguggaaaguaaacaaaaacaaccauaaaccagcauccccaauuaauuauugccccugaauauuuccuugugaaugugauuggagugcagcuggcgcauccccgggccacagggcucaaagcugagcugggcaucaucacugagccggaggguuacugcuacaugaagugcugaagcaggucugaaccagacagcgcuccucuggaccagcaugcacgaaucuagaguuagccaaccucaucacuguuagaaacuuuggggagaugaaguuggaaagggucaucugugguauugaacaggcaaggcagugcauguuuguaaucccagcacuggaaaggcagggucagggugacaccauaugauaugcauaguguacaucauguaugaugaagccagauggagguguccugcaguaaaccaaagcucuugcugcacugucgggaagaucucacguuacuuucuuuuagagaauugguuucucuguacuaacaggaagucugcauaguccaaugcuagccuagcuauaaggugagaccauuucaaacacaaaacacacacacacacacaaaacaaucucuccaaggccauggagaccagaaagugucuuuguuggguuuuuguuuucugcagugccaggaauggaaccuggacuuuaugugugcuggacaagugcugucuauaccacugagcuauaauugccagcccccagacuguaccucccaugguuuuguacuugauccaguucccugcacccuucaccccuuagaugcugcguuccuggcccgggagaaggcgaaggccgacgcugagugcuacacagcgcugaagaucgcagaagcaaauaagguaaagggcgccugacccaccguccugaggagguguugccucugccgcucgcuacccagagcccucacaacagaacugaggacccucugcuggguuagacagcgcuucucuugugugggaagccuuaauagaagcuucauuuuguauugaacaggaaaacucuggaaacuguugcuacucugucauagaccuuagauuauuuucucucagaaaaaaaugguuucuggguaacagggaggccaugagacaugcaaacacaugucugcuugacagaugcccuccccagaugaaguuccucucugguguccccucccuaagcucucuucacuuccaucacagcucaagcugacuccagaauaccugcagcugaugaaguacaaggccauugcuuccaacagcaagauuuacuucggcaaagacauccccaacauguuuauggauuccgcaggggggcugggcaagcaguuugaggggcugagcgacgacaagcugggcuuuggccuagaagaugagccccucgaggcacccacaaaggagaacugaggaaacacugucugcaagcucugcucgggcagcuuagagagagcuguauucuuuaagaugagacagagcaaagcgcuccuccuuuccacacuaccuuccuugacucuucuuacugugguuaaaaaggaagaaauggacacaaacuuacccccuucugggaagggagagcagauggagaguuguuuuuuggguuuauuuuuaauucagguaaguaaguuguaugacuucugagaagguguaugcaccguagauuugaccucugaccugcagacaccaacauugucacuuugaagcugguuuaaguggagcuacugucaguaugaagagggagagugugugcugccuccucgugcuugaauuccuucagggaaaaguguacuccacaguucucucccuugccucuaguguaggcagugucugcguguggggcucgugacagaaggccgucugcugcggaacaugagcugcagagagcguuggccggcugggcuuuuugacugaguggauuacuugagaguuaagcugucuugagcccuuuuuaggaagaacuuggugcuagguuuugcaagguuuucuacacacuguacucugcucuaguguuuguuggcuacaucucaccgcagcagggcuuggucacaccacacacuccuuuuccguacuuugaccugaucugugauuucauuucuucuugaauaaucuauucaugaguugcacucagcguuaagaugggaacaaacaagugcuguuagcugaugacguagcuccuuauaccccuuagcacuguggugcuguguggcuaauuaugcguaugcuuuugagaccaaacaucuuuaucauuauggagauucuucauugaagagcccuuaacacuguggagaagggcccagccagaugacacccaaguaguagugccuguggccugugcuggggcuuugucugacacugaugaagagagcaggcagccacuugagagucggcuccagugagucacccuaggaaacugagaaugcgaagaauagauaugagagaaagggauuucuuauccugaaauugcacuggggguggggcucuaccauggccugugagugcacacagaaugccucuguggagggcagcucugcagguaaucugcagacauggcaguacccugugcaaccaugacuggcucuagcuuaggacuuggccuuguuagcugguccccuaccucauccuccccccacacaaagcaccuacuguucucucuuaggugacuacuauaaaugguauuuucuggcaucaauucccaccucaguuuugguuuuguaagucgggccaguuugcuccuaaguggcaccagacuugucagguauuugggaagcauucagccgacccaaaaagaggcaggguucacugugcuuacuucagauguucccuucucuguccugacuccucaggccacugacccuggccacacuguacaaacuacaaaauguuccugaaaaggacauuuuaaugugcucaaaagcucuugcaaaaguggguuuuuuuccccaagaccaacucaucuucuucucauuuguugcugcuaaccacuuguugagagcaacgugcuauacccagcauccucucuuguacgugcaccugagaaaacacuacuucaguggagucggugcaggagggaggguaccccgccauccagcgcccuccuagcccgagaggcucuguaacuagcauucugagagcucaucccuccauuacaaagagccacaguaaaguccugcugcagcugcuccuucccugccccuuuaaugucacuucuuuaacagaacagaaauguccccaugucauagcauaaauucaguagcuauugguaucugucccagcaguaaaaucauggaacucagaugucuuuuuagcaugggaugccuagcccaucugucuuuaugaccuuguuuuuuguaauacuauaaaaucugacuuaggcauuugaauucuaaacauguaaaaugugauaagccugcaguuuuguaggcagugaauucauagcugcuauuuuuaaguagaacuucuaucaaaauacguuaaccguuuguaaaauucaguuuuuguaggacuuucccaaggcccagccaccuugguagaaugcuucucacucacuaaauguugcagaagcaauuuauauuccauauagguuuuuaaucacuuuucaauauaugguuagaauguuuguaaggaagccuaaguuuaauaauuuuuauauaacuaaaaauagguguggaggacucaguguggguacugaggaggaaugaagugcucugaaaagggagguguauaaacggccuguggggccgugugucuugugaaagugagauagccgugcuuacugaccugggcugucgucagcuggccgucgguaaacuaccuggacaauagccccucugucugggaacuuuaccuacuuccuuguccucagugggcuucuagccacuguuuguuuccuuauaaaagcuguaaugggcaaucauguguuuguacuuccauuccuuuuuaucucuacuucuguguaaacuggugauugaauaguuaaagcaauuuuuucagugugccccaagggcauuaaugagccuuuauaacugagaaaugauucuuguuauaguaauuauuccauaaaugauaccacuagauaaauuaccuuggguuaauagcuccaggauuuguuucagacaacaaaaaaaggucucaaugugaauauacuuacauuuuggauuuaauuucagucuugcuaaauaaaauguuuuugucuuuuuuugauuaagguaaaauuuaccaguagauuggaggacaggugauagaaaucaaacuuccuucuuaggcuuucccuaaaaauauauccagguaauauagauucuuaccagcaugcugguacaugccuuuagcuccagcacccgaggagaaggaucuguuugagcccagccuggucugcauagugagacuauggcaaaaacaaacagaauuaacacauugcugcauuucuccagaagauaaaggcauucccaguugacccuaaccucauguaauaucaguuuaaguagguaacucccagacuggcuguggcaagcugccucgccuagugucacuagauaaauguuaaugucagugaacuuuacaaaaacuauauaccauccaaauguuuuacaacaccuacuuuuauagaagaauuugcacuugaucugaaauuugcauuuaacuggauauuuucuuuuaaauaacaaguuugggauaucuugguuuggguuuugguuuaguguauguaguauaggguauuuugcugauguaugucuguauuccacaugcauaccuggugccuauggaggccagcugagggcauuggauuucccggacggggcaguuuugaguuguuccuuguuugcuggaaucaagcaggguccuccucaagagcagccagugcucuuaaccucugagccaucucccucucccccacccugccacaacauaguuuucuugguuuuuuuuuggggggggguugguugguugguuuuggggguuuuuuugggggggggggugucgagacaggguuucuguguauagcccuggcuguccuggaacucacucuguagaccaggcugguuuugaacucagaaauccuccugccucugccucccgagugcugggauuaaaggcgugcgcuuccca

SEQ ID NO: 4373 - RNA, 668 nt, Mus musculus
acggaugaaugaaaguuacuuuaaugucuugguuuauaccggcccgcccagcccuugaacucccuaggaggcuuucaguccggguaaccuccgccuuccccaagauggcgcccgccuggguggccaaccuccgcuggggaaguggcuggauggugagcggcgauuggaccucucaggaagggggcgggaccggaaggugggcucggugagucgcggguccuccgggcauccucuugggaauguugagagguggcagcaugacggcggagcugggagucggguucgcgcugcgggccgugaacgagcgaguccagcagaguguggcgcggcggccgcgggugaggaccggcggaagggcacuggggagggcuggaagggggacaccuacgugggacgaggugucacggugacgcagaaggggcucccggaggggcgggggcugcagaggggaucgcuggguuuccauggcggucggucuggccuugaggaucgggacuugccgggagguuggcuugguuggagaaagguguucauuuagggcaagugacucguauccaggcgucucgccauucgucauugcccucgguaccaccacgccauucgucaccacgguacuagagcccugggagggccguguccacccgcgaucacgugcguugcggcggccg

SEQ ID NO: 4374 - RNA, 13754 nt, Mus musculus
augaaugaaaguuacuuuaaugucuugguuuauaccggcccgcccagcccuugaacucccuaggaggcuuucaguccggguaaccuccgccuuccccaagauggcgcccgccuggguggccaaccuccgcuggggaaguggcuggauggugagcggcgauuggaccucucaggaagggggcgggaccggaaggugggcucggugagucgcggguccuccgggcauccucuugggaauguugagagguggcagcaugacggcggagcugggagucggguucgcgcugcgggccgugaacgagcgaguccagcagaguguggcgcggcggccgcgggugaggaccggcggaagggcacuggggagggcuggaagggggacaccuacgugggacgaggugucacggugacgcagaaggggcucccggaggggcgggggcugcagaggggaucgcuggguuuccauggcggucggucuggccuugaggaucgggacuugccgggagguuggcuugguuggagaaagguguucauuuagggcaagugacucguauccaggcgucucgccauucgucauugcccucgguaccaccacgccauucgucaccacgguacuagagcccugggagggccguguccacccgcgaucacgugcguugcggcggccgcgagccguggucuagcugcgcgugaacuugacacacacagagcgggcgggagcugucaggugcccugucacaagcguuuguuauuuucguaugguuguuaugucccccauuggacuucuagaccggugccaguaucugcuuuucuccaugcaaauuaagcuacguuaugugaagugagacagaaaaaaaaaaaaaaucaaacaccuuuccuuucugaucuaguguucauggucugagauuucaaaaugaugccugaaaaccgaaggcugaauuaacauagucuucucuuaccugaugucugggcauguccaguuaacuacucuagcccuagcuaggguuccucacaggggaaggaaauuaagagagccuugggaguuccuaccaccuuccugguaccggaguucucgggauuucccuaaugcagcccgccucgggaguuaggccugcuugaccgauuugucucuggaagccuccaguuaguucaucaucacacuaggaauuagacacagucagucccucagaaggaggcagcaggagaccgugugguaauugaugugacgucuccaaguccuugagagcacugugguucugugacagucucagaaacggugggguagacguaaggaaagcagggaaacccuucauuuuauguaauggaugugaggagacuuugcgugaaucuaauccugaacacugaguugugggugucucguugucaacucugcugacuguugguugauucauagacugaacaaggcaguguaugucuuuaucucaauugagccucuuccagggugaguggaagcguuauuaauaauuacaucaggaccaaaaugaguuucuaaacuauuuaccuucguguaucagaagccagaagugaccucccugcuaaacaggauguugccuucccuucaugaaggaugcugcuggguuuuguuuuacuuuguuuguauggguuuuuuuggugcuaaggauacaacucagaaccucacaaaugcuaagcagaccuuaugccacuguuacuguauccuugauaaaaaauuuguguguguguuacauuuauguauguacaaguaugugugaauauguguuauaugcauguauguacaagugcauguguguuaugugcauguauauauaaguguguguauauauauauguguuaugugcauguauguacaagugccuguguguuauaugcaugcauguacaaguacauguguuuguguacacgguauacucauaugugcaagugcacaugccaugagugcacacguggaagccagagguugaugucaggcaucuuucucuaucgcccuccacuuuaugcuuugacacccugcaucuggagcuagccagacagccagccccaaggauccaccugucuugcccccauccccacccugccacugggaugacagacaagggguacaaaacuugcuuuuuauaugaauauuggagucuaaacuaaggcccucaugccuacuuagcuaccauuuucccaccaagccaucuuacucacugcaaacccuuaaaccuccagcacugauugacaugcaaaggaaauccgcaggcaggguuggagcuccgugguguagcaccugucucaugugcccaaacuccagggcucuauauucaguaccaaaaagaaaaaaggagaguggaucuuauuagugccaagcugagaucuaggccggucuauuuuacaauguguguuauguugguaguggugguguuuguuuguuuguuuuguuuguuuguuuguuuguuuguuuuguaaugcaggguuucucuguauaccacugggauguucuggaacucacuuuguaggccuugcuggccuuggaacucagagauuugccugucucugccuccugagugcugggauuaaagguguuugcuaccacgaccuggcucuacaauguguaucuaacugggacaagauuccacacauucacucauguggcuccuucucucuuggcaggaccucccagccauccaaccccggcucguugcggucagcaaaacaaaaccugcagacauggugaucgaggccuauggccacggccagcgcacuuuuggagagaacuauguaagauuccucuuauaaagaacuguugggcugggcggugguggcgcacaccuuuaauccaagcacuugggaggcagaggcaggcagauuucugaguucaaggccagccuggucuacaaagcgaguuccagaacagccagggcuauacagagaaacccugucucgaaaaaccaagaaaagaaagaaaaaaagaaaaaaaaaagaacuguugggagaguagugacuaccaggcuucugacucguucuguucuuugcucuuuagguucaggaacuacuagaaaaagcaucaaacccuaagguacguuagacauaagaaguguugcuuuuguuuagaagccuuagcucuuagcugaaaguuacaccuauguugaggguggaauuuuagaacagaaagcugggcuagggauagaagccgucuguauuuccacugcgcccuaaauuucaacuucuauuaauauucucuuguguggcuguuagugaauagugauuuuaggaaaauccuuggagauuugaaagcauaaaccaaaggguaugggaugcagcuuugaggacauaaaucauuuaugccuuucauggauuauuucugaaaaugacagugaauugaugggaaugagaagggaaccagcgccaggcuuagaugccucugcguuuccuugugucucagugggagauuggccgaagagagggguggcaguuuaucauucccaggagagcacagaagugaaggacaucugaacugacagagccgccaugacaucgcuaucaaacgguccccuucuucucuucagauucugucuuccugucccgagaucaaguggcacuucauuggucauuuacagaaacaaaacgucaacaaacugauggguaaggcaaaacucucagcacaaagccaggccuucucugugauuguauggcuuacaccaccgucuaaguaagcagcuuugagaacacccccagcucaccauuuguguggcgggauuucuucaaauaaaacaucgugaaauaguaagaaugaaguguggggacuggaggguguagcucagcagcagagugcuugcuccucauuuacaaggcccucgcucgguccccagcaccauaaaaauaauuacuagucacagaaagauuugacugugugaugugugagguucucaaguaaccauacuuacuccucucaagguaucaaaauguaagaaacuguauggguuuuuuugguggggagaaaggcauagggagaggcagauuguguguauagagguuagagcaacauggaggaguugggucuuucuucucauuaugugggucccagggauagaacuuggguugucaggcuuggccgcaggcaccuuuccacacugaaccaucuugccuccccuggcauuuauuuuucuuaacagcuuugucaggguaaaauugaaaaaagcuuaucuaacuacaauaaaugacacagacugaaagugucugacuugaucaguuuugacagaggauuacaacugugaacugguacaguaauuaaaauagcaggcaucuaucccaucaucuuguccccagaggcuccuuccugucauccugcucaaacguuccuugucugugccgccgcugucauccccauaguucagacuuuguguaaguggaguuagaaaagaaaaggucuuccuucuuucuauccugacccagggcugaccuuuaucucgguacgcgguccuuccaucuuccuauucuguacuauugcacuguauuuacauagcacaguguuuccacucacacugacgaacaucuagguuacuucuaguuugggaguauuacaaauaugcugcugugcagaugugguggcacaagccagaauucccagcacccaggguuaauaaauaagugugauaaaaaauaaggcaaaaauucagaccauucuuuuuucaacucuauccucuccucucccauuccuuguuuuccuguugcagaguucucugcuugcuuguuuucauuucuucucugggcauggugacacacaacucuaauccuagcacucuggagacaagggcaggcagaucucuaauaagaggccacuggucuacacaguuucaggccagccagagcuacauagacccugucucaauaaaauaaaaauaaaggccuggagagacggcucugaaguuaagagcacuuucuggguuuggcuacccagcaugcuuaugucggcucacaucucuuucuaacuggaguuucagggauccaaaagccucuuuggccuccuuaaguaccaggcacaaauguggugcacaggccuacagguaaaacuccagccccagaucacagcacauguuugcacuggggucccuguuaguuuuguugcuguacuaaagacaaugaacaaaagcaacuuaacuugggaagaaagggcuuauucggcuuauacuuccacagcagugaaagaagccacggcaggaaucuggaggcaggaacugaagcagauaccauggaaaaaugucgcuuacugguguguuccccagggcuacugucuuauacaccaagagugccuacuccgggacugcacaacucacagugagcugugccuuccuauaucacacauuaaucaaauggcacagacuuuucuauaggccagucuuuguuuguuuguuuguuuguuuguuuguuuguuuuucaacacaggguuucucuguguagcccuggcuguccuggaacucacucuguagaccaggcuggccucgaacucagagauccgccugccucugccucccgagugcugggauuaaaggcgugcaccaccacugcccggccagucuagguaauuuaacuucucguuauacaucauccugugcuuuuuacauugccguuuugguuugucauuguuuuucugagacccagucugacuaacccgggcuggccuagaacuugugguaauccuccugucucacccuccugaauucuggaaucgcaggcacgaccaccagcacacccagcaacaugccagaaaguuuuguuugguuuucacacauaaacuugucugacucaguucuagcugcuuuccuauccucauacauauccuuccgcugcuuuguuguggaacacaguuuacauuuuauuagaacaauuugaucuuuuuaggguuuuggguuuuugguugguggguuugucgugccaggauuucucuaaggucccuggaacucuccguaaaccaggcugaccuugaacucugagaucuaccucugccucccagugcugggauuaaaggugugccaccacuuuaggucuuguccuaacuaucaguuuguauaaccaggccagagcugagauuagaaugaauuauuuaagcuaccaaggcauagccuuccuguacacucuagugucucuaucccaacaagguuguggguucagucuucaccauggaggaggaaaaaagcaaggcaggagggaugggaggcaggggaguaguuagcugacugccuggaagauuucugugcucaguacaauaaguuggugggguugugucauggucauuuaucugugccaagagucauaguucaucuucauugaagguagcuuugaugaccucacugacugagcauccagagugagcuauucugguguccuugucaaauaagaagacccaucccagaaguuauaagaacaugauaucuuuccaggcuagcguuuuggcuucuggauagucucugucccuugucgacuggccuauuuuacucaguuuagacugagacauaauaagaucggggccuacuacucagaaucucaauugccaacuuuccgaaucgucuccguacuuaggcagccugaucguggugucuuagcgucucccuuauccaucuuugcuggugggaugggacucgccugcccucgagguuccuauccagcaagcucucuugcuugucuucuuggcggucauaagcugaacuguccuuuucuuucccuggaguacuccucccucuaccagaucagagguuugcugcacguccucucuggcagcgggaaagcgaagacugcucccuucccccuuucucuucgcagccguccccaaccucucuaugcuggaaaccguagacucggugaagcuggcagacaaggugaauagcuccuggcagaagaaagguccuacagaaccacugaaggugaugguccagauuaacaccagcggagaggacaguaagugacuaggccugaccauggagguuugcucucuugagauggcugaggcucggggagagugugaguguaagcaucugcugaggagacugugaggagaagcuccagccuccuggugagcugcuucgucaagauucaccagugugaugacccaauauaauucuuuaauauauuucggcuuguucgguauugauuuggaagaauuauaacuuugauguccuggaaauucccuccuggaagggauugggaauuguaugugucauacuucuuaggacaauuacccaguacuuuauugggcaagaguaggaaaaaaaaaaugcugcuguacaccagugagugacugucucauggggccuggcuuagcaguguggccaugaauuacagagaaccgugacuuugacaucagacaaaugucugccugcgcuccaccacuuucuagcauuggaacuuugcgucaguuaccuaagcucucuguaccugaguuuccuccuguggcagugucaucggggagugcccguuguuagaggguguggugaggauucugugcagugagugauccagaaccccggauuucuuacuugcucacuuucuguuaagagugaauggcaggcacuggcuuacaacugucuucuaggcacucacacguagcagaucuuggcacgaaggagcucaguacagacaucuguuuuccagaugcgcccugcacucaaaucucaggugcacaguucucguccauaaacuuaggaaaagacuuagcccaccugccuuaguuuccucugaaaacugguauaaguaagaauauuuagaguuucuguaugaaaugaaaagucguggggcuggcacaguggucaguagauuaccaguuaccauuauaauguuauaugcaugcucccugacuauggcuucauugcauaaaagcagauacaaaauugacuccagagugucuuucauuucuugauaauuaccugugauuugcccugauuaaauaacagugaaaguuccuccguaguccauuuaguaaauaggggcaaaggcaaagcaauauuaauagucuuuaaaauacauaaaauucauccaaccguucuuaacuaguaaguuaaacuucgcaauuuuacagucccaacuuuauuauguauuaugacuuauuuuugcagcucuauuaauaaauugauuaaaccauaaaaaugucagguuuagaaaaaaguacugagauucaucuaggacuuuggcagugugacccucccuagugucccaagucauauguuugucucuuuucuauuucugugauaaaacgccaugaccaaggcgacuuagagacggaaaggucuguguggcuuaugguuccugaggguaagaauccauggccaggggagcauggccgccugagagaagcccaggccucgcaucuugaaccacacacauggaacagagggaggacgaggaaggacauaggacuuugaaacgucacagccggcacccaugauguacuuccagcaaggcaacaucucccaaacacagccaaacagugccaaaaccuggggacaaagcauccaagcauggagccugugggggacauccucauucaagccauaacauauuuucuucuucucuggcuccccuagccauucccagcuaaaguccugugggaugugucuucgugguaccacuuuguguaugcagaaccauggguucagucucuggcucuaaagauaauaaagagaguccugagauggaguaaagagaaaucaucuugagaaacgcagagcccaaguggaagacgcccaggcaugaaggaccucacauacacagucacucuuuagggccagggaaagugacuucaucagguguucaucugagucaccucuguuguaaggaagggaugaaaauggagccuucuucuggcuaguuaagauguguuggcauacacaucuuccauuucucuuugugaagguaaacacggccugcugccuucagagaccauagcugucguggaacacauaaaggccaguugucccagccuggaguucgugggucucaugaccauaggaagcuuuggacaugaucuaagucaaggaccaaacccagacuuccagguacugguguuggagugaugcucucaugccaaggaagguaucauggggcuguggguucagcccacaguagggugugucuagcauggggagagcuaaugcuugcccagcaauggugaggugcaguagcaucccaccagcaugcagggauggcugugagguagguacaucagggaccucucagaacagagccagucagaugcaauaucacagccucuucugaacuguucucauaaggagaaggaagaccaggcucccagacaccacacaccacaccuuccuuaacccagcgucuacguggcuaauacaauuguuagagcaaacuuuuucuuccuuucuagugacuggcaguuugcaucuuuacuguuuuuaggauguuguugaauuuuuuucccccacugcuugggguggagcccagggucuggaguauacuauuaaagcguucugccgcugagccacacccccugggcccugguaguuuucuugaaaguugaagauguggcuuaaacuuauaguuaccuauaguaacuucugguaaucauuacacaccucagaauccugagaaauagucaucagaaauguuuugguuuguaguguucauuuuggugggucuugcuuuucuccuguuuuguuuguuuugauuuaguucgacuugacuugcuuuguuuuggagacaacuucacuucccuguauaucucaggcuagcuaugaacucaggauucuccugccuguuuccaaguauuacaggccagcgcuauugugcccagcaggucuggucaccuuuugacaucauuggaaacaacaagaauaaaaugguaccgcuuguguuuuuggcagaggcugcugacccugcggcgggagcugugugaaaagcugggcauuccgguggagcagguggaacuuagcaugggcauguccauggacuuccagcaugcuguaagugcccucaucaguagcaacagucacgggagcuuggcugcucugacacuacccuccccacacugcuccuuuguuugaagugaaauuuauagaaauuacaaccgaguucuuaaaacucaauguaauccacuacauguaaucuaggaaaaggccgggguguaacuuaggaucuaacaaguguguuaacccuggguuugguuucauagcaccaagaaagaaauuuuaaccugauuuuuaaaagcauuucaaacauaaguccuagggcauuagcuaugugacaauaaauauaaacugaaauaaaguacuguguuagcaacucacauacaugaauuuccaagguaggaaauaacagcugagugcccuggcucagucccauagucccuuggaagacaguccagaggauugcuggugaguuucaagucagcuugagcuacacaaacaaguucaugcaagccaaggcuacauaguaagacccugcuuugaacuaaguaauaacaguucugaaaaucaaaguauagaauugcauuuuuggaauaucauauauauuaaaacaguauaaaaguucuaaaacuagagcuuguuuuauaacagauaacuacaggguuuuuuccauuuggccggccaucagccuuuggucaugagcugcagggcagcauuuugcuguguugugcugucccacaccuacaucuccaccgucccuuguuccuagaucccuaaaugcaguugaacuccccaagcacugugcaagcuaagaucauuaccuuucuuuugaagacugacugccauaaaagugacccugcccugguccgggacaccagagcacccaaccaucuucagcugcagcuugguuguaccuuacgcagccucugggcagcuagaaagagacucagcaccagcuacacugcagugccugacacucucuccuccacauuugcuucuuucccacagauugaaguaggaucuacaaauguccggauagggagcacuauuuuuggagagcgggacuacucaaagaagccugcccuagacaagacagcagacgcgaaggccucaguaccacuggugcaaggacacugaggccaagccgcucagggucaaccaugcaccagccuaguucauuugguguccgcauguccccagucacacucuuccguggccuuuguagagcgcugaagauuauacauguugacgggaaucacccgugcuuagcuucggcuauaggaagcucgggucaagcagugacuuaggcugugagacuucagaaccgacaccaauuuagccaggaccugaguucgguugagcacugcucaggaauacccagccccucacaaaugcguguccccaagugacuuuuggguugcuggugucuauaauugagaaaaucagagggguuccauuuuccaucuaauagaacacccugcuguccccgcuacucuggagugaggugauucugcucccaguuuccauccuggccuuagaugucuccaaucacagcuccucuguggcacugacugaaauuccaggguaacuuguaaacugcucuugggccuuucuugcuguaaaagagggacuuggagcuuauuccucgaggaccacggugauggaaaguggaugacaggauuucuucaccaucauaaucccuuucugguuuuuaguaaagacuuggagaugaaagccuccaguccuggcgcaugguuucagcaagccucacuugcuuuuccuccucuggggaucagcuauccccaggacacacuguauucacaagccagaauggugcagcuccugacuguucacagugccguaagagcuccaaaaaugaggaaacagcugggccuaguagcaccugcccguaaccccaacauuugugggaugcagccaggaagaucaggaguucaaggauaaacaaagacuaagucagacucuucuuuaucuaaaaacaacaauaaaccagaaagcacaguucugcagugaucacaacggcuugcgugugggcugcuuagcuuauuuccugauagcuuuuccgcuuguuuccuccagcccucacauccuucauuuaacaaauaacuucagaacccguugcugcugaauguaauuuccagacuuaaaccacuaugauucuuguucuguuucaaucaaagcuagcgcggucuuucaguuuguuaaauacaaaugugagcuugaauuauaccaucugugccaacucuaaagccauuaaagauuuauuuuuaugaucuggugugaugagugaauuggcacggggggcauuggagcugauggcaagcaccuugucuagccucaugccuggcucuggagagguccauccuugcgucagagaugccaccaaagccacaccauuacgugcaagaaggguucugaacuucaugagcaagaaagugucuucacggagcuucaugacaugccuguaaauacaacacacagaagguggcaaauucaaaaccagccagggcuacauagccaguuuuaugccaccuggcuuguacauugagacccugucucaaaaaaagaguaaaugaaguguuagcuggcuuguuuggcaguuauuggaaaagugccugcuuccuguuguaugaaauucuuuugauugccucuagguggcgacauugguuggccugaggaacaggccaacuugugaaaagcacacauauuuggcacacacauauuuggucagcaguuugcccuaguagggccuauucagucuuacucucuuuaugaauagaagcggagggcauggaagacauguuccccccggugacacauggacuugcaggcucaggugguuuugucaaugcuacgucuugauuaagggaucugaggacaacucuggaagcuuuggggaaaccgcaaugguuaagccgugaaaggucucccuggcuugugccuggggaguaagagcacaguagaggagaagccaggagagaacuuuaguccagaugaaggaaagaagcccgacuauauccacaacgggacggcucucuugagaacauucagccaggcuaugagacuauuguuucaugugagacagcugcuuggguuacucccagguuuuaauagcagcagugacagcaucagggcaaguuuaaagucagacccacccagccaguaacugccucuccccaacagcccaugcccuggugugugugugugugcaugcccuguauuaaaguucucuaaggaacgacagacagauaaaaugaacacacacacacacacacacacgggauuuauuagaguggcuuacaggcugaaguccagacaguccaacaguagacagauagguaagggauccaguaauugcucauuccuuaagacuggacaucucuucagcgcaggugcuggaaucccagggagacccuaaagagcugccaguuuucauuccacauuggaaucccaaaaggaaguaggcuuacuuccagcagaggaauggcucagaauagaugaucugccccaagagagucgggcaagcagacagagagcacaagcuuccuucuuccaaguccuuuuaugugggucaccgccaggaggugcggcccagaguucgggugggucuucugaccgcaaaacauccagacuuaaaugggucuucccacuucagaauuucaaccaaggaaagucccucgcaggugugcccagcugcuuggguuuuaguugguuccaaacguugucgaggugacaaccaagauaagccaucgaguaucccaaauccagcaucagguuugagaggcucaggaggccuuguauucuuuucucuuucaaauaaagcauuuaagccuuuuau

SEQ ID NO: 4375 - RNA, 16350 nt, Mus musculus
cggaaggggcgggccgggcacgagaagggcugggccgaggugccgcgggguugcuggagggucgugggcggcgugcaggagacaugucggcgggcagcagcugcagccagacucccagccgggccauccccacucgccgcguagcccucggcgauggcgugcagcucccgcccggggacuacagcaccacuccgggcggcacgcucuucagcaccaccccgggagguaggcgcuggccggggucacgggcgaccucggggggcuggaggauacgucgggauccggagucucacgugcgacggggagggcggcauucgagggguucgguagcuggccagaacggacgaggggcgucgggaaagcagaagggucaccgucucgguugcucgccuucugggugugguggagcguggucuggaacccggcugcaaacugccugcauuauuagccuuuuccugggagauacggcagagugcccugagcauacagauaggcacucugccaggaccaccaugugcuuaagggcgaccucugugggugucagggcaguuuggggugggacaagaucagggaaagaggcuggccuggagauuaaguuuaguugaucucccuuggaauaagugacgccugcacacuuuuuuuuuuuuuaaccuuuccggaggcagcccucuuugcuuuggacacucgcucauuaauggaggcuggacgcugagggugcuucucugccaccuguggcuuguguuaagagagagauuccugcaggggcggcgucugguguagugcagaacaacacguuccucgggccuggggggcagggcacagcguugaacuggcccaaguggcggaggaugaggaagaggaagcugaguuggcgcgggugggggccggccuccgggaaccaggcauucccagcuugcccuggagccccaguauagacgcugaugaaaccuacccgccuguuugcaugaugaaauccucguggcucacuacuucccucccaauccucgcgccgcucccacccacuuuugcgcuucuccccuccccggucuccucccccaacuacuccucuuacaacucaaaaacaagaggaauccuggcgcggugaugaaccuugggcuacugcuggcgcagccgggccacaugccuauuuucucgggcagcugucccugcaccagggagcacagccagaucccagaaccaaggcaccgaugaagggaucuuggagcucagucaguguccacuggguucugugaucuucaggacacagcaccaaggccucgcugcuugagcacgugucuguugugcaucgucaugcugaguuccuacacucagcaagaaguagcaagcagggcagggggagaaagccggcucccucuuauuagaaacggcccaaaggaaaaguuuucugcaggcuucuggccucccguuacuggaguucuucaaccccgcuggccacuuuuuaguucacgcuguugccccuuugucuuuucgcagaacuuuguguugagcacaaaguuucacagagaguugaguccuuuuaggcgaggugugaaucaggguguauuuuuuauuuuuauuuuuuauaggcaccgauacagaccuaaaggcucugggaaacguuuauuuucucucuugcccgucccuuucuggaugaacagguuagcuggguagcaauagccaguacuguuuguaaugcacucugauccacuucucacuguggucugcgaaguguccguuggcagaccagguaguucccguugucuuugaagaggaagggguuuccuuagaguguagcauuugcuucuuaacugaaagaaagcagugucagguccccaaagccagcuggcccuugucagauuuuuguugcuguuguuguuguuugugugucacacaguccauagcucgaggaaagacuugcuuguuucugccaaagccaguuaauuuaaggagugggaucuuuucccaaaggccauucauuccaggucgccucugcuaaagggcagaagcuugacccauuugcuccagaauguuucucaucacuuagcaccccaacgagauacggaauccgagugcagaggucuacagggugaguuacgggagagccagggcuacacagagauccuccugccucaccuuacugaguguugguaauuccgggguuaacagcuguugaauacccuuugggcuauuucucuuugcucucaucuauucucugcaaauccaucuaacuuuugaauuuucuuacuuguaucaggggccagcugggaguucaaggucaagugaaucacccugaggucuacucuguccucuggaucuaugggcguauaaagcccaugagcuugaaucaggacugagucaucugccuaaccauuauaugcuugauuggcucacauuccauuuugaguacucaggaguuacaagggaaagggauaaacaacacacaaacaaagcccauacacgcacacacacacacacacacacacacacacauauacacauauauguauacacacacacacacacauauauacacauauauguauacacacacacacacauauauacacauauauguauacacacacacacacacacacacacauauauacacauauauguauacacacacacacacacacacacacacacacacacacacggcuuuuuuccuugccuuuccagaucuuuaggagucuggcaaaguagaucucauauccaggcauaaagucagguuucuugaacuuaagcuuccuauacuccuuggcaugugacuugaccuguaaggggcugcaagcucuacaugaagaaauacuacaggaagcuacuucagcugagaauggcuuugaagcagcugccucuggagaccagggcacaacagguggccugaaccaucuccauuccugggacucuggucaguggucauuaagccuuugguaaccuaggacauuucugaagggagugucccacaagaagauuugaaccugggagucuuuaagauugcuagcaaugucauaaacaggaucuagugaacacccaccaaggauggauguuugacuucuaaaccuacagaaguuguuuggguggucauaccucauaguaccuggguaagguuaauuaauaaucaggcaggcagguagguaggguggcagguguaaaugacacuguuuuguaagggguaaaguugaauguaauggugcagagacaggagaaucuuugugaguuugaagccagccuggucuacagucuacauaauaaguuccaggucagucagaccuacauagcgagacccuaucagagaaauuaaaaaaaaagucucugucugggaagcugaccuugagguggcugccaaguguuuaacuccgucagugcugggaagaggggaggugggcuggacgcugaugccggugacuugaugucccgaggucuuagucacacagaggggagaaguuacagcugaggauauuauuaagggccgaaugagagagcuuggauaucgagguggcaaggagauaaugguccccgucugacaugcacccgagcuuccauuuaaaguguuugaaacaauauauaguagguuccaggacauacgacugaauuggaaggggguuggguagagcacuccaagcuaccuuugcagccucuugguuuuuauuuaaggcaugcccugcaacuaggaagauagugugacuuggaaggaugggauucaggugacgauacagcugacggugggauacaagcauggggcuuaagagaugguuccgagguuaaaacaugcuugcuagccaggcgugguagugcaaaacaaaaaaccaaaacagcaaaaaaaaagugcuugcugcacuuggaaaggucuguucuuuagccccuggaccucuguccgucaucauuccaccaucauucuagcugaagggguggccuuuccuugcuuccacaggaaccucucccuaaauuaaaauaaaagccuagaggcucggagggggaagcucagugaaggggaacucugcaagaggaucugacaucacaaaggagggggaggaggggcggaggcuggagggugacuuucagguguaagagagaguggcuauguugggaguuaggggacuagagguuuggcacagacuuucaguuaugagagggguaaauuccagggguguacucaucaguggcuauaauuaacucugcaguguuuacuagaaaucagcucagggcaacuguagccauauccuuccguacacaggcagacauccgagagacguaggcugguugcucuaauugugggauuuauuuuacauuuccuagugugacagcagaucaucacauucuguguacuccgacuaggugcuucugccuccuuucuucucucucuaugucucccucuccuuuccuuuuucucucuuccuccucuucuuuaagauaggaucuuacuguauauagccccggcuagccucaauacuggugaucuccugucucagccuccugagggcugggauaauaggcauguggcaucuugcuuaagugcguaagauuuuuauuugccaguuuuacuuaauaguucagugaugcugaggggagacaugauucuaagaaccaggggcacaucuauagaaugcagcgauuccauagacacccccugcccuucaguucuauaacccauagugauuuuuuuuuuaaaguuuuauuuaauuauaugaguacacuguugcugucuucagacacaucagaaaagggcgucagaucccauuacacagaugauugugagccaccaugugguugugggauuugaacucaggaccucuggaagagcagccaguacucuuaaccacugagccaucucuccagccucauccauagugauuucccuuugugguuuuguacgugggccccagggccacagaacuuguccccaugauccauggcagucugaggacgugauccucuagauuuugguggccuucagagguugccuuuuucuuuccagcauccccccaaaguggcagguagucauuauuuacaaggugagcuggauucucacccaccacuaucagcaaaagucauuaccgacucaggugaagggaggcagagagcauggugcugauuucauuucacuuagugguacaaaacacugaagcauuuuuccaaaugagccuuuauuugauguucacgaaaacgaguuagaagggaguagcaauauugaaaaugaggauugcuuaacgcgaccauuuuuuuuuguuuuuuuuuucuccccuccccuuagcgaucauuucuguguauggauccccauauguucaggcaaacaaacaaaaacauccauuacuuucuggcccgagcgagucuuaccucagcugucuuucuccguggugaaucauagccacgagucuguuggcgugcuuguuucucggguuagacaggauguucuuccagagcagucguugugaccccaggaccuaaggccagguccgguguucagaaggugacgagucaugcugcguguggcuuaguggcacagugcccugcuagcaugugggaugcccugggcugauuuuuagcacuagggaggagaugaagaugaagggggccuacaaggaacccagagugaagcauccucuuaggauauguagguuccuuccugaggccugggucuccccugagaacuccaggguggagaugguuguaccagguugccacuagccuuuaacaagccaucaccagacuugauaacguaaacaacgguuuauugcucacgucuguccuuugcugauuuuggcagaguugacucaaggcugcagcuggauugcccugggcugcaagguccaagguggccuuauccacgugugagucuaucacuugcuggccccuggugggaggcugggaacgcucccgucuuggggcucaaaucauuuaguuuagcuugaacuucucuguuagcccagggcagaggcaugggagcuuugccccaucacuuuaaaaguauucguguguucuuagggggcaguccagcuuuaagugggggugagaggaagaugggguggccuucuuuguuuugagacaggaucuccaaacauuugaggaugaccuuaaaguccugaucaaucuacugauaacuucucaagcguaugaaccacucacugguuuuuguuguuguuuguuguauguuuuuuguuuuguuugauuuuuuuuuucccugcuucuucugaacggcagacuuuagggccauugcuuuguagggcuuaugcuuacuguccaaacacaccccucuuauugucacuuggaaggccuggguuuucugggcacuagcaauuggcuugagucaggugugcccggcagcccagaauguggaugagaaaagaggcacaguccguuuagagcuucgggggcacauguuuaugaugucaguaaucugggaaugaggaguucgucaacaggaggaucagauguucaaggccaaugugggugcuuugagaauggcucccagagaugcaugcauuugaaugcucuguccccauucgguggaccuguuugggaaggauuaggagguguggccuuguuggaggagguguggcauugggaugggcuuugagguuucaagaaaaggaaaaaggaaaauguccacaccauucccuguuagcucucucugucucauacguguagaugaauaugaaagcuaacagcuauggcuccacucagcaccaugccugccuaccagaugccaugcuucccgcugcgauggucauggacucuaagcuccacguuaaaugcuucauuuuguaaguugucuuaucacaacaauagagaaguaaccgagacagccuuagcuacauauugcauuugaggguggaccgggcaggcucagcucacaugaaaccuugucacaaaacacuccaagaaaugaucagagcggucguccuacuugaagagaauguguguuuggacuggaguugucgcucaguggaggaacaaguguguuuggaaccuggguuuaaucccaagcaccagaaaagggaaaacccggccagucuaucuuagugugcuacagcugccauaugaaaauacugcuuuaauccuagcuuaagcggcaaaacuuauuuucuuacuguuugguaacuggaaguuuaagaccagagugagguugguucuuucugaggccucucuuccuagcuugccuaucuucucucuugucagcuuaugguccuccuccuccuccuccuccucuuaauaguauagaauagaguuuauucagggcauggggaggguaguagagacagagaaaggcagagagggagagaguagaugccgccaugagcauguggagcgagaggggggaggggaauggggagagagggggaggggugagaggacagaaccagagcaagaaggcaagagagccagcuuauggucuuucgucugugggucuaugcaugcauuuccucuucugaggaugcucuggugacgccagaucaggauccagucuaaaggguucauauugaccuucucuauaaagacaccauauugugaggugcugggguuuaggcuucaacaccugaguuugaaggaacacaguacaguccauaacagcucccacccacucccucuggacuagcccuugcuguguuuugggagacaccuggagagcuuguggcacucacacucugcacuggugcauucugaagcauuuggggagaggucugcaaagggggagacgcugggccagccuuagaaagauuucagccauuuuguucuaaagucucuguaaaaagccuugcucuugucagagccucuuagggaagaaggguggcuuguugcccccgacagauugcccacaguuggugucugguagcuucauaggacccccgagagagguaggugugcaucaccgugccucucuuccuauuccuucauaaaagucuucuuucugauaaguuuacucugcuugcuugagacuggacaucuaucuauccauccauccaucuauauaucaucugugugugugcuugugucuauuugucugucugucugucugucugucugucucuaucuaucuaucuaucuaucuauccauccauccauccauccauccaaccuuccauccuugugucuacuaucucuaugucugucuacuuaugaaacggugucucuacauaguccuggcugucucagaacucacucuguaggggacuggccuugaacuuacagagauccaauuggcucuaucuacggagcacuuguauuagagaggcauauaccaccauggcuggcuuauguuuguuuauuuauuuuagauuuauuuauuauguguaaguacacuguagcuguccucagauauuccagaagagugcaucagauuucauuacggaugguugugagucaccaugugguugcugggauuugaacucgggaccuucggaagagcaguuggcgcucuuaaccacugagccaucucgccagccccauuuauuuauuuuuugauccccaaacccuugugcauguaauguaaggaagauguucuuccauggaaugauaacucuagccucgggaacauugguauguguuauuuauuuagucuuuuuuuuuuuuuuuuuugagacaggguuucucuguguagccuuagcuguccuggagaccaggcuggccuagaacucagaaauccgccugccucugccucccaagugcugggauuaaaggugugcgccaccacgccgggcuuauuuauuuagucuugaugauacuccuuuggggugugagucuuuucuuaccuucuucguguggcucagaaagagcugggacccagaaauugaguuuucuagguaggugauucccgguuugaguccaggacuugugcacaaagucccaugugguuugcacauuaaggauccuaaaaauagguggugauggccagugcuuuaaauauaguguccgugagcccagggugacacccuugguuggcaggugagaaaacuagauccuugggggaauguguccucacuaguguguccaggaaaacuggcacgaguguuaaaccacgccuuccuggggaguaagcacugaucuauacuucgugcauuccaggaauuaaaaguuccaaaggcuaccaggcauaccucaauucaugaugguucccauauucugugugucugagagagauggaggacgcccguuuccgcaccccaagucucuuucuugguugcuuaccuuccuucugaagaguccccacuuuggguccuuggaauuggguccugcugugggugggacugagcaacugguggcagcuggucaccuuaaaccuugaugggacagaauaauuguuagcguuugugcaggggucccuugggagggccacaguucuuuuuuuuuuuuuuuuaaaggauuuauuuauuuauuauauguaaguacacuguagcuguccucagcuacuccagaagagggcaucagauuucguuauggaugguugugagccaccaugugguugcugagauuugaacucaggaccuucggaagagcagucagugcucuuaacugcugagccaucucgccagcccagggccacaguucugaugcacaccagagguugaugaaguugccaugauaauaaaugagcaggcccauuuugaggccuuggagaggccacugaggcacagguagaggaaguaguaccuuguccauagaguagagcuggcaaaugagacaauugucugucgagagucagcgagaaagaacguugguccacaggcaguucaaaucugaacuuggaacuuucaccuuagcacccaguaggcucucgauuccagcuccacaacugaucugugauucacgguguguguguguuuacuaccuaccucaacauuauuuauauguuuauuuauuuuguaccuucuuuucuccacugcgaccggaucccugacggggaaacuugaaggcggaauauuuauuuuggcuccugacuucucaguucaguccagucaguugauucauugcucgaucagaacaucauggcggcaggagcuuguguuagagaugggucuugacuuuagggugggcaggaagcagagagaagggagaugcuggcgccuggcuggcuucuaaacagugagauggugcuaccugcauggaacauggucuauccuuaguuaauccucccugcaaaugaccucaggcacuccacagcugcaccuucccaggguccuacauauuuuuuuggaaauagcgccucucuuauuuagccccgucuauucuggaaauugccauguagaccaugcuggccucgaacucagauccuccugccuuugccuccugagugcuggguaguggcaccacaccuggccagcaggaccucuuaaaccuuuuuuguugaccucuucuaucuagcaugaguuuuuauauaacccaagguauguagguauauaaaguagguaugcauaucaaacauucacugauaaaguuguaaauuuauuuuaaaaaaaaccauuuuuuggggggcauacauauaauuugacugucuauuaacugacaaaagccaguuugcauacuaagaugaccuucuuguuuacgaagaauagugucccggcugaaagucucgaaccauaggacacagggcauauucguuuuucaguugguuggcguuuuguuuuuauaacaaucugugaugugcauuauguugguaaauuguauugcgcuguuugggaugacugauaagcuggcuguaugcacagaguuaccgccccgccucucgcuucagacccaaguguguuuaucucagugucugcccccugugugaccagagggaagagagcgggcauaacgacagggugaaaaugcccuugagaacagcuggggggggaaccacugacaaccaggguccuuauuguuugugccacgcuauggaagugccuuaguuggaaacuugaucuacauggcaagcuccagauagaaagacccugcguaggacccugggaaggcacaacacagcugugggagugccuaaggucauuugcagcgcagguuagcugaggauagacccucgcucagucggggcuccagcugccugccucgguuucccuuacucagauucugccggaugcuguggaccuacagcugaaugacguucguuuccgguuggcuaggcucaccuguuugaagccuugccccgaggggaccauugacuccagcuggcugccuuagaguccuucucugcugaauguuuggcugguuuaauacuguuugucugaccugucugccuacccaucucucgcuagcuaucuauucuuuuaauucggcuuuacuaugcacuuauuuacaauggaaaguuuucguaggucauccucccaggugguacaaaaccaucaucagcaccaggaaaagccguucguuuaaauaaauaaguagaagacagugacagugacauuucagaagcugucagcaauucuguccuaaucccaagacuuacuuauuuauuuauuuuuauuugagacaggguuucucuguauagcccugucuguccuggacucauucuguagaccaggcuggccuugaacucagaaauccuccauccuccugccucugccucccaagugcugggauuaaaggugugcuccaccaucacccggcugauucauuuuuaaaacauguauuuauauacuuauugagagggagggagaaggagugggggaagagagagagagagagagaaagagagaauauaugaauaagaguagguauaggugugggggcaugcaugccacaucuugcauaugguggccagaaggcaucuugugagaacugauucucgccuaccaugcagguuuccgguugugaacucagggccccaggcuugguggcagguaggugccuuugccagccgagccaucuagccagcccuuaauuuauuuucaguacgcgugguauagaacauuauauaauacguagcuaaugcuguauagucucucuauaaaaaaagaaacugccguuguguuugagaaaccagaguuauuugucaucugcaaagggauagcuauaaauagaaaggcaaaggcgguuuuaaaauuccagcuggcugccauugucugcuggaggcuuggggccuaacuaaggcuugagguuuguugggaagaaagccuucaguaagugcuagugagggguuaaaaauagaucaucagugcugcacuguguucgaggccccggggugggggaccugcggauaagcucaucugcucacugucaccugaugggucucccucgacguuccugcucccuccuuacauugggaaucgcuccuuuauauggugguguucaggcggcugucaggguggaggguccugagugugguuuacugcuggagaagaggucacugagucugacccucacccugggcauaagaugaacaugguguaggaggucaggaggaaugggacuggcguucauuucaugccagcccuuaaagggugaugcaggcagaccgauguagugagguuuggagaaaggcucagccuaaguccuuuuuggauuggauagaacguuuccuguuucggcgaagacccggcaggaagaaagucuccucugcagagagggacccacugucuuucuguuguguagauggucgaccuaccggaguucuguaggaugggaugaugcggugacagggugaccaccuuuucugugugccgugcuugucccuguguaauugacaaggagaacugagggaugagagguugagggacuauagcauaggguguucagagcuccgagaaaacaaagaugcaucuuagugggcaacaaacaccuccaugggggagggggcuccccacgugguguuggggguuaggcaguggagcagggauguggucagguuggccaggucccucggucagccuaaucccccuuuggucuagauucuauaaaggacccugcugcaucgguuguggccacuccuucacaggaagugggaaacacaacaggcuugggguuccaggaagucuuaccggcucccuuauuacaccuuccccaccaggaaccaggauuaucuaugaccggaaauuucugauggagugucggaacucaccuguggccaaaacacccccaaaggaccugccagccauuccuggggucacuagcccuaccagcgaugagccucccaugcaagccagccagagccaacugcccagcagcccggaagauaagcgggcaggcggugaguccuguccagguccugaacuggaaggaggauugucuguucucaggaauuccacauuucagggagagggugaugguggcuguccaccuuuugaggagcagcuguagagagacaagaggguggggggcgggugggaagugggacucucuuugguggagggucuacaagcuccaaggaacucaaagaucucaugcaucagguaauuaggaggagaucuaaaaugacaguggcuuucuccagcaccuuccaucggccccucucccuguaucaucgcucacaaaguaccacucuuagaacccagcagcuaucccugaguucuugaugcaaggagacaauuuaucagauaucaugcgguguacuuccuuccccucuaggaaauuacaugucugcaagauaaaaacaauaaaccuggguaccuccuggcacguuuacuggucauuaaauggauuguggauggagacaggcagacaauggcuccuauugucacggaagcuuugacauuuauaucuaggucuuuccugguuuccccuccucccaaaaacaaucaaaacagccacccugccaggcagugggagcgaguuguaguggcagaacaccugagcucuccacugugggacuggguugcacaagcauguucacauccucuuggucugggggccaccucugacucuccacccugaaggcagagcucaagucucagacagggagcugaugacaccccccauggcccuguagguugugauuccuguagcugucuucagacacuccagaagagggccucagaucucauuacuaaugguugugagccaccauguguuugcugggauuugaagucaggaacuucagaagagcagucagugaucuuaaccgcugagccaucucuccagccccugggauuucuaauuaccccaggaguucagcagcccaagacaaacaauauuuauucuguuagacugagauggacauggggaaagugaauagcaauaagaaggcagauuugacugccugcagagagcgaugugacaagcgguugccaagcuacacgugugggucccugcagugucuucaaggguggagggauuccccagucuuugcacagaacucucaccuuuaccuucccaccucaaaccaaagaugauagaggauggaguugugaccgcuaacugaaggcugucauuuacccuugcuggcacacugacgacagcuccuagauucugaugguauuuuagcucucaacccucaagaguggcuugguugccccauagaguuagguggugguagugguguugguguggguguacuuuuaaauuuccuuaacuggacacaggacacaaagcuccaccccuuggaccacguauuaaaaaucggauucaugggaaauugagcagugucacugcccuccugaggaagcugauuccuaagcccagucaacuucucuuguuucucuuccucagcaugcucuuuccaguugaccugugagaauaacaaaagaugacaccucucucuggacuccuaagacuggagcgguuccauuugccacuuguuuauuggcugucugucuccucucuccacaggugaagagucacaauuugagauggacauuuaagggaccagccguaggacgcaaugaugcuucuaugucccccaaggcccuugggaggagagcugcacagcauucaggccucauaccaggcagacacugggugugggucggccacccaguccugcuccucacucagggugccagcucugccuugaauuuugugaacaccagcacauaccuccuugugccucugucuauaccgagcugcuacugcaggggaaugacucucacucacacccucccugcauggagcuccagcgaguggacucagaggagucuaucagaaugaucuggcaauccuagccccagccuccggagcacacccaucuuuccuuaggcuggguuaccugggaaagccacacuuuuacuucuuucccugacaggaaauaaaagccacauuuacccuaggcccgcccacagcugggcccugucugaacuguuuuccacucgaaaugacgacaugauuacuauucucuguccaguguuuauggugugauuucccuguacaauauuuuuuaaaaagauuuauuuuauguauaugaguaaucuaucuaucugucugccugucugucugucuaucaucuuucuaucaucuauuuaucuaucuaucuaucuaucuaucuaucugucuuucuaucaucugucugucugucuaucuaucuaucuaucuaucuaucuaucuaucuaucuaucuaucuaucaucugucucuaucuaucuaucuaucuaucuaucuaucuaucuaucuaucuaucuaucuaucuaucuaucuaucuaucuaucaaucaucugucuugucugucugucugucuaucuaucuaucuaucuaucuaucuaucuaucuaucuaucuaucuaucuaucuaucaucugucuugucugucugucugucugucuaucuaucuaucuaucuaucuaucuaucuaucuaucuaucuaucuaucuaucuaucuaucuaucuaucuacuaucuaucuauauagaugguagugagccaucaugugguugcugggaacugaccucaggaccucugcucgcuccgaaaauuuauuuauuauuauauguuagguagacuguagcugucuucagaugcaccagaagagggcaucaggucccauuacagaugguugugagccacuuugugguugcugggauuuguacucagaaccuucagaagagcagucagugcucuuaacuguugagccaucucuccagcccccuuuacauuaucauaugugcuuguuauaccagcacucugggucagcagagcaugccuuacugucaauuuacagcugagaggucuggcugaagcuagcccucuaugggccuggaccagaacgcugcaggucuguaauuauuuuuaguagcagcaaguguuaccuuuguccagugagauggucaccuuuccucugagccugggccaguguagagccuucgguccacaucagaacaguaugucaaucaucucugugugugcugcuguggggggugcagaggagauaauagauaauaggauuuuacugagguauaccauguacccauuaaaaaagguagcaugaagucaauugca

SEQ ID NO: 4376 - RNA, 1158 nt, Mus musculus
uugcaauaaaccuuuccuauauuuuauuugcauaaucuuuauuauacaaaauaagauucuauguuacacauucauacuuccccuaagggugcaguccuauucuuuaacuuuccuguuggcgaccugcaaugauccaugccucaaaugcagcaucuucucaaugggcaaaagcugaugcagccaauucuagaaagcucuauauguccugcccacaaagagguucuuggcauuauuugaacaagggcugcuggggacaaaaugacagcaugucauugcagucaacagugacauccucugcgagcacaaccaguccuccgaguagagacacgccaacuugguggaacaauaccccaagccuccgaucauccuggucuuugguccggccucggccagggccuuaggggaccucuguauccauuguauaaaucugaaugagaucagacacaauacugguaaagucaucacuaaauaccugcuaccaaggcuucucggccucacccucugcaggcaccucgaccccguaaaccuguugggccagguagagcacagccagggcuaggugcugagccuggaagcagaggcauagccccccgccucccccccccccaugguagcuaucucguggcagagcccaagcuguaacagagauggggguucauugccagcuguaacgauucagccaguucuugagggaaaucaaguaguucagcagguacuuguguggaugcuggaaagagacuuggaagcucagaacucguagcauaagaaguucacauuguacaaugcugucucauagcucccagaagcgggaauccagcuccaacggcucacugcccgggguaaaggaccugugugguacguugaugaugucacgaguaagcaaguguugcuccucuacuuuuccggccaaguuaacugaagacauggcgaccagguagaggccauaugcauccagguugaucucacaggagaacuuacaauaaauggugaacuuuguggagauggggauggaccgcaugccuagcuugaugccugccuccagauggaccggguuacucggaagugcacccucgccuagggaaccggccucuccuuggcacuccgcggcgccaucaaccguucgcagcugucuggccgaacagccuucaugagacccac

SEQ ID NO: 4377 - RNA, 1187 nt, Mus musculus
uaggugcaggaacuuuauugaugguguucaagagaguagggagggcucccuaggccccuccuguuauggggaucuggggugaaaguugugagggagaugcucaguguugggggucaaguugugauagggacuccucagcaaccgagggccucucucuugcucucaguguccuugcuggggugggugguccaggguuucuuacucccuggaggccauguaggccauaagguccaccacccuguugcuguagccguauucauuaucauaccaggaaaugagcuugacaaaguugucauugagagcaaugccagccccggcaucgaagguggaagagugagaguugcuguugaagucgcaggagacaaccugguucucaggguagcccaagaugcccuucagugggcccucagaugucugcuucaccgccuucuggauguuuuggcagguuuuuccagggggcacgucagauccacgacgaacacauugggggugggaacauggaaggccaugccagugagcuucccguugagcucugggaugaucuugcccacagccuuggaagcaccaguggaugcagggaugauguucugggcagccccacggccacagcuuuccagagggaccauccacagucuucugaguagcagugauggcaugggauugugagcccuuccacgaugccaaaguugucauggaugaccuuggccagggggggcuaagcaguugguggugcaggaugcagugcugacaaucuugagugaguugucauauuucucaugguuaacacacaucacaaacaugggggcaucguccgaaggggcagagaugaugacccuuuuggcucuacccuucaagugggacccggccuucuccaugguggugaagacaccaguagacuccacgacauacucagcaccggccucaccccauuugauguuagcggggucucgcuccuggaagauggugaugggcuuccaauugaugacaagcuucccauucucggccuugacugugccuuuaauuugccacggguggagucauacuagaauauguagaccauguaguugagaucaaugaagggauuguugauguuaacaacccccacuuugccauguggagagcagauggcagcccuggugaccaggcgcccaauacagccaaauccauucacaccgaccuucaccauu

SEQ ID NO: 4378 - RNA, 1417 nt, Mus musculus
uugcacucuggcuccugaagauguaagcaauaaagcuuugccgcagaagauucugguuuguugcgucuuuccuggccggucgugagaacgcguuauuaacaaguggugccgaaacccgggacaagagacaccuucaggcaagagugaagacccccugcuacauggaggauucagaacugcaucacggggaaggagugguuaauaaagguucucauaaaacagacuguugagaaggaucuggcguggauucagaacucuucagcuggggaacgguacugaugaagagaaagaagaaagaugaaggcugaauaaacugcuguuagaaggacugguggucgcgucguucuugcuggucgagagcgggcgcgacaauugguggccccuauggggaaccgacucccccaccgaguucagaacuuucagcagucagugguugccggcaggguaaguucacagugagugaaacuugcgacuccaggacuuugggaaggaccucggauaaaauagaggugagcauaaaguugccaggaaguaggcacaaaguaacccaggaguuugggaaggaccucugauaaaauagaggugagcauaaaguugccagcaagcaggcacaagguaacgaaagguucccggcuuugggacaaguuaagguuccugguuuggggacaaguuaaggaacuaugauaaccucaguguagugaucaauagauccucgcuguguaguuaugcuuuuuucucccauugacccuuuguggguaggucugauaguuuuggucuuguuuguucugauauauggacucuguuacuguuugaaacuguguguagaggcagucaagacaggucagaaaauccuuacagagcaacaagaaaguaugucggaagaggagaagggcuuaaaaagaaaaaggaaaaagaaaggagacacaguguuaucagguggacagaaaggacaaaauaaaagagccgagguggaggaggaaggcgaauuagcuuuugcgccgccucccuaugccuccucagcagccaccuguagguggaccuucugucuggagauuuggagaggaucgaccagaucugguauugacgugggcgagagggucuguuuguguguuuccacaggaccagacggaaccucuuugggugccggagagauuggugagacgcuacaagaaugaggcuccugauccaguugccccuguggaugugguggauauucccacaagcacaaaggauggagcugagaugggagauccuuucgguauuccagaagccgauaccagcucgacaugacauucaaauuuuuccacgcuuuuugaucccugaauuccccuuaaagagauagccccgcuggcuaucuaucccuugcuucagggaagaugaguggggaugagagcccugggauguaugcuuguuauag

SEQ ID NO: 4379 - RNA, 6629 nt, Mus musculus
ccgcccucacuucuuuuuuuuuuuuuuuuuuacagguggaagaggguaaauaguuuuaauguguaacaggacgaauggcaaggacaagacccccaagacccaguccuucuccagugaauccuuggagcucacacgccugggaaauccaugccugccccagcccuaagguucccaggucccaggaaaggaaguugaguggcuaggggcucaauugcaagaguucaggaaggcaaacccaggaacuaguugaauuuggccuuggagaaauccaucucugggugcugguccaugaacuucuucaggauuuccuguuucuucugcucaucagaggugggcaagcccauggacuucugccucuggucauacaucaucuuuuccaccaugcugcgagucucacugucgaggucugauagcuuggaguucucaggguuaaucuucuugguauugauuucggggucacugguaaccaagcgguuccaccauuccaucuuauugaucuucuccagaugcacugucaccaccuugccauccucgaugagccacgagcucuccuccaccuugacuucauuguagaguucuccaucaaccacugguggcuguccuuuaaggcccacccggagugccgcuggauguccaccaccacauccuuucccuucagccggaagcugacccggaagggcacugccagauccaguucugccagggucuggguccagcgguaguugggcaggucagccccauugccuagguugggcuucaguuuuccuuuguccuucucauccuccucguccuccucggauaauucuccuuaaaagggacgggguucuggcacucccucucuucgucucucuucgucucuucgucucuuucucucuuucucuuugucuuuuccucugcucucuuccucugcucucugcccccccccucugccucucucucugcgucucucugcaucucucucucucuuccucucugccucucucugccgugcucuuccucucuugcuccugaguaagcaauaaagcuuugccgcagaagauucuggcuuguugcgucuuuccuggccggucgagaacgcgcguaagauuagacaaccauaagaaccaggguuuggaucccagcauucauugcaacaaaccaggugucuggugcacaccugaaaccuucgcuccaagcuguagagauauaggaggaucgccguggcuugcuugcuucuagccuagaugagaaaccugcagccccaggcucagggagagaccccaucucaaagaaacaggaagagagugacagaggacgaugugugcacaugucauacaccuucacacucaguugugaauacacauacacacagacacauauaugcacacacagauaaauaaugaagacaugagucuuuaaaagcaaaggcauucuaaacauagguuuaaagcaccagauguagcagagagacacugaaggaauuagagcugcccaagagcaguucucagaagugagugacacucccuugucuguacaauggcccugcagaagccuugcuggcuucugaaguuuuaucuccagaggguugcuagggaauuuagaaaugaaaccccacgcucauuccugaggugugccugacagacggguucacucucaguaagguaaaacucuaagucagagagaugcaaggugacaaaucuuccuuaagguuaacaaaaauacauuguccuauuuaugagaucuguagagaauacacgggaaggggcugaggccauucugaguuaguuuacccucagaccuuaagccucauuuucugcucuuucaacauuuuuauuuuaaaaaauauucugcauaaauauuaucuucuuguuggugauuuuuguagcaagaaucauuguacuagaauccuucuuuucaccccaacucugggggagagauuucucuccuucuuuauauucccacaauuucugcacuuuuauucucuuuguucauucaucacaauuaccuucugaguccuuauauuguaaggaccauuugaguauuuuuaaagaauaaaggcucucuucauugagagacaguaagcauaaugaagauacuaaaugauguagggguggagggauuaguaaggauagugcacugcaauugaggugaaggaguguuaagaaguaggguaagauaagcacugucucaaagucucagaaauccuauuuaagaauggaauuggcacccaggaggucuaugaaugugucgugggacugcggcaacaaugcauuagaaauguauaauuuagaggaaacagggacagccacccucacacugcucucugcccccagaguuccuugcugcccaaggaggaaugaaugaacuaggaucccugagcauccuccagcaucuguucuuguccaucuucaccauaaucaugcuacuaauggguaaagcaacagagagaagagaaaaagagacuacaaaauacagagagggggcucucgaugguuaccuaagguagacuaaaaugaaacugaaacacuuuuguaccauuguaguuggauuucaaguauuccuugucuuuauggaugaaagauaguaauaaucauuuuuaaauaaacaugaugcauauuuaauagucaguguuucaagagccauauagcuucaugugggggacauacugcaauagacgauagaguugucaggaacuggauuuuauguuagaucaauuagauucaugguucaauaauuuuccauuggguuggaggccauguuuuccaaguccuuuuguugguagcaucacauccucuucugugagaugcacuauuuacuugccauaggaaaaggcaggcuaccuaaaacucacugcuuggugcuuaaaauaucccucaggaaauucugguuaauggaguaucuucagaaugccuagcuaagguccuggguucaaggacuccuaguuacagugugacauugguucccaggagauggcacuuuucaggaaggcucagcugggugggaacaaagcugcccuggccuugaacuuggagcugccagcagcugacguccaggcacugagugugggcugugccuguggcuguauggacagugcuaggauuacugcuggccuccaugcccugcccagcuuaugauugcaacacuugccugcuuucguuucaucauggaauaguuuauugcuggcuuccggaaguaguucagaucaauagcuucugggggagagaaugguuugggacaaaguuuucuuuggaaauucaugucuucucagaauuauaagcaaaaauacugaggagcaauuucagacgacuuuggguuguuuggcuacaaaauacaaugagggcaagaguacagaagccuagcuagcucauucuacuugccccgugacuucagguucugcaacacaguaacuugcucugagauccccaccacuuuagaggagagagcuaugcagugggcuuauuuaccuuagauuuccucccucucuucagcauaucaacagucauucagaagaauuugcaccaauuucaauuugcugcuuuccaccuaacuucacucugcuuucugccugucaucucaguaagaggacuguuuuccugucuagaaacgaaagcuugcuugguccugugaagguucuaugccccaguguaggggaaugccagggccaggaagcuggugugggucaguuggugagcagggggagggaggggguaugggggguuuucggaaggaaaccaggaaaagggacauuugaaauuuaaauaaaguaaauaucuaauuaaaaaaaagaaaugaaaaaaagcaaaaaagcauguuuaucuuguacaacauauauacauaugcauauauguguuuaucucauacagaauguguauauauauauauguguguguguguauauauauauauauauauauauauauauauauauauauauauauauauauaaguauauauaccuaugccauacuuacauaugccucucuguucuugcccaagaccccugaccacauuagaucguauuguuuucaaagcaaccaaggauauucucagagaagcugaaguagaaguagaagagagaaaguauugcuuuucauaauaaaacaggcaacaacagcuuuacaggaggaccugcugagggaauuguaauguaaugaauauauaaaauacuuuaaugagugaggauccuuaagcucauuuaagaaaaaagaauuuaaaaacaugauuagagaaaagccuagguuuauuuagauauaggucagaguuugagucccgaguaaacacagugccuuaauuuguagaugaaucaccugcuaaguggcuaagugaugagauucauuuguggagaugaaaugaguucucugaaggcugcuucuguagcaaagguguggauccaacuugcaguuuagcgcguugaucugcuuugcagcagcgccaccugucaguaaugaguaacaggggaggaucgaugcaaauugcagauuucagaguuugaccaguauuguuccucacugcagaaaggcaaugcaacuagggauggucauuuugaaccugcccuggcauacucuccacggggagcugagggagagguuguuggcucugggaaugaacucacauacauggaaggacaaugagaggaucuucaggcuacuugaagugaugucuguggcuuucaagcuccauguuacuaacaaauacuaacaaagauuccucucucagcaggacccaccaaaggucaugagcucuaagcaucgcugggggagcuagcugugcucugcagaugcauccuagcaccgauauuucagaggucugauggcagguuucaaaugacauucugaaauacuuucuaucuccaugucuuagguugaaugaugccagcugaacagauuacuuuccacgaauaucuguuaggcaauuggaauguuacugauuuaaauaauaauaauaaaguaauaaaaagaaugcauguagcuguuuccuuaauauuuuauucuaaauguaagguuaagucaugccacuugcauuuauaucuuucuuuauuugguaaugggagaggggaaaacagauacuagucaaauuauuguucacauuuuccuuuggaaaucauucaauuaugcugcuguuaggauugaccaacucgccucaauuucaaguggaaggaauguggguggguaauuuuggauuuccagagaggaccccaugagggugguugaugaggaugacagagauuguuuauauuuauuuuauuauguacucagaccucaaggagaaauugguugacugucagcauggaaaugaucaugaucaacuaguuauuggccuauaucuaagcauccccaaguaccaaacaggagucacuaauccguuaucaauacuccuucaucaggaucauuuccuacuuaggaauccaaggaaaguagagagacaugacagaagucaagucauuucuuauuguauagacagaaaacaaucaacaaaauggauaagauaaagggugcuacaucaugguguugaccaguaaaagagguauuuaaaaguauuuaucucuaacaccugguuuuuauuaauauacagagaaucuucccuaccuguucuucagaacccauucuagacucaagcaugcuugaucaugcuuaccaugagcaaagcauuacuaaucaugaguccccuucauacugaauguccauuuagcccaggcuaugucagaauacuugcucugucuuucugguaucaacugccugugucaaaagaauaagugucagugaaggccaaacauuaagcagagacaaaucagccaaacacacacacacacacacacacacacacacacacacaccucucacaacaaacaagcauauuuuauuguauauuugaaaauuuaaaacaccacuaaaaauugaaucauuauuugaauaauguauggaacagguugugaacuuuggagggaaauuuuaugcauacagacaaaauauauacacauugaaauuaacaaucagaggagaaauaauaguauggaaaacaguacagaaccagauaggaggcaaaaaucaacugacaaguggguggucauuuccauuggucaacaucaugacaugguggcucauuuguuccauuugagugucuucugucuauagaauaagaaaggacuucuuucaugucucucuacuuuucuuggauuucuaaguaggaaaugaucucaaugaaugaguauugauggcagaggaguggcuaguguuggcuucauggggaugcucaguuauaggccaauaacucagcacuguguagggcugagaagaggacacugacaaucaagacaagugaagagaguucaugggcuuuaagaauggauacuauugaaacggugaugucaccacccuuucuguauuguuaaguuuauucuucagaguuauuucacuuugaucuuucagugcauuuuccaaagcaagugguuuugugcguuuaauucaagagagccugagaauaaaucauaaacuaugacaacaguacaaggcagcuuucaacucuaaccucuucaaagagcugagauaagugaccaacaauagagaaacagaagcacaucuuugaugagucgaagcguaccuggaggaccaugggacguuguuuugaaaggaaaacgcacaacuugagccauc

SEQ ID NO: 4380 - RNA, 9309 nt, Mus musculus
guuuguggugucuauguguauuuauaugaaaaucaaaaagacuaauuucucauuuuuaccacaauuagaagucuccaguuuaaaggaacaugaaaagaaauccauaccccaaaauauguagagcuagagcauggcuugcuguuuuucaguuuauuuggccaucgcacggcagcccuuguguuggucuguuuuccagccaaagguccaccuggaguuguuuuggcuagaaugaaggagguucuuccgagccagcccacuacuuacaagcaugggacaguucucaguuaacaccuguucugauggaggcacccuccccuagggccaugcagucucucaucuuuugaguaugugacaaaagaauaaaggcuguggggaaacagguuuuacagaaaucaaugcccguuugcucucauguuucagggucuucuggcuaaaauugcaguauccugugaagacagcacaguggugagcugcaucaggaaggugcagcagggcucugcagauucuccuggcgaugacacugaaggugacuaaccagcaggaaaggccgcucuccuuaucccagaucacauggauguaguuauggggguaaaaaucuauuuuuguauuaaaauauuauaaguugaaauuuuuaucucuucuauuuguccacauaagaaaaguugagugagaaaaaaauugaaauccugacauuucuaaguaauuuagaaauauuuacagccagugccauuccagcuccaggaauucaucuguuagauuccuugggcucaagcuguuacagcauguguuauaaaaauacgccucucaacucaaggcucuucauacucacuccagauuucggcuccacugaagugacauaaauauuaacaauauaaauacuuuaggaaacagaacacacaagagcacagcugccagugugaagggaacucauguggcuuugacuuuggccaugggcucugucuccuguucauacucuauuuccacauaggcccguuuuuuccguaaagguccuuucaagggugcuuugccuuugugcuuagccuuaugagccucuucaucauuggaggauucaucauccuggucuuccucacugucaguauucaguuuauccauauccuaauauguagaaacagagagucagaccagggaaagugcaagccuucuccuacgccccucauugcgcagcugguucaaaacaaaccaugcguuuguuccuuugcuccuguguucagacccacuccccuauccccccuuccuugcuguggccacaagccauucuuuaucccacagagcucaccucaaagucacucaggucacucuccuccaccuccucaucuucuacaaacucucuuuuccccacauccuagaaggaaacagucacuggguuaggaauaaugguacugaagauugagucuuaacaucuagguuuaccucguuccauaaagugagucagucugcacacacagccaccaaaaccuauuacucucaagguucacacauacaaauuaaaaggaaaaaucagggacacauguaaaagucaacacagaaucaucacaagauacaaaaggugauggaaauaaugucgccucugggaacaaaaaaaaaaaauuugggaacaaaauacccauggaaggaguuacagagacaaaguuuggagcugagacgaaaggauggaccaucuagagacugccauauccggggaucuaucccauaaucagccuccaaacgcugacaccauugcauacacuagcaagauuuugcugaaaggacccugauacagcugucucuugugacacuaugcuggggccuagcaaauacauaaguggaugcucauagucagcuauugaauggaucacagggcccccaauggaggagcuagagaaaguacccaaggagcuaaagggaucugcaauccuauagguggaacaauaugaacuaaccaguacccccggagcucgugucucuagcugcauauguagcagaagauggccuagucagccaucaguagaaagagaagcuuuauaugccucaguacaggggaacaccagggccaagaagugggagugggugugggggggaaugggugggggagagugggggggacuuuugggauagcauuggaaauguaaaugaaaugaauaccuaauaaaguaaauaauaaauaaacacacacacacaaaaauaaugucgccucugaauuacaugaaaacguguuguccugcaggucacuacauuucaaaacaagacaaaucauauucaccucuucuucgucuucaucuucuucuucuucuucaucuucagagucacuuucugcuuccuguuucucuagggccuugucgaaggcauggauggggaaguuguagaugucgccauacugaagaagaaacacagaccaccuuuaacuaugccugaguaucacaccuuuccaaguuccucugcucuacaaucaggggccaaguaagagaacagugaugaacuauauuucuauaguuuuccagccuggguacagaaugcuuuugucacuaguaaucuaagcugagaagaaauagugacuuuuuaaaaaagagacuuuuuauuuuaaaaacccuuaaaagauuagagaacuacacagaaacaaaagcucuaggcauugaggcuggggcagagcucaccacauaugaauucucagguccaacaccaacaucauucacaccggacauggugacagacacuuguaauacagcacaguuggaggcaagaggaccaagaauucauacucaucuuuugcuacaucuuuugaaucuaaggccagucugggauaucauuagguauggacucaaaacaacaagauacacuauagggaguggggaaggugccaaaaugagugaggugcugaaugacuauauauaccagggaccccaggccccagacuccaacagcaaagccgccuccucagggauggcaaagccacccuuggucugagugcaaacguugacaagauguggagaaaaugugucauaguucagccucucccaguauuuagggucugaaguauucccacuagagauacugcuacugagauuaguuaaaccugucuccucaaccuagucguauccauaaaccugcauccuuauuuaucuauaagccauucccuuguucagcuguaugaaauaaccugucucccugagagucagcucuguauaauaaaaugcugccaaacauccaagagacucagcuuugucuucccaguccaucucagcacagcuuucugccugucuuuucauccccuugcugccccaagucaggucugugccuggaggcugugcauggacaggggaaaacaaaacgaaacccagaagaccaaaaccuaugacuguuaggaugcuuuuauacacaacuuggaaagaucaacuagagauaacagccaagaggaaagucucaucaggaagacaggccuacacacagacuugcuuuacucuguggacaaacuggggugcaaaggcuaucugugauauuuuaaaaaauacugcacuuuucguauuuccuagcagguaagaaaacacuugucacaacacuacuagguuucucaccguaucuuguuucagucucuccagcaauuccuucucaauagcauuguccagcugggcagcuauuaaugcuuuuuccuguaagaaaagaccaaaccauuacuccaucaggacucacuuuccagccuguacacauacaguccccuauguuuaauaaggguaugacgugguuguauaccagcaaggcuuuugcuuuucuagccagauacacuucuuucucucucaaagccucuugggagcuuuucaauuagaaguucccuucuauaauuugcauaaauguauccaguaaauaaaaugaaaauaauucuuaugacuucagcaacagcacucugaauuucuaacaaacccuugauagauguauuauacauauugacuuauauccauuuaagaaugucacauaggccaagguagauggcucagugggugaaauaccuggcucaccaaugugaggaucugagucugagcucucagaacacauguagaaaaccaggcgugauggcauacaccuguaagggggccaauagcaagagaggaggcauagggagguggagcccuagaagcuuguggaaaagauccuggcccacagaguucaagccaggaaagaucuccucucaaacagaaugcaaggaaccugaggacugucacccaacuuccacaugcaugcuaugccaugcauguaugcagugcaaacacacuaaguaagaaauacauuagguggauaaaaaagaagcucagaaaguacuuaauaaugagcccucugaauucauacagaaaaaguguauuuauucugaaacaucugcaagaauguuugagaguaaggaaauguggaaacuaacuagcuggucuugaauaaaaaugggugcaugauuagcaaaguguaaaaaacugacaaugacugcaguguguggugauacacaccuguaaucccaggccaguuuaggucacagagcaagaagcugucuuagacaccgaugaaauaguacauuugagacagaaaguuucacgugaugagugagaauaaaaguacaacuauuccggaggaagguguuccuuagaaggacagaacagagcggcaaacgcugaggacugcagauggaccuguugggaagagcugacucccaaguguagguccugaggaccauugaagcucggcucaacucaacugucacuaucugugagauggccugauagauuaugcucugggcaaagcuggaagagcaggccuucuccaugcauauuaccaucaccauccuuaggaaccaagccacccagguuacuugagagcagcuuaaucugagaucaacauguauccaguuuucuguuuuguuacaaacaaaugcaaucucacaaucgaacccuuccauuuucuaaauaauauaaccaaaauagccauaagacuaaagauauugucuaaacucugcagaagguaauguaaguagaagacagaaagugucaaagucuaaauuauggaacguuuugaccugaagaccuuuagauagagcuguccauacucuuuuuauuauacucgaacaccuuagaguaccuuauuuucagccuucagugaaaaucuuaaaaaucugaagauacaaagaggccacuccccacuagugacacguuauuaugaaucacaugcaaaaaacaacuuucuuacauaauaaagaaacauguaaacaucagaacagcuuauuaccucucuucguuuuucccuucguucaaccuucuuacucaaaggaacaagcuuccuccuagcagaaaccaaacacaguauuagaaaauucagguucauuuuaaagauaaaagaauuagaauugaucuuuugcugcuuagauccauauaguauguaagagccuagauauucagacugcuaguacagcucagugacugaacacgcgcuuggcacaugcacacauuucuacagccuagguagcagcucacaccaguaauucagcaugguuggugaggcagagggaucucugaguugaaagcuacauaguaaguuccaggccagcuugacuacaaggugaaauguugucuuaacccuguaccaagucagguauuuugacauguauuucuuuuaagacuuauuuauuuuauguagggcaucagaacccaguuacaggugguugugagccaucaucuguggcgguugcugggaacugaacucagaaccucaggaagaaggaagaacaguuagugaucuuaacgacaacaguccccuugacauauauuuaauguggucauuucuguuuacuuuagguucacuauaguaagaucaaugcuucaaugaacaaagaaauaugaauuuucugaaaaagauucacaugaucuuuaauaugcucugcuagucucaauaaaaaagacuucaucuuuacacuccuuuuuuuuuuuuuuucgagacaggguuucucuguguagcccuggcuguccuggaacucacucuguagaccaggcuggccuugaacucagaaauccgccugccucugccuccuaagugcugggauuaaaggcaugcgccaccaugcucagcucccuguuaaucacauuuuaaaucuuuaauuuuagcuuuucucagggaaucacacagaauuucuagguagccaggguuaucacauauucuguuuuaaaauccugcaggaccaccggacacaccuuuaaucccaaguuuuucuuggcauaucaucaaagcuuugucauagcugaauuuaggaggaaaacaugguuugugacaugguccacagauaguaauagacagaccgugaauaaagaacaagcagggcagggcagugguggugcacaccuuuaaucccagugcuuaggaaguggaggcagguggauuucugaguucaaggccagccuggucuacagagugaguuccaggacagccagggauauagagaaacccugucucgaaaaauuaaaaacaaacaaacaaacaaacaacaccgccccccaaucaaaacccaaaacaacaacaacaaaaacccaaaacaacaacaaaacaaaaacaaucaaaaaugaacaaguugguccuuacugucgcuucaguguaaguuuucugauucgaaucagguacuggguuaucuugguaaaccucugcuuacauuugugucugauaaagcggggccaauagaucagauuuucaucuauuuguuccagugcuuuuucauaguuuuuacuaagccggaccuguggaacagaaagggaaacaugaggaggaagggcaaaucaaguuaggccuucacugucagcccgguaucuaugaggguggcuuucaagugcagagauggccuacauggcaauuuugcuuuugcccaauggucacuagaguuuucucacugaaucuuacccguucccagagacgccugggaaaagcugcucgcucuauaaccuucauguacagguagcacugcccugaagagaaguuagacagcuuuauuauuguuauuuacagaggcuggggacauccguuuauaaauugucguguagcucccguaccuuucucuucuuuaaugguagcauacugacuauuugccagaggacaggacgaccgauugcacagaccagucagacuguauucauuucugcagaagcccugagucuugguucuaggaugcaaggaaagaaauguuuacaaccaagcgggcggccgaacacauuuuagucuaggcugcaaucuacucaccuuauuuugaaagaacaaaacugcuuguuuccuaguguauuccagauuaccugcaagacagaaagaaagcccuuuugcucuggccccaaagaugcuguuuaauauaaaaagaggccgugcucucuggccugcagcuggugcuccauggcucaauccuugcccucacuguaggcuccagcaacaccaccaccaaagcacaaacacacaagaugaugaggaccaugucagagcacauugcugggugucacagugaggaaagggucuuuagggaaugaaaagauagagcuaucuuuuaauaggccucgcucguccccuaacaugaauacauauauucuuauaaacaacaacaaagucgcaagaaaaaccuaaaugcagauacgaccauacccuauuacucagcaacagaaguucauuuauaguuaguaacuacuuccccagaauuauuuucaauacauacauacauucuagcaucuguaguaugcccuuauguauagugugaacaaaaugagcccuaucacauuuacauuguaacuuuuuuuacauguguucauuauccauuguccaauucugcacagcacuagauacuuagauauacacaccaucaucacaaccuuauuaccuucuaccuugucucucuaauguguucugcacucuaaaguaaaggcacugccgucuccaaacacaaacccuggcguuugcuggaugagaacaauccuacgguccuuacaucccggaaccuggugaagugcauaguauauaaaaacggugcaucaaguugcaaucacuaaagccacauaugggggugugugugugagcauaaaggucucuagauggacugcacugaagagccaagaaggacccuagagcaguuaaaggggggaagaacgaagggccaaagaauaaaacacacagggguaaggauuguaggaaacgagaaguggaguggguguauuauucagcuucguggucagaccucuuacacaucauuuggucacaccucuuuccugggcaccggauuugucugugcgcccagcugcccacuuagcaucucuaaaaggaucccgaugguaaacauaccccagugcaacucucauuuucacgcucuucuuaaauuaaaaaaaaaaaaaaauacaacaguucucccuaguucccacuaaaaaagaccuggaaaccauuuccuucaagguucucccugaccuuguccgggcaagccuaucaaauccagucucccccucauccucuggauuccuguaacaaguccuucccuaucucucaucuuuguaccuuuacuauuccuacggcucuucaguggcugccucagucccaauucugggguuuuuagcccaaugugacugaucuaccgcucuuucuccauuacuccucuuucauaguaccguuauucuccauccccagagugcucaugagagcagagguuuuuuugguuuuuuuuaaaugucuuuugcccgacuguuaacaaccaaucaucacacugaaccuacaccaguuggauacuggcuauguacuuacaacucugugaacagacaaacgaagucuuacuuccgaaacuacgccucgggcaggcugcagagcaaaauaaaaagccuaacacuggagagguagcgcucauggaggaguucccuaagcacggauuuuaaacaucgcaucucucccgccuugccaccccgagacaacugccguucagauggcagcuggcacaaagggcuucacugccaagcacuagggacuaaggaagcccacccggcgggcuggggcugggguggccuggccuucuacacgcgcgugggaagccacuaucggaaaucggggcucugcaagucucgccauccgggagaagcggagacaaacgggccgucugagcgugcgggacugaauccuaaaugagcgaaaugccgcgcaaaacccaguggugccaaggcgagaggaggaaaacucacgucguccgacugcauggugccggcagcucagcucgccgcauuaggaaggaccggggaagcggccacgcuucuuccgcggagccacuuccggagagccacuaaccua

SEQ ID NO: 4381 - RNA, 1786 nt, Mus musculus
cuuuagcugcauauguaucaaaagauggccuagucggccaucacugcaaagagaggcacauuggacuugcaaacuuuauaugccccaguacaggggaacgccagggccaaaaagggggaguggguggguaggggauugggggaguggguaugggggaccuuugggauagcauugaaaauguaaaugaggaaaauaacuaauuaaaaaaaaaaaggaagccagagacucaagugcuguaucuguuuaucugaacaauuuauaggcaucuaagugacaggucaucuaauaacacuguuuuucuguuuaguucugcauuguuacauugccagaaaacaauaggcuggauaguuucucuuuaaauccccauagaauucccuucucaguguuauaguuuaaugucuuauccuuggauuuuuuuuuuuuugcuuuguuuuuacugagguuaauguaagaaauacacaguggccuggggagauggcucaauaguuaaaaguacuaccugguuuuccagaagacccacauagauccauauagaagcugacaaccuuucauaacuccaguucugggagauucgcuucucuacaaaaauuaguuuuugugcccuucuugccuauacaauuauccuuuaucuauuuccgugagccucuuuuaagaaaaauguaauuguggaauauaguuccuccucccagcaaauguguguaugcuuccuuuauugaugguuaugcaucuacuuccaugggcuuuaucucccauuguuuaucuuuaucaaucuccccauuuaauaaacuuaaucucucuucuucuacaucauguggaaagguccuuucauugcuauaaagugucuacagaaauauacuaacaucuugggguagacaugccaugcacaauucuuccuuccuuccuuccuuccuuccuuccuuccuuccuuccuuccuuccuuccuuccuuccuuccuuccuuccuuccuucccccacccccccccucucucucucuccauuucuuucuuucauuauuuuuuucuggugucacuucuaguuaaauaaaagacugugacucagagacaguaaguggccugggaggcaccuuacagugacagccacagcagaaugaaugaccgggaguaaauuuuguuaucaguggaagaagcgucggagagcaaaacuaugcuuaaaagggaagcaaaugauuucuggcccacuugaaaacacauauacuaagcuaauugacuaaaaaucgaaaugaacaacaucaaucuuucaacuuaaaggguuggauugaguuuuugaguuaggugucauuuguccauguuuuacuacaugaaugaucucuuaaaaggcccacagaagccauccuuuuguuagggcaaacucccaaaacaauacuccaugucuacaaagagagguuuaaguagcaaaagaauccuuaauuuucagaauugguaauuuagacccaauaguuauuuuaaauucuaauugaaaugauacauuuauugagacaaucuguuauuucucacaguuucauuaguaaaauaauuaaaaauuuaaagacuuuuucuuuguucacaaaaauguauuccacuauuuuaaaagaguuugaaaauggggagggaguggcaggaccuauggcccagugguuaagagcacuuggcuguucuugcugaguacccagauuccaguucccacaaagcaacccacagcccucuguaauuucaguuccaggggaucugaugcccuauuuuauucuccauaggaaaaggcauaguagugguacauagacaugcaugca

SEQ ID NO: 4382 - RNA, 32885 nt, Mus musculus
uagucucaacgcaggugcgggugagucgcgggaaaucacaacccucccgccaccucuccugccggcucucucgcacgccggguccccgcgcgcugucugccgucagggcgcgcccggaggcagagcccgagucccccgucuuuccgcuagcgcggcuggggaggcggggucccaagcccggccccucaggcagcuccccgccucccucccgcccuccccgcggcgucgggccggugcccgaauccaggcagcggccgcaggaggcgcggcggcggcggugggcgccgcaggcgaugccccugccccgcugcuccggcggggggcagagcgcgcggcggcggcggcggcggcggggaaggaggcggggggcggcggcggaggggccgagagcuggcggcggcggcggcgguggucgugaagggcaucggugacggagaugaugugagugucggcuggcugggacccccggggcugccgagccggagcugggcggcuggcagcguacgggaaucggagcgggaggccuggggcggcagaggggaugcugugugcgcggugcggagccggccgaggccggagcgcgagagccgggccagaguagggguuccgggcggcggcagcgggggcagugcggacccaggggcgucugcgauuguucucaacaccccucccccaucccaccccgugugucuguuugucacuugcagcugaagauggaaagagccaggcgaaggggaggcggcggcagcggcggcggccguggccgcggaggcaagaauguagggggcccuggccuaagcaagaguagacucuauccccaggcccagcauucucacuacccccacuacuccgcgucagccaccccuaaucagucugggggcacauccgaaauccaggagcuagccuccaaacguguggacauccagaaaaagagguuuuaccuagacgugaagcagagcucccggggccgcuuccuaaagauagccgaagucuggauagggagaggccggcaggacaauaucagaaagaguaaacugacccucucccugucgguagcagcagagcugaaggacugucuaggcgacuucaucgagcacuaugcccaucugggccugaaaggccacagacaggagcauggccagagcaaagagcaagucuccaggaggcggcagaagcacucugcacccuccccaccggugucaguggggucagaagagcauccucacaguguccucaaaacggacuauauagagagggacaauaggaaauacuaccuggaccuaaaggaaaaccaacgaggucgcuuccuaaggauuagacaaaccaugaugcggggcacuggcaugaucgguuacuuuggccacaguuugggccaggaucagacuauuguccucccagcacaagguaugauugaauuucgugaugccuugguucagcugauugaagacuacggcgaaggagacauagaagaacgaagguguggagacgacgacccacuugaacucccagaggggaccucuuucagaguggacaauaaaagguucuacuuugaugugggcucuaauaaauauggaauuuuccugaagguaagugaggugagaccgccuuaccguaauacuauuacuguuccguucaaagcuuggacaagguuuggggagaauuuuaucaaguaugaagaagagaugaggaaaauuugcaacagccauaaggaaaagagaauggauggccgucgggccaguggugaagaacaagaaugccuggacuagcgugaaauugaacuccagcaggcagaauuuagaaaucaguaauuggcuaaacguacugauccguaaucaugaucauuugaagaaguuucuccucuuuugggcccucuguuauuaguaauaccucuaauaguuuauacuuaaaaggagucugauucucauguuauguuauacauagaucacuauaauucucaugggaauuccaaccuccccagagccaaauaguuuagcugcuucaacugcuccagacuauugaaguaugcagaucagcacagagugugacauucugaccuuuaaucacgauaacuuaagauuuacauugcacuaugacagaaucuugaaaaugaugauacauagacuuaauacaaaagugugaauuucuauuuaacaaaucccacccccaaagaaagucccauacuuuguuaaaaguucguacuuuguuaaaaaguugcaaaguuuaccuguaggaccauuaccacagaaacagagauugaccucaaguguaguauauuucuuuaugaaaguacuaguaggaauauauucucauuggguaacugaguauuaacuaguaccacuaaaauacaaauauuauuagacaauuagaccuuugaaauacaaugucauauuccuuagcaguuacuacuauauacagaauucuauaauuucaaauuuugugguaacccuacaguuuuaguugccauaucaaagccacggaagaguuuuaauucauuauucuagcuaauugcaaucuaaucuucuguuuccuauucuauauauuucauugacuuuccaaaguuuuggaaauuaugcuuaugucacuguugugagggaggcuucacccaguggcuuuguuauggaaauuuugauguuuuaaaacagccuuucaugauaauuuggaauuguuuuuccuuaaaaaucugucaugaacuuucaaaguguauuuuaugcuuucccacucgugcauaaggguuggugcaccagcucacugguguaaagauauaucuacugauauauauuuuuuaguagggcucuuauauuggcugcccuuaaaaccaugucaaacuuacaguauaaaccugacuuuuacacauacuuuuaacuccaaaagaaaaaaguuguuguuuuugguuuugguuuugguuuuuuugcugagaauacaaaauugcagugugggagauauaauauuuggaaacacuauugguuauaaacauuuaaaaggaaaauucaggcauuuuccaaggugcuccuuaagauucucaaagaggcuuacucuacacaagacguauccauccauuugugcuugccuguauuaaaaaucacuuuccagaaagugccaccugaauuuuuagacacucagcaguuuuuaagcaaguggguagauauagcauggacacccacagcaucccuuauuaacugaaugaaauuucaucuguugggcuacaucuuacucuaaacgaaauuguguuuugucgugggaucaguuacugcuccacaguaagucaugugaucacauuuaagagacaggcacugauuucagcugcccagcucgaguccucaugggugagagcuggcugcaaggaccgaggucagaauguggcucuucucugauaugcucuuaaguaauucagcuuugaacaauuuucccuccagaauuuuucucuaaacacauuaaacuaaggucgcuaaggaaaaccgugggacgaauuaagaagauuaaguucauuggcuuuuguuaagaccaagcaacuaguaacccagacauacauacugauguugguugcagauucuauuucacauuucucgaaguacugugauggacucucacucaguucacuccccuugugagccaucuggaucaccauggaacaacaagguuagaagaaaaugucagugcgagcgcuaauagcacaugguggguguugagacuauaaaaguagcaaggauuuuuaaccaguccugacuguaagauaacguaacucuguagacuugauaggaaguagcuugggguauaugaaggaguggugugcacuugaauuacuguacuacugauuguuauugcugcccaucauagugccuguuaauaauaaucaaccugucagauuucggcaaacuggagcugugaauauuccauuacucaguugucccaaucacuauugcugugaguauauacucgcucuuaaaaaucguaucuuccucuuuugaaauauuuauauacguuaggacuaacugauugguuuuuguuuuuuuuuuuuuugguuuuuagucugaugagguuuaaauguguauauacauauguguguauauaccuacgguacuaugucagacaugaagauaaauauauuuaauucacuguauauagauauuauuagcuucauuucauauuaauuauuuaaguaaaggacuagcuaaauagccacauuuucuaccuuauauguauacuucaaaguucuugccaucucaaagcuacagauuggguguguguauguguguguguguguguguauauauauacacacacauauauauacacacacacacacauauauauauauauauauauauauauauauauauauauauaggauugaacauacucuagaagcacuaagacuuuuaccaauccuuuguuuaccuucucauaguuacuauauucauugaaaaaugguaugaugcuaugauuuuuugauacuuaaaauucccaagaguucauuagccauaauugugauccaguucgaacauauggacuuaggauguguguuaccauguaucugauaagcuacuauuuuuaucugugcaauauacauuuuauuuauuguccuuuguaacauaaauggagcugcaaguguacaugguauucuucaaccuaacaggacccucgccucgagggcguucgacuccuauggagacugaugguagaagugaaagugagcauugacaucaguaaccaaaaccacuaguuccuguguaaugcuaaaacacugaugacguuugcacauaguaaucgagcauaauguggacagacuccaacuguaaucauauaagcuaauaguauaaaaucuggaaacggguuccucaguaguuggcagugugcuccuagcaauuaaaagcagcgcuaauacgcugcuuauaugcaaaagaugcaauguauuauaaaaaauucaaguucugccacauuuuauuauuuuuccuucuuaaagccccaaacugccaugucccuuaaaacuugagucaaacacaagcuuauuugcacuaaagagcauggccaaaaaaauaaaugacaggguggaaaagcuauuuagaaccucuugaaaugauugguucuaaugggagaauuucacauuugucuauuugaaagcuauaugguccaggcagacaaucugucaguucacuaauuuaauaaugcacuuuaccuuuuguauauagaagauguacauuuaugccccuuggcaggcaggcuguguuucaguaacuauguaguuagacucuguaggaugaucucuugcaugcacacguuuguguuagaacuauuauaacagguuucuguuaaggcaguguaauggaaaggauggaagaugguuuuaaagcaagucucaauucauuuaacaaggaacuuuaaaguagauuuuguauuuguauuaaagacuagaauaauauaaaacuauuucuaauccagauuaguguugcaguucagacuauaucuacuugagacuucccauaauacuccaaaaauuaaauuagggaaucuagccagauaacuuuuuuaauaauucuguuccauuguuaauauguguuuaaguuacuaauaaaaagacaguacgugcuacagcucuagaauuuaaaguaugguuagcuuauauuuuaaaauucaccagacuaaaguaauaaaguuucaaguaaggaguaugaagagcuuaauacguuacuaaaaaauaaauaggauauuucaaaauuugcaaaaguauuaaccuuuaacaaaucaaaagagaacuggggaauucgguauauccuucuaccccgaacacauuugaaaauguauauuugaaaaacuagauaauuguugcuuaauaauagguuguauguacuuuacugagaaaacacuguguacuaacaauucaucaaggcugugcuauauuuauugcauucauuuuauaucuauagauaagaaacauauauagucauccuaucuuaaucuaaccauguauuuauauuguaauuuugcaaauauuuucaguaaaauaaacauuuaucugagcugcacaguuugaagaggaugaaauuggacuauaaucucagauacucauuuuuaaugagcagcuaccauugaaaacugauguauugucauuucuugagauuuauuuuacaguuuacuuaauauuuaaaugaaugaggcuuaguuugaguuuuaauugguuauuugaaaaugagguuguuguuuuuguuuuuuguuuguuuguuuuuuucuugcuuccuuccaaacaacuuugacugaaacaugaaauccucuuccaaacuuuagauaagggcuuuggugagucaccaccuagucugaagucagucuuuaccaaacaccaaacaucuuugggcaggauauuuugucaaaagaaguuaacauugauucugugccuccagaaugguacagauacaagauuuggcauugccagauaagauucauuaaaaacuuucugaaguuuccugagagaugucuugacuuccauagagaaauuguggcuaauggcuggccugucagaggaagggaauaaggaauuagcauucugcuguaaccaucuguagucuacaguacuauagcaccagaguacaagaaaaauguguuucccaauccuauaucuuacaaaaauuguuuucuagaucacagcaagucuaccauaaagaaaauaugaucaaauaugcauagguagaucuuaggggaaauuuuuacuauuuuuuucuagaaugaggggaaaaucagucuuuguucuuaaucugauaugacauuuuucagccauguggauuuguuuuagugguaaauuuuaacauuuuugaauagagaaaacgauuucuauagcaccauauuuacggacagaggauggagcuggguuagaggaauguuugcccagagugcacaaagcccuggacuugauucccauacacauaagggaaguauaggagcgcacgccuuugucacuucaacacuaaggugaaggcaggaggagcuaaagcugaaggucguccucagcuccaguaacugcagcccgagcugcaugcaguguagcuccaaauaauaauaauaauaugaugcuacaguagacaaucaaaaguagcaaccaguguuaauaauuuguuacucuauccuuuuacagucauucucacauguaaacauguauauacauauauucuuuucaaaugcauaaacacaugacccucccauuccuaauaauaucaacuuuaggucuggcauuuaaggauuuuuuuuucuuuugacuaaaaauaguaaguggaucccauugguacagacuuagauugcagaugucggcauuucuuguuagguguacacauucgcagcuucccauccgaguuuccauccucacaccugcccaccucaccuuccaugucgcucucugugucccucucaaaaaacuacuguuguuuuuccugaaguaacacguuaguucaggaggaucuggauauuaauuaauauagccaaguggccugugagguuaacuguguucucuaauggaaagcucugauauuuaaaagcuuuaacagauuauagcuuucaauuuuuacuaacugugcuacuauuuuuuucauccaaagaccuugccauuaugagcacgugagcauuagaacuguagugacagauuuuauguuauggcuuuguucaaauugcuuaauucauuaacaugaagccuuuuauccauguguuaaggacgguauaaaguuuauuuaacagcuuuugauaugcaugucuacacaaagacacagcacuguuccuaaucauuuaaagcacuauuuuuuuucuugaauuuguuuugagguggauggguguguguguguguguguguguguguguaggggcggggguugggggacuggagaccugaaggccaugccaguguaaggcaagcacucugccacugagccauauucccaaccaugaaaagguugggcuuuuuuuuuuuucuuccccuuguugguuuuuuaaugggucagagaguauaccuuaggaagcuaaggagcuauaaguacaaccgagucaucugcugggagaaugugaaagagcaaauggaucuauuaaaaagcacgguuaggcaaaagaaaacaaaaagaaaagugacaauuauuacuauucaugaaaauacaagcaaaacuacuuuaauaguucuccaauauuacuugcaggggagggggaccauaagucaugcucaucaugugggcacauuaagaccuucucuuuucuguugacuaccaguguggggaauaaaccugagacaggaaauagccuacccucuguccccuucaauuuuacaaaugaaagcaacuugggcaaaagacucaacagaauuagaaauauaucuuaaacauggguuagggauucuuuuaauagauugguaucuguaaacuuccugaaaacaaaauacaaaacuaaaggcucugguuuaaacuuuaugguaauuucugugugguugauaacauaauuucuugcucaaaaaugagagaggcguugucagaaaacaugauccuuucaaacacuuuaaaauccugugugaaucacauauuuaaugaguaacucaccgcccuuuagugaauaugcaaaaccggccacaauuugcauauauugacuuguuuaaauucagauuuuauauauauauaaucuguagcaaaucuucuuucaauaugaacuauacuuaaauuuaggacaaaauaauaacuuccaauuccucuucggaguucccuuguuuuugguaaauuagccuuccuaaguuuuucauguguuuuccguguaaaaauuguuaguuuuauugauaaugacauccgccaacacacagaagcacagaguggucugucagugcugccgcuggggagguccuuaauuaugugagcgugacacaaacagccgcuuucuauagaagagugucuccaucaagauuagucucugauacuugagaguaauuguaugucuuugaguuuccucuuuuuauaccuaguucugacagcuguucuauaaagucuccaaguuuuuaggaaauaauaaaaauugaaaaaagaaagaacggaccauuaaaauuucuuacaguauuuaaguguuugaauuguucaggggguaaguuugaagggauaaaguuuaucuuauuaaucuuuacuaaacuaagguuauaaaucugauugcuuucgcugacuaaagccagaaugucucccauuagaaguaugcuagagaaagugggccugugagcugguacucuuuggaacuguauuuauuauagguucuaugagguugcauaaaaguagcagaaagaaaagaaacagaagggcaguagcugauagauuuuuuaccccuaugacaaaagaaaucaaucuaauguaaagaagagacaucauguauucccauuccccuacuuaggcuuaaacacaggaacagagaaaguaauaagucccaguuccaugauaaaagagcuggcccuaaaggaguaagagugguuguuacauauuaacuacauuuucuuacacuuuguuccaccucugcuuuuuuguuuugaggggaacaguuauaugugaagucucagaguugaaggaguguggcuuguuucuuguauauauucuauaaucaucuuguacauucugcaugacauaggaauuuuuuaaaaccuagcauuacacuauuauuacacauuacauaaacauuguccaaaugccauuccugaaauaauuauagaauacagugcuaagugguauguggcuacugucgucagugucccagagaaugaaguacugacuuugauccucuccuccuuggccauauuaaauaaccuaugauggugaacucacggagggccacuuaccuagcugcagcaagauaggucuguuguguaguucaugaguggagaacuagauacgcaauggucacgagggcauugcuguagacacuaaguccuccacugugccgugccagcaccagccaacaaacaguguuagagagugaugccuuucucaacggacuaucaaagacagcauuuaagagcagcauaccuauagcuuauagaacauaagcacauaaauauuuugauugucuuaaaaauucuacuuuccugaaacaagccaugugauugccuaucuuuggcccaguggugguuugcaguagcaauuuagcuggucuauuuugaacaaauuccauggaauuaauugacuauuguagacaaaguucuuucucuguuuucuccucccucuccucaaaaaagcagauguauuuucaguucucaauugcuucucuuggugucugggaucuaagugggacaugagagagcaguuuaguuuguugguucuuuccauuugucauuaggaugagauuuuuuccucagcuacugucaaacugcagcuuuaccuaaaaauacacacuugaaaugccaaaacuucacaacagaucuaagcauagaaccacaaaacaaugcaccaacaauaaggauaacaauguauacagcuaccuaaguccagagcguuucuugccacuuacucauuugcuucagagucugcuguauuggccuucauguucuucagacuagcaguaagauuuguaccaauaauuucauaaucuugagcucuaacaggaggaaauccauugcuguuuaguaaauguccuaaaaagcuuaccaugcauagguguaaaaagagaauucuagaauucaguuuacuagcaaucuuuucccuccuacacauguacccuacuggaauucagcaagagcaugacuuugucuaccacuguggcccuacuuucacccuacuuauuuuuucauaugacaaucaaagcauaauaaagaucagagccgcucgaugaaauaagcuagcucucuauagacuguaaggaaggaggagcaguccuucacucagccauucuuggcauccuuaccauagauagcuaagaguugaagaugaauagcaaauucaggaucauucuuggcuacauagcaaauuaggccaaucuggacuacauaaaacccucuuuaaaaaaaaaaaaaaaggaaggaaggaaggaaggaagaaaaaugagaaagagcgaaagaaagaaaggaaggaagagaagagaagaauaaaagaaagacagaguuauggaaagaugucaauuggcguuuauuaauagccaauauuggauaccuacuuuauaugacugcauugcaguacccuucauauagacuuucuaauguguauaacugccucauuaacuucauuauaauaaaauuggcuccauauuaccuaacuaguauauuugaaccaagucaacacccaagacaaagauugugcucaaucaguuagggaaggcuauguaagacuuacucagacucugacacacagacgcaugcaucccaacaguaauagaacauagucuggccucccucagcguaaaguagcuucagguuacuggcaacucuuuuacccagaacuguucccuauaaaugggauuauuagccucaccaagagauuuuugcuuaaaggaagaugcauucacucaguuuaaguugcucuucaucaauagagcuuacuugaucuuaaguauagauuauagacugaaccuccaccccuggucaacuuuuaaaguugguaauuuuuaaaggauucggauguugggaccaaugauggagcauccugauuccaucuuuagagacugaaaagacaaagcagugcucacugggguccaugguuucauucucaugaacugaagguaacucucacugggguccaugguuucauucucaugaacugaagguaacucucacugggguccaugguuucauucucaugaacugaagguaacucucacugggguccaugguuucauucucaugaacugaagguaacucucacugggguccaugguuucauucucaugaacuaaagguaacucucacugggguccaugguuucauucucaugaacugaagguaacucucacugggguccaugguuucauucucaugaacugaagguaacuggcuauguuaaaucaguuuggaacuaaaucuuagcaauguuacugagagguuuugcuucuuacaacuuucccugacagcugacugacagcucacccggcccccauacucugcagauauuauuccagucccugucacacuacaggaugggugcuccuuuuacagguccauacuccuccccaguucuuuagggagaugguuuucaaacuucccugagucaccuccagggcuuguuaaaccucaugcccaccugcauuucuguacagugggacuggugaagugagaaauccaaggaugcguguuucuaagacaucccagaagaaaggauguagcugaucuggggaaacuaccuaguacugugauagaugagauucuaucugaccuacaaaaauacuagaagaaaaaaauuagaacuaguacccugcuaccuggacugccuugagauauucacaaaucgaaagcaaaauuuuauaaguugacuagaguuuugauaaaucauuuuauccucuuuuuauacucauuacauuuaauaaccuuucugauucccucucacuuuucaacaccuaucucaagaucuagcuggcagggauggauuauaaagacaugaaaaucaucauucacauaauauggggacugaagcauguucuuaauuuauuaagugauucuugcauauaaaucucaggaaaggaaagugaaugaugacucaaaaauuacugauaaacuuguugaauauaaaaauauuaagaccugaaggaaccuagaaauuacuuuagucuccaaacuugacauuuuguaaucugcaucaugcaauauaugaaugauucauagguuagguaaauagacuuaggggcuuuaaaugcuaauuauuucuugagauauaugugaggcaaaauaaacucauuuccuuuaaaacauaacacuguccucaucaucuuccugagucuucucuguguuuucaagauagaggaacuauauaguggaguuuauguuucuuucuuaguuaacaguuggucccauugcuuucaauguagagauuguuccccuaagcacacauuaaguuuauuaccuuuuaaaaaugaauaacacuucaaaauaacuuacuccauguuugccagccggguagagauuguauaggcagagucuagguggguagguacuuagugaaaauacauagggaacuaaugagaaaagaguugucagacaucuuuuuuaacucagagcuuaagaaaaauaaugugugggacuuuugcauucaacuguguuaauuaggcaaagugaauagagaaauuugguuucaaauugccaaggaucauucaaaaacauuacccccacccaaacacacacacacuuucaccuaucuuuaacuacaaaacaacacaaccaguuuugagggccuguaccucuuugauagaucauuugccaagcacaccccgggucccauccccaaagcuaagauguuuuuaaaggagaaguaguuuuucucagacuuuacuaguuagaugaacuucuuauaacaguuucuacaccacacaaauauauacuauauaugcauauacagagauuccagccccuaagccuugcucuuggaaacuugguuucguaucauuuguuguugaaccuggaagucuguagagagggggagagaagaacauucgugccgaguauaugcuugugugucaucccaacuucaaagcuagaaaagaucgcauuauagcucuaaacagucaacguccagcacaacagcugauacuuacagcaccuauuaccgacucaccuaggacugagucuagcaauucauagaaauuguuuuaaaccaagagccuccuuuuaaaacagcacagaaucuccacugugccuccgaggaacagaaaacucuuuaccaugauaauaacaaaaguauacccuuaaugguuacagcuuauauuugccucggcagaguucuaagcaccauuaaaauaacagcauuuucucccuuuaaaauugaguccaguugggccaacaagacggcucaacaggucagggcacuugcugccuagccuaaugauagaaauucagucgccagaaccuacaugguaaaaggaaagaaccaaacccaguuauagugucaucuccauaacacacacacacacacacacacacacacacacacauauaaaucuauuccaaaaauuuaaaguccagugggacucagacauuaguugacauggcauauuaacaaggucaguuuggauucucaucuacagggaucgugacugacgaguuaacauuuugaauuguauuguucaugucuuauucuaauuaucuggaugcuuagaggugguggugguugugaugaugguaguagcagugguuguuacaagaucuuguguuguccagggcaaccucacacuaucuagguaauuugagcugaccucacacuccugcuccuaccgacucugccuacagagugugggaaacacaggugccagccaccgccaccaccuccaguugaaagcucuucauugccaucacuucaaacugaaaacuuugauuucuuuuuuucucgcugaaauugcuuacauuuagauacuauggcgugacauuguggaagguggucuucuuauuuuuaauaguguuaaauaauauuuauugcuugcuuuaaacacacagaacccugaggccuaaauccagguguuuaguuaguagugucgcauuggccagcuucuuugauauagcuggagaauacggaggacaccaaaugucugccuccacuauucuccccacccugcaagcucaaguuccaaaggcccuuucucaccaucaaccccguuucugaaauucuaugcagccugaguucauuaauccuuuucagucucucacaacuugacccucuaauucucauaacauuuuuaucaguccuuucuccucaaauaguaagaauauuaaaaacauccuuaauuuugggauauuuuuuaaugugucacuccuaauagucuuuuuuuuaauaguguucaaaaacuacacaucauaaaauuaaacacucaaaaguuaccuaguggacaaucauauuauuuguauguagccaaacuaaagaacguuucugugggaaaacugaacuccugugccauucaccucccccauuucucccuagcccuaccccaucauggguuuuuucacagccuuuuuaaaaaauguacaagucggggauggcaagaugacucagcaguuaggagcacugacugcucuuccgaagguccugaguucaaaucccagcaaccacacggugguuuacaaccacccauaaugagaucugaugcccucuucuagagugucugaagacagcuacaguguacugaugcauaauaauaaauaaaucuuugggccugaccaagcagaguugaccugagugaguagggugaccagagaaacuggagcaagcagagguccuaaaaauucaauccccaacaaccaaaugaaggcucacaaccaucuguacauggacucauauacauaaaauaaauaaaucuuuaaaaaauguacaagucacuucugaaccccucuuuuacaauggauuuauaguuauugucacuuugcucacccaauaaagcuuuaucuucuuacaguucuagcaugcaaaaagauuuagaaucgcaaagcccuuguccguauaauggagauuguccauauaauccuuguuacuaaauggaggauauuuuguccugggauuucuuccaaugaaaguaagcuuuuauucugagaacugggggggacucauggccauuuugugcuugcuuauuuguucaagauuugaagcugcaguugccaggaaaagcaggcuuagauauuagacuucacguggcucuuuccaguggacaccagagguucauuuucuucugacacauaacguguaucacauuggauguuuuccuagaaccugacaguauuaauauuuauuaaauaauuucaaaauguuuugcuuaaugcaauaugaaacuguuuggcaugaaacaacuauuaugggaauaauauauuuggguauaaaauaauaugaguaaaauaaaaaugcacuuugugacaauaaagucucaaauauuguuuccagaaaccuuggccaucagaccacucaaugcaagauuuuucuuuuuccaucaggggcaauuuuuuuuucauuagauuaaguagauuuaacuaaggaggugugguauaucuggcugguucugagcagaccaagcaauuacuucucuuucuuuucaguguuccucuugcuauuuagaaucucuccucguuguguauuauuagcagaccuaaaucacagcgcuccauucagugcccucacucccccaagcucaggcugccaacaucacaauuuagccgcuucuccauuugccaucucugauagauuagcacuaauauuguacaaguaggaaccgguagaaagcaccaaguuucagccuggaaaguccccagguucugagcguucauuuuaaaagucauuuaccuuuuauauaauuuauaauccugaauugauuuagaauauagacugccuguggcacuuaugguaacuaaugcuaguuugaauucauuguucaacuuuuuuaaaaggcucucacuuagguuugaagauauaacaacccaugguucaagaaguuccuuucacuaagguauuugcaucugaugugagacuuacuccauagagccacaugcuaugugauagaaacuuuuacauuuuauauagaaaagacuaaucuuggguaaacacagaacuugauucucuacacuuucaauaauuaauucuaaaugacaaguuaauuuuuuacacaguaaauuugguacacagcauagcuuuaaaccaaauugcauauaaugcuaaauuacuugcuguauuuauaauauacuuaagaaaaccaaagaauuuuagguguuuauuacucagacuauuauuugaaaucuuuguggaguuugaaagaguccuagucuugccuuugaccugaggcgcaacgaugcuguuguauacagggcaggggaggaaccucgucuugguuucuagcagaugguuuuucugggccuaggacgaggaaccucgucuugguuucuagcaguguugaggaaccucgucuugguuucuagcagaugguuuuucugggccuaggacgaggcauuuagcucuaagaaugcuauucaucucacucagcacuuguggggauugggucaggcuaggugaacucuggacccuucucauggcuuuaucccuggagccagucaaacuucuuagcuaucuucaacuuccuucucuggccuucauugucugcagccgcucuugcugugucugucauuuauugaccauucuguccuuagcauucuccauauguaguuacggcucuuuuacaguuuuacuucuaauuugucuaguccccaugauuaaccucgugugugugugugugugugugugugugugugugugugugugugugugugugugaguguguguacacgugcaugcgcuaacacagaaauuaaugauccuauguaaguuuuaacuagacaaaagcuuuaagcaggcaguucuuagagucugaugagauuuuuagacaugugaccaaaaucuugguuaaggauacaucaaacuugguuucccauaggaaaacucuuaccuccuugacucgaacauaaacuuaaaggccucucucuuccuccucugcauucccuccacacccugcccuguacugauugcaaaaaucaucucucuucacuuaaucacugcuguucuccuccuguuccuuuucugccuuggaaaucacaguucuuagcagaauuuuaaauggugacgagugauaaugaaagugaccauuggaagcccgcuagggaugcuauaucguuuuuguugcaaagaugcugcagaaauuaaggugcaaugugugguggggucuucugguuucuaaacauccuaaauuuuacuuaaagacauuuuugugccaugccuaauguuacuuggcucuaaauaucuuuuggagccuaaucaaacuuguguuucccuucaacagcuauuucuuuuaucugccauguuccaggcaguguguucauaccuaugagaagagugacgcuaucauaauuggcuguauuguacauuuagcaauugaucuuuuaaauauguuuuuuuuuacauuuugucagugcacuaaauguauuucacucaugcaaacagagaaauacaacaguacuauuuuagacaguaauuuugucuucaucauuccaaagcuuucuugcuguccaggaaugaaauuagcaaucugucccaucucacgccuagagugcucaaguggcacugagcuccuaagcagcaggcaugggugauaacugugcauccccgugaagacaucaucuaauucuaccaugguuucuguagcuggauggcauggcaugggggcauuuguagucugucugacuugagccuuagcucacucauugucuaguccccaaucgcuuuccacauaaaagaauuuacaaacagcucccagcgcucuuuacuguagugacugucacugaugaguccaguagaauaggccugauucucuucaggucauuugagacacccuaguucucacauaggaacauugcagugcacgccacucaggcauacauugaauuaucugugguaaaagaaacugguguauccugaacauuuuccugugacuguucauuaauuauuauuuucuaauugaguuaaagacugaaacuuuacauuuuaaguuauguagaacuugaaaucauuuuccaaguucuuucacaugcucaaccucauuuuguccugauuuaaguuagugcuagccccucuuagagauacaacacugaggcccuggcgggugccaugauuugccauaaucaucagagccuaccuaauaauggaauagcaaggcauuaaugagcccacugaugagcaaagccuucauucugacagacaaauuuuaaguggcagccuugaaaauuaaaauuggucaguuuaaacguuuuuauaguuaaaggacuuguaagacugcauucugggcagauguggugggacgugccaauaaccccagcauuucugaguuggaggcaggggaacacaaguucauggccagccuagacuacaugaaauucuauuaaaaaaaaaaaaaaaggaagaaggaaagaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaagcauuuuagguaccuccuugcuuucacauaauuuuuaggcucaagucuggugguccugucaauacccagauaucuucacuggauucugaaugucaacacugcagccuaacugcucuccuucaaacaggcauuacucucccugucugagcagccuaaucccuugugccccuguuaccucuuaucaguguaccugcauugugaguuuaacuaccucauuugcauaguaggccugauaaaucgccuaaugaguuuuuucccugauguucacuuuuuguauucgucuaguuuauugguuuuuaauauauuuuauucuuuaagaacuucaugaauaccaugaaccuaugcacaagagauugaugagugacuauauaauaagcuuaaggagacuguucugaagauccauuugaagguagugugaguuucuuaccuaacuaacucaagaacccaugccucugucccccuccugaggguucacagugaacaagagcgaagaguccagagagccgcauuaccuucagucacacacccaaauucaaucacauucauuccaucaucucuguuagagcaagaacucaacacguauuagaaauaucuccacuucacuaggaauaauaacacugugaucaaaguuuuaaguaagaaauuucacaaaaugaaugaccccuguccuugguauuccuagguuaccagaguuguagcauugcugaggaauucaccaucuuaauuucugaauuuuacaugcaaaugggauuauucugaccuuauauuuauggccauaaaaaguuagugugcaacuuggccuaaucugcaagaauuaucauauguuuauaaauuaucauauauuuaaauaagauauguauaaauugcauuuaaaaaugcuccauaugacuaggauuaucaaggaagagcuuaauagaaguuccacaacuaccuuuuacuaugaaaagaauaaaacuagaaucuuuauaaucaacuucuuccacucccuuauuccacagcaaugauuuuaaugauauuucuagguucugggucccccuaaauucucaaccacuaguacagcauaguaacuagcuuggugucagcuaguccuggauugaaguccagauucuaucagaugcauaucaaaggcauuuaaucuaacuuuacaguguucugaaagguauucauucaacauccaguuuguaccugcugaucacccacucuuuucuacgccaucuucugucuccagggccuuaagucaauuccagagcaaaggguccacugugaaccaguugcugcuuaagaaaauuaaacauucuaagauacaugaagcuguagcaaaauaccugucacauaagaaauguuaacaacauuauuaaacuucccaacuuguaaucuuggaagugucgcguuauuggcacacggacaugaauguguaaugaaauuugcuuggacagaaaaccaaaggcacuaacuguguaagaaaaaauguacaugagacuccaacagaaaucagauuaucuguucauccaaagacaugauuaagaaaugaauaagauuaugauuaagaaauuaaaaaaaaaauucccaucuuucaaaagcuuagauaggucacaugaguugaagacuaguuggccgcgcacuaaaagaacucuccugucccuuccuaaacagggaaaaaccucaaagaugucuuguaguuucuucaaaaaccaccuaagugcucacuucagaacugcacaagauccuguagagcagugucucuacagccaguguucagcuugugcuccggaggcagugggagcguaugcugauuuaagauacugcugggcguuuucucagcacugggggaaguuuucucaucccuuuauucuaaaauugaaaccaucauuacaagucuguguacugacaaaugucuguaaucucaggacugccaguucagcuaaggcacaaagugaguucaagaccagccuuggcuaauaagagccuaccccaaaagaaagcaaacaaacaaacaaaaagauuacgguuaggugugggacucauuucaaguccuuuaaaggaagaaacuuaaacuuaaacuccugggucccggaauguaaggggcugcuacaguuugggcccaagggaucuucauagagcgcugucaaugugugagcuuggugacgcccucccccuuggguaucugaacuguaugcuuucuccuuuuagcucacacaggagcucuguuuucuucugacccucagagacuuacaaaacuaccaggaauguugaccugacugucaccugacuaucacuguguugacugcucgcacgugucccuuguuuccucugagagguacacaggaaccauuaggguaauugaacaguuacagggaaacuauagcugagagccuguguuaucuuauuaauuuauuguuuauuaguaguauaucaauuuacauuuauuaaguuuucuauuaacagacaugguaauaauuauagguuacaagagucagccuucuuuuguuuuugauucagacuaauuaaguaugugccuacacuuucacuauuaauaaaucuaaauuuguaauguggagugagaaaccacuuuucaagguaaggaauggcaauuuuaggaaaaguagguuacucauuuccuuuuccagcauaccuugcuauagcccucauugcccagggacguuauguguucauaguuucucccucuacgcucagguggaggugaucgugaacauucccaucuuauuuuagacaccuuuguaugacacauuguuccaugggacaguauaugccuuugacagguuguaauugaaauuaacaaaaggaauaaauugggagagugauugacuuuugauuacaguuuuagcuuuacagaugaaugcuuggcacugcuuaugaggaaguucuguucaguacauuagcauuuucuucucagaacuaacagaaucuuuuuuuauuucuagaaugaccauaaagaguaauaagguuauuucuguaggaaaacuaagcauccauuagauaucugacucagaaaguaaccucuuuaaaaccgaugaacacggcaaagaauaauggugaggcaaucauaaaugaggacccacacuggcaucccuaggcuuuuaacauggaaugcuaugugcauauuucacuguaccaagcagcauaagauaaaaucccaucucccucccaccugcuugggcugagucugucucuuuuccgagcuggcuguaguagucccuuuagaguaucaguccuggguuccauuccagaguauguuaguccugugggagaguuugaaagggaacauuuugugaagagaauaaagcugcuacuuucugaugcuucugaaggaagauuuagaugucugucacaguucugcuuuucaauuuaugauuaaaacaccauuuccguggugucaguuucagugaccauggagacaaggaacaucgccauuacccaaagagucccuguauucccauaaauuacaacauccccacaccuucucucccaauucccagaagcagcgugguucuguuugccacguggccgugugcucuaggauuuuaucucacugaacauguaucuauuuucauuuuggcuucuuuggucugucuguccguuaaaucguccaugauguugagcugcgcagcagguuuucuuuuuauggcugauaaaacagucuucuuaaaacagaucugaacugugcauccaaggugaugaacaacuucacagcaaaccuggugagaaaaugcuguccagcauugagacgguacccgugacucuuagacacaucucccauuguaacuggggcuguguggaucaggcagggcuguuugggacacuugaguuuuuccacaguaaacagaggacucgggugagaagccaucagccaccacaguggccuucaaacugguucuuccucucacaguaaugcugugauuucacaaagugagcguucacaauaauuccaggugagggaauacucauuguaaagccugguuuaucuaaacacccuggaaagauggaccuggugcagcauaccuagcacuugagaggcagaggaaggagaaccacggguucaaggcuguccugggccuaacuuugucuuuuaaagaaaaacgguagaucuaauaauacuuccauuguuugccgaguuggugauaccuugguagcuauuguguucucuagaugauguaauggggaccuaaugaacucaauuuuauaguuagaaauugaguuugaccuagaaucccaaggaaagguucuaucaaucccaggugagugggcacaucaagacugacaucuggauugcaucuggcuggucuagacauccuaaugcuaucugauuauugccauucagcucuugagucagugaaauucuagcaauagcagugaguuugaacagaucuuuacugugaaucuggggugcugugugcuacucuauauugcagaaugccuaaaggguggaagucuucaucaucgguugucuugugcaagaguucuaucuguguccuguaaauaacugaacuugauguugcccugcauccucuccugccuccaccuucaacacuaggaacacggggaucacagcaugccaucacaugccaauagcauacacagcagcuacuccauugccauuaugagagggugacaccucauucaauguguaaauaauuacuuggcaguaaaaagaagccauauagcaacuuaaugcuaauaucagaucaugggaaaagauacccaaugagaucaaaaguagccugagugaugagagaauacuaauuaaaugauuauuuuaauuuccuagcucucaauaucuauuugaauucucauuccuuuuaugucacugcccaccacuaaguacccuacaauccuuuguugcuucuucuuagguacgugugugugugugugugugugugugugugugugugugugugugugugugugugugugagagagagagagagagagagagagagaaagagagagagagagagagagggagagagaucugaaggugggcaugcaugucacagugcacauguggacgucagaggacagccgcauagagucagugcauagucagaucucuccauguaccuuuagguggguucugggcaucgaaccuccgguccccaggcuuacacaccaagcaccucuacccagugcgccaucucgccugcccuucccuaccuauucagacucauuuuucuccuggcuucagucugauaguuccagaaauacugaaaugaagcuucucuuuaaugugaccuacuuucauguagaauuucucauuuuuaaaaggccagcucgauuugaauuaccaagagaacuuuauuaguauaauuuaaccuguaaggaaaaccuacagagccaucauuauaagccucaaggauauauucucaauucuaaagacugcuaacuucuuuugagcaauaccuaaacaguccagcaucauucuaguuguaguaauuaauuuuaauuaacagccaauaauguuuuuugccagauggaaaaaugagggauagccccuauucucauuugaauaugagaaaugaucagcuuaaugggagaaagguaaagagaucagaucgaucguggguuaugaguuggagaauuacaaacuucauuucuuggugcauauauccuguugaaguauuuuugaaaagucucaguauaagauagaguugacauuaaauagcuuuuuuccuugcauuugcuugcucuggaaaacacacaccagguuuuuauggggcuagaggugcuggcuugggagcugagcagaggcuuagcccgcgcagggcccgagguuaagugccaagcacucagaagaaucggcuucucacgucucaguuuuuaaauucauuacaauuuuuguuauuauuagugaacauggugucacuaaaaaugccaguuuuauauacaugugaagugacuggaaguuuaaaaacucaaaucaaaaguuaauaucaaaagccacagucuuuccacagaagguauuugaaaccacaacucugauuuucacaagaaauaaguggcuguccucucuguacagugggaaaugggggagggaccuguucuuuagccagugagcucaggguggguggugggagcagggcagucuucuaauuacuaauuuuauuggcaaauaaaguuguguccacccacuauugggacuuacauaggauucuucaggauuuaaaguacuuucuguaaacuuguucucaaagaaaguauagugauuuauuuaaagacaauuuauuacucagagcugugggagaguucugaaccaccaaacuuuuagggcucagcuugccuucuuuuuuuuuuucugaaaauaaaaucaguuuuaagugucacccaaauucccauuuugucaguggaagaaccaguuagcacaauaaaagaauuuuagaacuggaaaggacccuuggcaucaucuagucuuaccuuagaggucacuagguccaaggaaaucacucucccacccaccccuaguacugguuuuuccuacuuuaaccccgguccucagauccuaacuguauguauguguaacuggcucaccauuccuucugcuagccuccacauucaugcuggugggcugcagccgugcggccggcuuuuugauucacugcgucugacuuaguuucaggaaagcaucggcugccauaagcaacagcuuggccuuuaacuagaacaccuggcagagacaaagaugcauagucagugcugucacugguacucuggaagaugcacaucagugggccaugucauggugacuucagaaugaguagagcugcucuguagucagguagugauaccaccuaccauacuguaaugaggccagcacagugcuucauggagagacugccagggggaauacaguggaaagcuuauuuguccaucuucucaguccuguuucucauacauuacaucagcagguauuucuuuugcauacucugcggggucugaccacuacagcagaauguaagcuccugucuuuggcccccaaagauaauaaaagaugcuuggccuagagcaacacccugucacugucuauagaguagaaaagcuacacucagcuugaauaaguucgugcaguucaacaacccacuuaauuaacguagccagccucaucuggacacagugagaaauacauguuauaacuguugugagacaucuuacaaauaagaguuccacaaauguaacagcuagagaaaagacaagugaauacguaauacaguaacaaugggguauuagaucagcuaaauauaguuggauuauuauauauaauaaggacuuucugugucuguaauuuuaagaauuucauguauuuuagugauuuuuaaguauuucucuaacaaauuuuaagugcugaaacuaucaaaaccuaguacugaacaaaacuguaggauuuguagauagauacuuaucuauucugugauugaccugucagcauauugggcuuaguuugguagaggaggaagaauauuaccaaugauuugucaugcaugguccuuucugauuugacuauauuuucaaugucuauuuucucauaaaacuaccauaucacuuucggucucaagcucuagccagaaaagaugaaaggcuuauauaacaaggcauuuuuccagacaccuuuacugucagucuuagagaguaaaacaggcaguucucaaccuaugggucucgaccccuuuggggggucacauaucagauauuuauguuacaauucaaaacaguaucaaaauugccauuaugaaguagcaacagaauacuuuuaugguugugggaucaucgcaacaugguaucaccacagugguaugaaggccauagcauuaggaagguugaggaccaccgugguagaaggagacucuuaaacuguagggaaaggaagugauccuuucaaagagccaucuccuguucugugaugaugaacuaaucccaguuuuagcaggaggacuuucauguuuuagacagccuucucacggcacucugccaggucagccccuggcauaagggaaccagacacucugcacuccacaugacugacugacaguccacucuccccugaaugacaguuuucaucucaguuuucaaagcagcaacuucaauuucauuacacuuagaaagaguagacauauucaaaauguaaaugugugugcauggcaguucuuugaacuauaaaauaauacaguuauuacaugguaaagagccaucuuuaacucuuaccugaugacaugggaauucaacaauaugggaagcguccauuccauucuuugcuuuguucuauauuuuggugcuuuggucuccauuguccuuuuauccuuguauuucuucuaaaaauaacuacuacaacacauuucccccuuagucuuucuauuaaaauaaaagagguaggaucuuguaagaucaauaucacacauuuuuugcugcacugcauaauaagagugagcaguuaagaugggaaaccuuaguauuuaguacuguuuuccaaacuugguuaucagaucauaaguugcuuccaugauugaagagaguaaguauacuauauagucaaauagaccaaaaauaauaauaauaauaauaacaguagcuaagccggucuguuuuuuaaagcauaagacuugcgagcaucgcauggcagcauugcuaaccuuugcuugaacaagcucuccugggaccggcgggucuguggacuguuuucacuauacuuggacaugaauccucaaagagacaggcucucaacagcuaccacuuaacaaacacuaugcugguuuuuggcaacuauaguucaucuuccugauuauauuugugacguucgugggacuguacuaguacacagaagauggaccuauauacguauuuaggguuugaaacaguagaauugugugcauuuuagaaaaauauaugguaacucguggcacuuugaaaaaaggaaugugcaauuauaaugguuuauaccacuuugacuuuuuuuuaacccuagaaguacucuuacuaggcuuuagcgucaaaaccaaaccuaaugcuaaaacuagcgcuuuguuccucccguugacccuguuugauuggugauguggaauguuucacacugaucauucccccacugaauuuucuuauguccugaccucaacaccuucaaagaaugcuuccagugaacccagugauggucaggaaaauccaugaccauucacucuugcacugauuuaaauauaagcaauuuucuugucaaaauauuuuuuaagaaaauauucaaacauuuuaaguaguguuuauucauuuaaaauaguuugguauauaucuagauagucacauuuuuuccuaaaaucuaggggguuuucccucacacaaguaaguauauauaauuguacuuaaaacacacccauucccccgccaaggcaaauaagauauauaguaaauggaucucuguguggguaugacucccacauagauaaacuucuguuccgucacgggcauuuuccugugcuaugccaguguguugugagcacaggggguagaaaugcuaacauuagaaguugacaucaauacaaauuccacauaaacuuacugcgauagaaggcaucuaucugccuguaacugaauaauuuacuguugguuuucuccagccuucccugcuuaaggcugcacaaucauuuucaaugaaggaagauagaaucuaugaacaaagaaguuuuguuuuguuuuguuuuuuuaaauggccccauuuggcacacuuugaaaaaucuguugaguuuguuuuuuuuuuuugaaguucauuggucgcuuacaacuucugagucuuacauauaaaucacagcauuuaaaaaucacacauuuccccugcccuucaaaauguauucagaauugauccagacucauaacuuguaacuucuaaugauuaaaacuugccauauauacugaaagauuaaaugacauaagagcuacaaaagauugguaauuaauaauguaaccccauagacuaucaaacuucugauaguucuggguuucuugcaaagccuuaaaauauuaaaaaaaaaauuaccuaaaaagagaaggcacuuuauuaucuggagcuaacuauuuaucuguguagaauuugucuaaaaaaaucccuuaaaguauucuuuauccuuuuauaaauguauccuauuauacauuuuucuaaagccacguagaauauaaagugauaaaguaaacuauuuuaauuuaacagaaaaucguguuacauaguauaaaaaaugaauaauacagaaaugaaaauagaaaaaaguauaugugauaaugguaaaaagugucuaaguuaaccuauaaucauuugaaauuaccauguaaaauuuaaagacucucagugaaaagaaaaacuuuagacagcuuuuauuuguuguuaguucuuaucuuuaauuaucucuacuuugucuugaaaugauuaucaaaugagagggcaaucagaccuuccgccagccuaucacaccuugguuuuguuucaugagcucuguuaaugaaaccauaacgcuuaagaagccauuuuguuucuucuuuucuccagucauccagacuuggugaauuaucagguuuaacucauuccuguagacuuaaucgugcugguauauauaugcucccucuuagagaaaucagucguugauuuauauaaugcauuuacucagcagaaaaaaacauuauuuuuuuuuacccuugcauguugauccuuaacaucugccaacauaaaaaugauaggcuaguauuuuccaauuuuguuugugagcaguauuccuaaacauucuaagaaaauguuucccauguuguuauuuauuuuuaagucucuacacuuuagcccuuuuucucucccuaguuuuaaguauuuuaauaaauguaaauguuuucuagacagagucauuauuucaugauaaaggaaagaguugaguuuaucaggucuuuccuuaucaaggaaaggcuaaaaacaauuguuuuuuuguuuuguuuuguuuuuucuuuuugucaacuguuugguuucugucuuuguuuuaaaauaagauauauuaacccaaagguguguugacgucaaggcaugaacaaucguaauuguagaucuauugaguauuuugugaugcugaauaacaggcuuuucucaaccucugugaugcuaaguauuuuccuuagaacguuuguuuaauguuagauuguuguucugaaagauguugguccuagugggguuuuuaaaaacuuggaaaacaaacgcauguauuacaaguauagcaaugaauuguaaccuuaccauacaguacugauacucuacuuucaaauauguuucacuguuaaauauagacaacauaacguuacugcuguacuguuacugaguacucucuccuaaaggacccuguuaucacuacuccagauuagauguggggcagacacaugauugacuccugugucuguauagacccuaccagguauauucuucucuuggugaguaaaauuguauuuuccaugacaucaguacuuugagaucugaauauaccuguaucaauguuaauugcacauuucguauacaguuaccuucauuugccaaaauuggcguaggcuaaaacuggaggguuuguuacaugcuuucugcuggaaagguuuucaauuauacuaggaguggguuuguacugugaaaaugguggggcucccuuucagauuucuuaucugcuaaauuaaauuaauauuuuuucuuuagcucacaaauuacccuaaauccagagagaaucucaaccuuuuucacuguugucagaccaagcauaaggaacagcccuaugauacuccaaagacaguugaggaauaaggacuaaaucccuuauguuacacugcagaauaaaggcauucgaugaaagaaaugaacugaaguucaucaugagcgcaaggcuucuguacuuggcguuccugcauggaaaggaaaacagguauggacgccauuggcaucauauucacacugcccuuaugcggaaagccccccaccacacuggaggacuucuggacucagucugguuugcuggggacagggguggggguggagguccuguuucuuuaaaccuuucauuuuccaaauagcuauuugccagcauugagggaggaggagacauauagacuugaaaauacuuucuuaagagaucauguaacugucuaacucugaguuuaaauuuggaggaggaaggaucacuucaauccgcugccucguauaagaaacauuuuuuauaaaucuguaacugcguuaguguuaacaggguacaaggugguuuuguccuguauuguauuucaaagguucucauggguugugacuguauuguacuguaugaaaagaagucagaacuugccuuguauuguuuauaauggaccauaacucauacuaauucaguuuucauguuccaaauuuuucagugaugcauguucacaguuagguccuaaacuccuguggugcuaauuccuccauaauccaauggugcuuuuuguggaugcuaacugcacacaugcugaacaaggcuugaaacucaaaaguucccucccuuccucuguuuauaugaaguaaaauacaauaacuugaauuugucucaaaauauucacugacaauccaauaaacugguuuauaugugucauuaguuuggauucuuauuuuucagaagucaacucagucacgcuggacccccaaugcugaucuuauaugucuuuauuucguuauucauuugugccugcaaauuuauguugucucaaagaauuuaaaucuaguuggucuaacuuaugaaaccguguuuagagagaauccauaaaaccaagcccugucagaccuaaaaauaaguauguugcaaagaccaaacaugggccuuugucuguuuuaguaguuuauugauaauugaccauuggauugggccagaagaaaacauuugcaggaaagcaagccggcucacaccuucuaaaucuuuauuucauccuagacaacacuaaaaagacucacuccuucagagccaccuuuaaaguuagaauuguggaauugaaacgcggguuggcagcagaguuccugacuugcaugcaugaagccuuggguucaguuucugcaaaauaaaagucagaaggaaaauuuuacucuucaaguaugaaaauaaggacagaaauaauccaauuauaauuucccagaacaaacugacaucauauaucaggacagaugauagagaaaugcaugaugaugaucucgugagauguuaagcuuugcccgcuauaccgagaacuguccuguaagggaagcagcuaauaaucucuaugaaaucagaauauuucuccccagccagagauaaauuuaauacuagagccauauguggauuugcauucuaaccuuguagcuuuccuagccacuggagauauuaaauuuugaaaagaagaaagaaaggaagcaaauuccuaaagcuccucugacaacagucauugacaucagauauaaaggacucaagcuugccugucuagccagugggucuggcgacagaaaggacauuccuguaucacugggggucccuguuauacauuaauuucaucucaaauggcuucugacaucagaaacuaacauuuggagaguggaggcagaggcagccuccuuugacucuuggauaaaugcaguguuccuaaagcccagccucucccagaca

SEQ ID NO: 4383 - RNA, 1441 nt, Mus musculus
cagagagccuccuggguaccacuucaaaacaucugcuuccagaaggcagaggauacagugcuuaagaccaggcagccucuagcgguaagagcuucagggaagcucgggguuuagccucauugcaucuucuaggccagaggcagggccuagaagcaaacaggacaagaucucauaggugcccuugagaagugcaagcccucugugucugccgaaggaaccagucuuuugcuacagaacagcaguuuaucccucgcuuauagaucgcaaagaggcuuuaaguaaagcagaugucauaugcuugccaagacaguacuugcucguuccugcuccagugaccuguucccuucuugucacuggacugaucauaagagacaaaccucacugugaccugacuaugagguauugacccugccaaggaaggagaguucucacagagggaguuucacugucugaaaggucagcucagggagugcaguggggggucaguaugcuaugcuggaugggauggugaugcugagaguaauaagaaagaacuauccugugacuuaagauccaugcccuggacagagaggagagagugaggaggcugcaucuggcuccggcucucacagccauuguaguacauucagcuccauagagacagcgccggggcaagcgagagccagacgggcacugggcgacucugugccucgcggaggaaaacaugggcaaaggagauccuaagaagccgagaggcaaaauguccucauaugcgcucuuugugaaaaccugcugggaggagcacaagaagaaacacccggaugcuucugucaacuucucaggguucuccaagaagugcucagagagguggaacaccaugucugcuaaagaaaaggggaaauuugaagguauggcaaaggcugacaaggcucguuaugaaagagaaaugaaaaccuacaucccccccaaagggaagaccaaaaagaaguucaaggaccccaaugcacccaagaggccuccuucggcauucuucuuguucuguucugaguaccgccccaaaaucaaaggcgagcauccuggcuuauccauuggugauguugcaaagaaacuaggagagauguggaacaacacugcagcgaaagacaagcagcccuaugagaagaaggcugccaagcugaaggagaaguacaaaaaggauauugcugccuaccgagcuaaaggaaauacugcugcagcgaaaaaggggguggucaaggcugaaaagagcaagaaaaagaaggaagaggaggaugaagaggaugaggaagaagaggaugaggaagaugaagaugaugaugaugaauaaguugguccuagcgcagcuuuuuccuugucuauaaagcauuuaaccccccugaacacaacucacuccuuuuaaggaaaaaaaaaauugaaauguaaggcuguguaagauuuguuuuua

SEQ ID NO: 4384 - RNA, 1881 nt, Mus musculus
gugauuuucgaaguuacuucauuuauuuugauuuuaagggagaaaaaaguguaaucacauaugggaaggguaacucaauuaaguauccuaacucacagugcacacauauucuuucuccuuauccagggcccaaugugugaucucuuauggucagauccggaugaccguggcggcuggggcauuucuccacguggugcuggcuacacauuuggacaagacauuucugaaacauuuaaccaugccaacggucucacacuggugucucgugcucaccagcuuguaauggaaguauguacuuuuccugcucucgugguguacgcaugcacccgucauaaggcuucauaauaccuucaguaggggcuggagagauggcucagcaguuaagagcacauugcucuuccagaaggcgcucaguagagacuugagcucagugagaugaugacuccaugcugcuuagaggagcacacugaggagugugcuugcuguguguguccuugcuacauuucaccaaggagguuugaaagcuguuuguccacugcugguucuauuccgugaccacucaguugagguagcaauugcuggauuucuccuguuguguuaguguugucacuacgaaaggaauaaacgagaacggagucccucuaaccagcaaguaguggcuuuaagaagguagaacaaacuucaccagccuagagcaggcgaggagugggguaggggcaggaugcaaagcacauacacgaagugacauuaaacuucauuauacuggcaagcacagaugucagugaugauaauauuuuuggagaaaaaauuugacuaagcuuuaacauuccuaaaaguccugagacuccaaaauuagaaaauaaucaaauuucagcuauuugaggcaaaacugaaacauuuaacauaacaaagaugagaauggugugcuaugugucaaguaaacaccacccaacaucacgagugauggaaggcagaggcucugacacaggugacaaugugauugucaagauggcugguuagcaugggcucagcucucugggagagcauauucuaaguugguauuugccuaauacgaguuucaagcaaacuuaguagcaaacuuuagaagccaggcucauuucuaucaugucucagcacuugggaggcuggggcaauugcaaguuugagaacaggguagucuaaauagcaaaauucuuucucaaaauaaaauaaaauacuuagcaaaguuuaugaaggaaaauggggaaguuacuaugguuuucugagaaauucaguguauauucuaaguuaaaaucuuaaguguagguuaagaaaagcuguaugguuacugagguauauaauagaaucuuguaccuaauaaauguuuaaaagucugaacaguugcauaaacuuagauuauaaaagguaacauagccaccgaaguauuugugacuugaucugucaaaauuggauuuuauaaugaaacaaugaccuuuuuaauguugcagggauauaacuggugccaugaucggaauguggucaccauuuuuagugcgcccaauuacugcuaccguugugggaaccaggcugcuaucauggaauuagaugacacuuuaaaauauucauuguaaguaacuuuacauuuuaauuguauguaaugacuuuuagaggaaaauagccuugggagcuggagagguggcucagcagcucagagcacuuaacuacagucuaguaugacuuccauagauaccugcacacaugugugcauacacucauacacacaugcauguaugaaaagagacaggaagccgggcgugauggcacaugccuuuaaucccagcacucaggaggcagaggcaagaggauuucugauuucgaggccagccuggucuacagagugag

SEQ ID NO: 4385 - RNA, 1881 nt, Mus musculus
cucacucuguagaccaggcuggccucgaaaucagaaauccucuugccucugccuccugagugcugggauuaaaggcaugugccaucacgcccggcuuccugucucuuuucauacaugcauguguguaugaguguaugcacacaugugugcagguaucuauggaagucauacuagacuguaguuaagugcucugagcugcugagccaccucuccagcucccaaggcuauuuuccucuaaaagucauuacauacaauuaaaauguaaaguuacuuacaaugaauauuuuaaagugucaucuaauuccaugauagcagccugguucccacaacgguagcaguaauugggcgcacuaaaaauggugaccacauuccgaucauggcaccaguuauaucccugcaacauuaaaaaggucauuguuucauuauaaaauccaauuuugacagaucaagucacaaauacuucgguggcuauguuaccuuuuauaaucuaaguuuaugcaacuguucagacuuuuaaacauuuauuagguacaagauucuauuauauaccucaguaaccauacagcuuuucuuaaccuacacuuaagauuuuaacuuagaauauacacugaauuucucagaaaaccauaguaacuuccccauuuuccuucauaaacuuugcuaaguauuuuauuuuauuuugagaaagaauuuugcuauuuagacuacccuguucucaaacuugcaauugccccagccucccaagugcugagacaugauagaaaugagccuggcuucuaaaguuugcuacuaaguuugcuugaaacucguauuaggcaaauaccaacuuagaauaugcucucccagagagcugagcccaugcuaaccagccaucuugacaaucacauugucaccugugucagagccucugccuuccaucacucgugauguugggugguguuuacuugacacauagcacaccauucucaucuuuguuauguuaaauguuucaguuuugccucaaauagcugaaauuugauuauuuucuaauuuuggagucucaggacuuuuaggaauguuaaagcuuagucaaauuuuuucuccaaaaauauuaucaucacugacaucugugcuugccaguauaaugaaguuuaaugucacuucguguaugugcuuugcauccugccccuaccccacuccucgccugcucuaggcuggugaaguuuguucuaccuucuuaaagccacuacuugcugguuagagggacuccguucucguuuauuccuuucguagugacaacacuaacacaacaggagaaauccagcaauugcuaccucaacugaguggucacggaauagaaccagcaguggacaaacagcuuucaaaccuccuuggugaaauguagcaaggacacacacagcaagcacacuccucagugugcuccucuaagcagcauggagucaucaucucacugagcucaagucucuacugagcgccuucuggaagagcaaugugcucuuaacugcugagccaucucuccagccccuacugaagguauuaugaagccuuaugacgggugcaugcguacaccacgagagcaggaaaaguacauacuuccauuacaagcuggugagcacgagacaccagugugagaccguuggcaugguuaaauguuucagaaaugucuuguccaaauguguagccagcaccacguggagaaaugccccagccgccacggucauccggaucugaccauaagagaucacacauugggcccuggauaaggagaaagaauaugugugcacugugaguuaggauacuuaauugaguuacccuucccauaugugauuacacuuuuuucucccuuaaaaucaaaauaaaugaaguaacuucgaaaaucac

SEQ ID NO: 4386 - RNA, 1566 nt, Mus musculus
ucaagagcaggaaccucuaagguuguauuggccauccacugcuggccauucagucuaccaucgcaaauguuuuucaagugagccuucccuggagagagaauuuacuuuuucaagugguuaucaguuggagauaguggcuggauuaaggauggggauagcugucuacuucuuugggcucuaggagcuuaucggugaagauccacacaggcucugugcaugcugccucaguucacugaguucacauauuuaucgaucuuuuuugcuuuggagggccuuguuuucuccgugcccuucaucccuuuugcucuuacucuuucugccucugcuccuuugggguucccuaaggggaggguuucauauucacccauuuagggcucacuguuccaaggucuuggacgcuccucuguauacuuuuuuuuucuuuuguuuuuuucaaucaggguuucucugugcaguccuggaacucacucuguagaccaggcuggccuugaacucagagauccaucugccacugccucccuagugcugugguuaaaaguguccgaaguccaaacuccaaaccuucacacuuuagucacuaucuccucaggaaauucuucuccacacugcagaacgugguucuguagcacucuauacagacauuccuaucauggcaccagacaucagauagucucuguacaggacauguaucccagggcugaguuuguuuaggacaaauucaguaacuuacacauacuuggaacuuaagcuaaacugaagagcgacuggggguauugaugguugaggacuugccaaguugggaaucuugucagugggaaggcccuccauuccugaacucuaaguuaccagagcugagucauggaguggcagggaagucacugugaggccaacguuaagucauaacuguaacacguguaggcauugacagggagaacagugaguggggggcaggucuagggaacucuccacgcggguguggggcaggaacaggcacuagggagcagaccccacuuuuaagcuucccgcaggaccuguuaggaagagaagaugcuuaguaacuaguuagcuaagaaccaaacgcccuguuacccccaagggacacaaggccaccgggccucgcagcgucaaccgccccuuuuaagucauuucagucuucugagcaccaucuuuuagaccugcacagucugauaagccacugucaucgugaccagccucagauccacaggacagggaccgucccagccgaaggagaugacccgcgccgucugagcaaucgcauccgggcccgcgccccagccucagggcacagcauccucccuccauuccucccagcccgaggccuccggggcgagcucgcggaaggcacggccggaaggggcgggcacugcgcccagcgagcccuccgcgccauggcuucucguggcgucgugggccuuuucuugcucucugcucucccucucuugugucuggagcuccggcgcgggaucccgagucucgguaaguguugccuuucuccucucggugcucccagcuggaguguugucaccugagcggcgcggaccuccg

SEQ ID NO: 4387 - RNA, 45338 nt, Mus musculus
uaacauuuauauuucguguaauuuuauugcuuagcuuauuaaccagaggcauacccuguguuccaaagaugaaauccuuacgccaacaguacugacucuaaccucugucauauccuaaacauccccccagacaagucaggggcugcagcugcucccugccauuuucaagaaguaagagacaaacugaauuuccuaacuucuuaaacaucuuccuacaaaugauuuuauuauaaauauuuuuucuuggaauaaacaaaacugcauucagcaccauccuccaacuucuucuaaacgaauagagaaaacauggaauccagaaccauuuagaaaucaagauaaauagcagacaccugagugucauauaagugucuuucuaauaaaauaaaacaaacaaacccagaaaguuaaacaggaacacccauuccuucccacuagccugcuggaugaaaagaaugagucugguaacccgcuccuguucuguaaacugagcagcuccucucucaggccugaggagcaggcaggaaggcagacagucuugagaucccaagcaucaagaaagaucucgacugcgugucuguaacuguguuuaggaauaaaaguguucccuauuugcccgggguaauguccgaguaauccuucagcacuccagccaaguguucauugugagucuuaaaccgucgcuuuuucugugaagcaggcuuuuuccuucucugaauagaggccugcaggacaagguaaagacaguuaaacacaagugacccuaggggacagaagguuaagauuuacucaacaagcucaaagcacaggguucugagccuuuccugguucuugcuuggagguccgaccucaaacaccccauucacaguacacccagccuccaucuagagcugugccuucugauaccacaaggcuuuauaaaccuccauuggaaaagagcaggcaggcacaaaagcaaaacacaacucuccugggcauuaagucaguaaaaugagaggcgaugaauuucugugcugucuccaucagagggaaucccucccucacucuuggacagcaggaugaggagcagcuaaccguucagaagaagcgacuaaacugcuuuucuaaagaauacauaccacuuucuuugguccagauuccugcauggaagaaauacccugucgcuucagauacucuucaauuuucuccucauccauugaauccacagugacacuccuccacaguuucuggaauucuguaccaagacaguaauuauuuuaccauaaauuuguauaaaccacagcauuuuuggugaucaaaauucaccuugaauaguaucuguccugggccuaaauuaguacaucuuagauuuaacuaagaaaacaaagaaauaccuuaaacccuggcaggcacucaggaggcaaaguaggcagaccuccacaaguucaaggccagcccugccuaacagcaaguuccaggcaaacaaugaggauacauagugagacacggucucaacaaagaaagaaggaaagagugaaacagagacacggacacaagagaaagagaaaacggcaaaaguaugucaagugcuggaggcugugugaccuggaaggcagcagugacagggccaccagugugcucugcuuuuuaugauuuaguuagaagaaggcugugugacugaagcuucucccaccuucaaagggaagagaagcaguuaacacuuccauuccaacaacaacaaugaggaagaggaaggagaggaggaggaggguagguugagaacacucccuauuaugaacaaaggaaaaagguaggugucuagccacguaucccauucuuauacuagacauguauaaaauaauaaucguuuaugcuuuaaauucugcuccuaaaggcagcuagcuguacugagcaggcucacuaagagccuugaagcccuucccacacacagcccaccugugacgacagcaaagccuuacagugugcucuggggacugagaauggcaaagccccuaaugcugcgcuaggcuucuuguucaccauagccgaggagguugcaggccugacuauugccaacccuacaccagcacacaccuccccuccuugccacuccacuaccaugcaagcuacgugacggcucaguggcuguucuucaaggagacaugacuugguucccaguacccacccacauggcagcucacagauaucucuaacuuaggucuaggggcucucaugcucguguugccuccacugcucugcuuaguaguuaagagcaccaacacacaugcaggccaaauacccaugcaagaaauaaaaaaauaaaaaagauaauuuuuuccccaaacuuucaaucuaaagcaaacaaauggugacuaaagugcaugugaauacaugcaagcgacuaaugcauuauuucaagagucaaaguucauacagccagucuggcuacuguuugguauguucccacgccuucuacaugugacacccuacaccaccccagaacucuaccaggaagaaggucucugaauaaaccucuuugcuuuauaauucacccagucugugacacuucuuaauaaaagacuaagacagcaaucuuaagcuaaaaggagcagaguuggaggcaagagacaacaaugaccacaaaccacauuacaaagcuacaguaaucaaaacagcauaaaaauaaagaagugucaaccuacaaaacagaauagaguacagagaggauuaucuuaauaucaguuaaaguaaauaucucaauugauuuuuaauaauguaaaagcagaaaaugaaacagucucuuuaauaaugucuuggggagucaguguggccagagcgauagcucagcaguuaagagcaccagcugcucuuccagaggacccugguuggcacccucagcacccacaugguggcuuacucacgccaucucuuaauuccggcuuugggauuaggcucuuuucuggccucugcggguccgaagcacauagguggcauacagauauacaugcaugcaaaacauccacacacacaaaacacaaagugugccagaaaaauaauugaaucuacaagcaggaaaggcaggcucuuuaucucauacuaugugcagcagucaacuggauguggauuacagacagaaagacacacacagaguuuuuaagagcucugcuguaauuaucuguuccucuguaaugacucuuucucuucuuucacugucuucaucuucaguaguuagcagucugaauaaaccaagucugauguuuuccucuuucauuggcuuggagaggcaugacuuaucucacgugcuuagauccauccugguuugaugucauuaauucuagaaaauucuuggccacugauauucaacuuucucuuccaccaucuccuucagacucaaauuauccaugaagauaauugaagaccaugugauauuguccuacagaucguuaaaaauguccccuuggcuacuacgucauguguccugagaggcuacuggaguugcucuucagcucugucaccacacuuuccauuagauguucuuagugacauauuccacuucaucauacaguuggucuggccuuuucuacuacuuaggucaacauuaaccuuuauuuuaaauucuguguuuagcaguuuaucuaguaguuaaauaucugugucuuaagaauuuggucucauuacugaccuggucucaacaguauaauauuuuccuuugucucuuuuuaugcauuuuuuucccaagcaggacauccucuguggccagcugaaaucagagguaauagucuguaugccuggaaaugggaacgccuuuccuuugccaagccugcagugaggcaaucuaaucaggauguacacuuggucagcaacaucuucugcuaucguucaccauaauaaacuggcuuccaauucuuuacgccacuccuuguguucagaacagggccugguuuguccuaaguguuuuccauggcugcugcccuccaggcuuggguuucccuguuacacuggcuccccuguagucugccugaguguuuuggaacuucacauugcuaaggguauuucgccugcauguauguuaugcaucauaugugaccaaggcaguggaggccauaagggcaucagagccccuagaaccugaguuagagaugggugugagccaccauguagauggguacugggaaucaaaucaaaccauggguucuccuaaagaacagccucaaccuucacugcaagaaucugguggagccgggcgugguggcccacgccuuuaaucccagcacucgggagguagaggcagggggauuucugaguucgaggcuagccuggucuacagagugaguuccaggacagccagggcuacacagagaaacccugucucgaaaaaccaaaaaaaaaaaaaaaaaaaaaaaagaaucugguggagucuauggagaagggcuuggagguggggaauuugaaccucugaauccauaccagccuugagaccuaugucuucauacuaaucggugcagucuucagcaauacuuucaaauucuuaacuacauucuuuugauuagugcucauuuugucugucucagguaagugaguauccauaccucgucuuuucuugggauaccuauucauagacugcagagcagacagcuguucuguaaccucagcucccugauagacuaagaagguccuaaauuuucagauuccuggcacuggcauaaugguaggaucuaagagggaguuagaaguucccaacuaccuaacagccaggguuuuuuuaagauucacuuuuuaaaugaucaguauauguaucuaugugugugcaugcacauacagauuuauacauguuugcaggcaggcaugcaugcaugcgggcauuugcuugcagaguccagaaguggaugucugauccccugaaacuggaagaagcuacaagcacuuuggagguaccugcugggauugcugagaacugaacuuggguucucuacaagaggaaucgguguucuucacagcuaaauccucucuccagcccuuaaaagccaaacuuuaagacaaugugaugauucugccuacaugagaugaauauauagcauucacuuacaaguaaugacagaucaaacaauaucuuuuuaguuccaauaaagcacacaaaauaacuuuuacauuuuacuauuguuauuuuguuuuuaauuauuucaguuguuauaagaaguauggugcacaccuuuaaucccagcacucgggaggcagagucaggcggaucucugaguuccaggacagccaggacuauacagagaaacccugucuugaaaaauaaaaaaguauacuauacaaaauaauaguucuggcauuagaccaaaauuuccuuuauucuaguuuaccaacauaugaaaaacguguuuuugcguauuaacccaucuguguauauauguauguguguauuuauguguguguguguguuaucuguguaaacaaaagggaaagaagcuguguucauaauaucacuuauucacuggcuaauuucauuccagagacuucuuacuaugcuucuguuggugacacuguaaaauuuaaauucucugaaaacaaacugcuugaccugccuuuuuauuugauaugugcaaaaguuuguaugcugccaaggggugauggcacaugccuuuaaucccagcacucgggaggcaguggcugauggaucucugugaguucaagaccaggcuaagccuacagaauaagugacagacaaacaaacaaagggaaaaaaagcuugaaugcuaaagauuucuuauuacacagucacagaggcauucccuacaagaauagcacuagccauggugugacaaaugaaucuguucauuaacacaggaccucaaaauauaugcuguccuggcuaguuuaugucaacuugacacuaacuaaaaacgagggaaccucauuucuagggacaaaaugcauucauaagauccaucugcaggacauuaucuuaauuagugauuggaggaggaaggccuagcccauuguggugcuagcccugagcuauuuuuucugggugugguaagaaagcaagcgacuccuuccaugcuugagccccugugcuaauccccuucuaugaugaacaguucuauguguucuauguaaguagaaacccuuuccucccagccugcucuggucauggugguggagcaacaguaacucaaccucagauaaauacugcucaugcaccaaaacaaaacucaacucucccgcuauagcauggcuaauaaaucauuuccagagaacauuuccugacuucucuguccugaauuuaccuacuuuuuucucccgcccucccucccuuccuuucucucuuuuggcagugcuaaugaccaaucccagagccuugcauauaccaggcaaggauucuaccauugagcuguauuacacuauguugugcuuuaaaccaaggucuggguauauaacucggccugcucugaggcucucaagccuguugccucaaccucccacgugcugaaauuacaggcauguaccacacucagcauuauaaaaaaauaaaacauuuuuauuguuuugccuuucuuuagccuaaugcuguuacaagauguguuaucaaugaaacuauacagauauuuuauagcuacucaaauauuuaagaugaacauuagaucacaaauuucaguaguauuugagaggaccccaaauuuaauugauuuuuaacauauuugagaauacaaacuguucaauaauggugcaaagugggauaaacuuuuuuuuuccuuuuuaagauuuauuuauuuauuaucuguaaguacacuguagcugucuucagacacaccagaagagggcaucagaucucauuacaggugguugugagccaccaugugguugcugggauuugaacucaggaccuucgggagagcagucggugcucuuaaccgcugagccaucucaccagcccgggaaaaacuuuuuaaguuuauaaaacaugucuaauaaacuacaaauuaaaaaccaagguaauuuugguuacuuugcuguuuuugucauuguuuuuuucccagaguaucucucucuguagccuggcuguccugggacuuuguggaucaggguaaucucaaacucagagaucccaccuaucucugccucucaagugggggggucaaagguguguacuaccauacccagcugaaccuuuauuuucucuaauauugucaaguugcuuaaaaaaaaaaaaaaauagguuggauacacuauaacccuggaacuagacugaacucaggaacagaccaaaguggaaacagugaaacuguuaccucagauagauaagcuggugguuagguagacagucccagacacaacccucacugauggccugacacaccucugguuaugccugugaaagcauuucugaaacaaagguguucuguuuugcuguuacugugauaaacacugacugaauccaacucaaggaggaagcguuuauuucagcuuacagguuacaguccaaccaagugggaagccaaggcugugaguuccaggacagagaggguuauguagacagauccugucucaaacaaacaaacaaacaaacaaacaaacaaacaaacuggccauauguauacaugacaccaagcuucacucauaaaagcauauggcuagacagacagacagacagacagacagacagagacagacacaagaaaacugucaaucggcguaaaaauugcgcuaaaauacaugcaugucaccaaaccaucaaaauauaaugcucuggggacgucauguuguggcagaaaaugugcccagcaugccaaaggcccuagguccauccacagcaccacaaaaauaaaacuagauaaucacuuaaaagagcaacagagugcaaaguaaagacucaacaacgauagcugcuagaagaauccgagaacucuaggaauaaagauaaaacauuuaagcuucuaaaaccaacuaccagcaaugaggagaucgucccauacagggauucucaucagaaauaccaagagccacuaaacgauguagcuguagaagagaguugcaaauacagcccagacuucuaaaauccaucuacuucuuuccuauuuagcuagucaaauccaaaacuacaaaacccugaguuaggauaacaagcggccagauagguggacuaagccucuuagauacuauauuuucaauacuacugcuagcagcuagcaauuucuauguacuaauuaggaaccagauuccuuucuauuuaauuaucauaaacucacaagguaaaaauccccaguuuccagggaaaggagaucuuaucgaagcuauagauuuaauuccuuggacuguucucuuacauucucuugaccaccaacauuuauauuauaucuaaauuaguaagagucugguuuaaggaaauaaauguccuuuugaaauuaaaugcaugcuuuaguuuaaauauucuguuuacuucuuaauuaagaaaaucccuacagaacaaacaauaggacacgugcuuuuauuauagacaaaacuaagggugaucuuucacuugcuuguccauucaagagcauuucugcucuacuggagacugacaccuagugggcuaaaacaaacaucaccauugaugccaccauaucaaagacaaacaucacaaugagccaugacugaggguagaaggacacagggcuagggcuugaacucagagccucauauaugcuaggcaaacacuacuacaauaccccagcuccaaaaccuguagauuuucaauuggccuuacauggaaauacauauuuacaucauaaacaaaaacuuuuucaaauuaauuuuacaucggugauuuauaccgauaucuacuaaaaacucauguuauccucagggcucuuguccaugacuguucccuacaaugucucuugagcauucuacgauuauaaaauuaucaugcaacauguuacaccauacagauguuugacuuacaaugaauggguuacauccugauaaacucauugguaaguugaacauacaaacuaaaauacaccuaagcuacugaauagcacacuuagcaaacugugguucucacaucacugccuauaaggucaaaaaaaacgauauucacugaguguacuaaauaauugaacccaugaacauaucucaauccauuuucuuuuuuauaaauauuaacugaaucuuuaacccacucuucacgcagaacagucugucccccaaggaacauuugguaauauacagaggcagcuauggccucacaccauggggaagcugugucucugacaguuaaaccagccagaaaugcugauaaagguucuauauugcacugaacaacccucuacaacaacaacaacaaaaauuuuagccucaaauguuaaugcuaccaaaguugaaaauucugcucccaucaucuuuccuggaagguauuaauuacugaaaaauaucaguuuauauuaaauggaguuuauaauacaauacuguucacaacuauuuuguguuguuuuaauucuucauuuucuacguuguauacuguauauagaauagcuugcuauuguaaaucacagaaaagguacacuuuucaccuucuagaacuugaccaagaauugugaacggcugaaggaaaucacaaguuacagcacauaugccgcccaggcaucaaacaucuacugguuaccuauagcuaucagguaucauauauguggagucauggugacuccacauuuaaguugacaguuauuucauuuauauuuuguugcaggcauuaacuaugccugauuacuuauuaauauuuaaagaaaaaaguuaaauauaaucauuuacauugcauuuaggguauucuacugacuuuuaaacuaauuauauauuagaaguuuauacuggagcucaagagaugacucaguaguuaggagcagugacugcucuuccagaagacuaaaguuugauucccagcacccacacggcagcucauagcugagacuccagugcgaggaaacccaaagccaccuucuagucuccacaggaaacaugcagauaugugauaaagacaaaacacccacacacauaaaauuaaaaauagggcuggugagauggcucaguggguaagagcacccgacugcucuuccaaaggucaggaguucaaaucccagcaaccacaugguggcucacaaccauccguaacaggaucugacgcccucuucuggagugucugaggacagcuacaguguacuuacauauaaugaauaaauaaaucuuuaaaaaaaaaauaaaauaaaauaaaauuaaauuaaauuaaaaauauuuuuuaaaaagcuuauauguuuauuuaaauuucagaugaauaagaguaacaaaauggcugucauaaaaagacaauuuacuaaaucugauuaagcaaacaucauuagacgagacccagcaggugucucugcaccaucagacacacggacaugcuccuggcugccugcauguggcuccgguuucagcugaccucaucuauuuucacagagaucaccuaugaacuccacccaccuucccccuuaaacaagcauggcaaaacacuuaugucuuugcuaguguacggacuguguaaaauuuuuagauguguaucgucuucuucagaauguaagcuucagggcuggugagauggcacacuguaccccaagccugauugccugaguucagcugugaggacccacaugugugaagcagagaacugaccccuacaagcaguccuccacaugugugccacggagggcacguugccacacaguagauaaacaaauguuaagaagaaaugaauaaaccccuuagugcaaugccuucaauuaaugacuacagcacacagaacaaauuauuuaguagguuuacaaauaagcauucagagacuaaagcaaaaacccagaaccugucaaaaacagaaaaguuuguagaaagccuggugugauggcauauaccuuuuaucccagcacuuuaggaagcuuuaaguccagccugaucuacaaagccagggauagagugaggcuacacgaccagaauagcacugugagaugcuuguaucaaaaaaaaaaguugggccaggcgugguggugcacaccuuuaaucccagcaccugggaggcagaagcagguagauuucugaguucgaggccagccagccuggucuacaaagugagucccaggacagccagggcuacagagaaaaccaaaaaaguuugguagagaguaagagaaaaaaaauuguacaguuuucaaaauaaaggaaggguaggaugcccauaaaagacaaauauaaaauggcacuagaacugauuaaaaaucuuaaagaggggcugaagagacaggaggugguugagaauacuagcugcucuuugagaagacuuagguucaauucccagcacccacauggugguuuacaggguauccaacucccucuucuggccuccuccagcaccaggcaggcacuuggugaacagauauauaucuaggcaaaauauccauacacauaaaauugucuuaaaaguuaaggauaggggcuggagacauggcucaguggguaagagcacugacuccucuuccgaagguccugaguucaaaucccagaaaccacaugguggcacacaaccauccauaaugagaucugacguccucuucuggugugucugaagucagguacaguguacucacauauaauaaauaaauuaauuuuuuaaaaaaagcuaaggagaaccauagccacccacaauagaaaugucucaaacaagaagauacaagugaaaguaaaagccaggcaaaaaaagguguccagcauauaaaggggaaagaguuaugacaagugagcugagcuacagauagauaaaaucuaagaacuggacagcaguaaaauaacacaaugcaacugagaggaacacuguaugaguaugaacauaauccuuaagcuauuaucauucaagaacaugcacagguuuaaaacugcaugaaaauauauaacacaucaauuacacaaguacugaaggaaaucaacaacuauuaaaacugugugaaacuucaaugucugauuaaucauuguucagaguaaauagucaaauuuuuaacagguagcaagugaucugacagauuauauguuguuaaaguaaaacaacaagaagcaauaaaagucaaauaauaguuugacaaagaauugaggaagccauaccaaguauaaaaaguuggcaauuaagaagcagaauaacagagaaaauuaaaaagguucuagaagccaucuucugcaaaucuguugccauuaaauguaaggagcggguguagcggcuaccgccgcugccccaagauggcaccccgacagcugccaggucuuaugaccuacaccugacuuucucauuaccucagacauagccacaucccagccgccugcacagcgcagaugccaugccucgucagcucgcgugaaccaauggacugccguuacgugacuggggugacugggaggagucaguaggguauuuaaggcgcgccccgggguuguuagaggggauuguuguuccugcauugcaaugcuaaguguucugaauaaaccugcuugaagaaggucgacgugguguuggguggaugcgacaauuaaagauguaauuuguaaauaaauuauuuugaaagaaagcacauuuaguguggcugacacauaaaacagaaaauuagaaaaauaaauaaaauaaauacaguuaaagaagacacuaacaaucccgucaacgagaaggcaaccaauccaguauaucuuacggaacucuuucaaguaugcaaggaaccuaauacucuaacaaaacaacagaaggcaaggugagcaggaaagaaccuagacgugacagaucugaaguagaaaucugagcaauggguccggagaaauguuucuaucauuuagagugcauacugcucuugauccagguugaauucaaaugagacagagauggagaccaaauaucugacaccaaagguuagucuaacugcaggaguguugaccaugguucaguauuaagaaaucuaggaaaacauuucauaauauauugaauaaguaagcaacaacaaagaucuuaaaagaagcaaaacuauuuuucucagucuaccucuccaguaucuucaccaauauaccuuguccaccauacaagacacuuacuguagcacuggcaaacacuguagcaucuauuuaucacgugcugugaagagacuauacaucauuagagaauacuuguagugcagagaucaaacuagaagaauaagcuacuaacaaaauuuguuccuuaguaugugaaacuuuaccacauguauaccaucauauacauuacuuaucuaaucuggggaggugagggaauaaagacucccauuugucucugucagccaaacaauaagacuuuagaccaacaaaggauauauaaaaugacaaacuaaacuagaugcaauauuaaauaagugcgagaaaaagacaaacaaaacagaaaauggcuaagaaagcuaaggagcaauauucuuagaaaaaucacauuagagacaggaaauauuaauagcuuagcgggaagauuauaagaauacauggcuaggggcuggagagauagcuucaagguuaagagcacugguugcucuucuaaggucuugaguucaauucccaguaaccacaugguggcugacaagcaucucuaaugugaucuggugcccucuucuggccuguggcuauauaugcaggcagaauguuguauacauaauacauaaaucuaaaaaaagaaaaaaagaauauauggucuaacuacugcuaaacaaauaauauuccugaaauggcuccacaaacugcuccugagaaguuuucagugggcugguggguuauuccaaccucuuuucugucaacaacugaccucgacucaaacgucuuccagagcagacaugcugcagaacaagcuucacacgaaaagcugugacugagaauauguggcuacgucaaaggugcccaggaaagguugaaugaacuaagacauacucaugcuggacaaagagaaagagaugcugaaacagagaugagaagaauacgcuagaggcuuggacacagaacucagugggagugccugcccagcaaagcugagguauuggauucaacuacacacacacacacacacacacacacaccccucacaaauucugaagaccauagcauagcccacaacuauauaauugccacaaaggaaaaacaugaauuucuuucuuacaaacuuugguaauugaaagauuccuaagagaauaucagucaccaacaaauauuuauauuuucauaucaugcaucaagucuuuagcagcuuaugaugacaauaaagaaauccauggaagaugagaacauaaagaaagucaugagggaaauacacuuaccacaauauacacacuaugaaaugcuuucccauacagccccacauacagugaaaccgucuugcuguguagcccugacuuugaguagguuuauagaccaggcuggcuuuaaauucacugagagugaccagccucugccuccugagcgcugggucaccaugcccagggccaguaguaaaacuuuuuaaaaauaaaaacuaaggaaacagccacaggauuuaaaacuaaauucuacuuuguacaagugagauaucagcauaagaaaacaggaacuagggcuagagaguuggcucauugguuaagagcacuggcugcuauuccagaggaccuggguuugauuccaaguacccaggugggucacaaugaucuguaacucuaguuucaaaggcucuaauacacucuucuggccucugugggcaucaggcaugcaaguggugcaaaaaaaaaauacaugccagcaaacauucauuaaaaaaaaaaaaaguuaaagcacaaacugcuacauuguaauuucauguacaaauuacuuaaaaccuuucaagucagcauuucaaaugcauucuaagauaugauauaauagauaugugucuuuuagcuauaggcuaagagauggcgaugcuaaaaaucaccaucacaauauuaaauuacaacuguaaguacugcaagcuuuaucaccucaaaacugaaauauguuuccaacuguaagaucugcacaaaauggcucaccuucauccacagaaaacugacagcuuuuaucauugaagaauaguauuuucuucuuaucaggacgacuuacaaauaguaucugguccccuaaagccuugaagauaaaaaaauuuuaacaucaaauuacucauuuaaaaauauauacuauacacaauacacauacuuucucucugucucucugucugucucucucucucacacacacacaccccccuguaucuauauauaggggagagagagaacaggcuucuuuucuuucgacccacaguaaaucauuagggucuccaugccccagguuggagcuuaauuucuuucuucaguaauuuuaucuucaaggaugcugucagacuugucagauaucugucaaagaacaaaaagguguaugugugucuauguguccuugaccgugauugcacaaaugcagaauccagaugucaacuuugggugucuucuugaucaacugaucuccaccuuguuuugugugacagcaucucucacugaacacaggcugccuggccagcugaagagcccuaaggcuccuguuuuacugcacccuggcgcuggagauacacgcacgcacuguuaugugggcacugggaaccugaacucagguucucaugauuguacaacaagcauuuuacuacugcacaaucuccucagucccccaaaucucaccuuuuaaaacaaaauuuaaaccaggugguaguaccacacgccuuuaaucccagcacucaggaggcagaggcagguggaucccugugaguuugacaucagccuggucuacagagcaaguuccaggacagccagggcuacacagaaaaacccugucuagaaaaaccaaaaccaaaagaaauaaaaguggauaacuugaucaacaaaaugaaauguccacauguaacaaacaaaagggaggaaauccucccaacugcugcaacauuugaacuguaaggauauaaaaacaagcuaguuacaaaaacaaacacugguaaaucagacucaaacacacugguaaugacuagaaacaccgugaaaagaguaguuguugccgggugcucuucaguuaugcagaacauaaagguccagggaaucuuguagcauuacaaugugaguaaggucaggcuggagagugcuugcuucagcagguaagagcacuuguucaguuccaagcacccacuugguggcucaugagcauuuguaagugcagcugcaagggauccaacaccucuucugcacaccaccagcacaaggcaugcacacgacucacauacacaaccagucagcccaagucacaagucauuauuugcaacaucuguacagguuaaaauuugauacuguaaaguuaaaguuuaggauaguucuacuuuugauaaaucuacacguuaaauccugaauaucucccaaaaggcccccaggguggcacaguagaagccugguaagauaagaagcccuuagaccaccaagggagugacucugaaagggacugugaggccucggucccuccuuccucucuuccuuccuggggauuacuauauguuccugccauagugugcugucucguaaaacugagcauggacggaaaccucuaaagucauaaucuaaaauaaaccuuguuguuuauaaaucugacuauaucaauuauuucacuguggugccagaaagcugagcaacaaacugacuuugugaggagcaagucugcuggugugcaucuguuauucagcaccggggaugugaauaugaggaccaggaguuuaaggccaaucaugucaacucuugucucaaaaaucaaaagacaagcagcacacaccuuuaaucccagcauucaggaggcagacauuucugugaguuuaaggacagccugguuuacagaguuccaugcugggcagaacuacauagugaaacccagucucccucuuccacugccacgccuccccaaaagacaauuucauaacuucgggcuuuuccaacuuacauauaaaucaauuaggaagaugcaaggcaagcuggagauacagcucagugacacagcacuagccaaacaugcaauggcaacaagcagcuuuuacaagugagccucaaauuuaaucccgaaaauguauucuucaugaccauaacuuucacugccaaccccuuaggacaucagaacuuguuaguaaguaauggcccugguauguuucaaugccucuaguuccuuggguaagcauuaucaaauacuauuguuggaagaguuuuuauuucaaauaacaagagaaacacuaaugccuuugugaaaaacuuucuagaaaucugaagaacuaaaucauuaugcaacauaaaaacaaaacaaaacacaugccucccccuuccccccgaaaaaccuguuaacauuacacaaaggugauuauuuucuuuccugcucuguggcaccgaacaaaguguuuuuuaguuuguguguaagugcuuugucuaaaugcagguaugugcaccaugugugggccuagugcacucagaggucagaaaagggagucauaucccugugaaguggaguuagacagugcugugagucaccaugugggugcugggaacaaacccaacugcuaagccauuuauccuuccagcuccacaaaauucaaauuuuaacuggaccacuaaagccccauguauacagaauaaagacuuuaaaaauaacuccacuuucuucccuccccuuucuuucucccuuuuuucuuuccuuccucuucucuucuccccucccccuccccuccucuccccuccucuucuuucucucucucucucucucucucucucucucucucucucucucucucucucucaaguuuaaaaccaugaagagcagacuagaaagaugacucaaguuaaaagcccuugcuacucuuccaaaggacccaaguucaguucccagcaggcagugugagcuuuagcuccaggggauccaacacccucuccuuuccuugacaugggcagcuacccaaagauacacgcauaaaaacaaguguaucuuaaaaucauaagaagcgccgggcaugguggcacaugccuuuaaucucagcacucgggaggcagaggcaggcggauauucugaguuccaggacagccuggucuacagagugaguuccaggacagccagggcugcacagagaaagccugucucgaaaaacaaaaaaaaccaaaaaaaaaagcauaagaagcugggcaugguagccaccuuucaugguaacccccacuuucagggguaaaggcacacagaucucucaguuccaggacaaccagggcuacauacauaguaagacccugucucaggaaaauaaaaaaccacaacauuacuaauucaaauuauaguuaugauacaggaggaaaagaaacauuaccuugacagcuuucugggaauuaggcagucccucuucuaugucuucuaagagaauuccuccuaguccccgcuggucaugauugucuaaaagccuaagcagggccuucuuaucuuucaaguuguacuuagguuugaaggcauauuucccauccacuacuucaauuuuaggauuguugacuaaagccuguaaaaauaacacaauuuggauauauuuauaaaaagcaaaccccauguguauguucuuaaauucuagcaucacccaacacaguggcauccugaagaaucauaugaacauaaacuagcagaccuaaaacaccagauaucuaggaucccagaccaagugagucagcauaaaguuugcuucuuacuuaaaagcaaaugaaaauuucauacauuauuugcauacauucuuuagagagaaacucguuuuaucauagcuacuuugaagaacauuuacucuuuuagaagacaaaguaaggcuggagagacggcucagcagguaagagcacugacugcucuuccagagguccuaaguucaaauccuauaaucucagcaguuaggaagcugaggcaggagacuacugccaagugugagccagccuauauuacagaguaagauuucagcuagaaguaguggcauaaaacuuugaccccagaaccugggaagcaaauggaucucagugagucugaggccagccuggucuacacagugaguucuaggccagccuggucuacacagugaguucuagggcagucagagcuacacagugagacccuguuucaaucaaucaaucaaucaauaaacaaacaaacaaaaaaaucacacccacauaaaaagaauaaaacaaaaacaacagucuuaggcagguucugcuucuagucacuggugaguaagugacagcagacaugaccuucugugacuuggacuaagucaaaucacuucacaguaugaaaaucaagaaguacaucugacuugauaaaauaaauuaauugaauuaggccagucaugguggcacacaucuauuuuuuuuaaggauuuauguauuuuuguaaaugaguucauauauauacauauuucauauauauaugaguaugcuaucuucauguucaccagaagagggcaucagauccuauuacagaugguugugaaccaccauaugguugcugggaauugaacucaggaccucuggaaaaagcagccagugcucugagucaucucucuacuccagcacaugucuuuaaucccugcauuugagagacagagauaggaggaucuuugugagagaaaaucugccucaaauaaauaaauaaauaaaugauuacaucugguuguuuaggggguauuccuuuuguguuguuugcuuuacuguagcccagacuggcuuugaacucacuaugauuaaugaugccgugguccuucugcuuuuauaucccaagugcugggauuacagacauguacaacuacaucccagcucacauuggguccgcagauacaucacugaucuugaaaaguaguauucguuaacaccaauaaacuuuaaagaaggucuagagagauggcucagcaguuaagagcacugacugcucuuccgaagguccuaaguucaaaucccagcaaccacaugguggcucacaaccauauguaaugagaucugacgcccucuucuggugugucugaagacagcuacaauguacucacauauaauaauaaaauaaauccuuaaaaaaaauaaauaaaauaaacuuuaaagaagcaaauacuaaaauagcugucauucauucacuugcaaacuggcauggucagagacuguuuuaggcguucuucaaaugguauguauuuauuuaaacauuaacaaucauauuauuucucuaaguaacuagaaaaaauaacucauuuaucaaaccacagaaugcuaauaauguaauaaaaugguuuacugucccaucuuaggcuuuaaauuuucuaaagcauauaugcaauauauaacuugugaguauauaagauuaugaguuugacaauucaaaauacuauuuaugacaaugaaaaauugguacacagacuucacaauucuacuguagucuuagaggaccuuuuaaaacauaaauaaaauuauauggaaaccaacagccaaacaaauuauaaaaauguguacauuuaaauucaaccaagacuauacaucaagucucuuaagaaaaaguaaaaaauauuaacaaauuacaggauuaaaaaaaaaacccacucugagccaggcacauugacucaugaagcuaaagcacagagugcacugagccugaagucaacauggaugacaauaugagaccuugccucccacccaccuuucuccucgccucucuccccgucugacacacacacaugugcagacacccaccccaucccaaaauaguaaaacacgucuacaguugaagaugacuugacaguggaccguucuagcacaugcugggcuggguuccaucuccagcaccacacucaccacaaaaaaagaacucuguagcagacacaccuuucuguaaugaaguaauguuuacauuaguguuaagacugcucuuaccgggcuggugagauggcucaguggguaagagcacccgacugcucuuccgaaggucaggaguucaaaucccagcaaccacaugguggcacacaaccauccguaacgagaucugacgcccucuucuggagugucugaagacagcuacaguguacuuacauauaaugaauaaauaaaucuuaaaaaaaaaaaaaaaaaaaagacugcucuuaccuccgucaucagccacuguuucugcuugaguccgaugucuaagugcugugucucauccagaaucucuuccaacguuagaggauguguaucuccccgcugaugucgugucuaguagcaaaguuuucaaaugcguucacuaagucauauauaaacuaauauuuucaggaauauacaacaugugauaucugagacaguaugaauaccaggaucaagaacaugaaaucauacaaaaucagguugauaaaaaaaaucaaaugauaaacugagaagaaaaaaaaaucaauaacuaagucggguauggaggguacacaccuguaaccccagcaugagggacgcucaggcaggauaaccaaaaguucaagaccagccuaggcuacaugaugaguucaagucuagccuaaucuacauaguaaguucaaaacuaguagaggcuacauaacaagacgaagauguguugaucuggauaaggacagcagcaacaacacucccaauacuggggccaaggcagacauguaucuauaagauuuagguaaaaaauauuucuuuaaaagaccaauugaagccaggcccgcuggcauaagccuacacuccuaggaauuugggaggcuaaggcaguagaauuaaguucaagaccagucuggaaaacugaauugagaccuugucuuaaaaaaacuuaagagugagugcuucacaacccagugugugaaguacuuucuucuucaauccccacacacaugcacaucaugaauuuagucagaaaucaaagagaacgcuggaucuggacaguccuugcaaugcucucuaguuugggaaaggaacugaauauaagaguagcagugggggcuggagugauggcucagugguuaagagcacugacugcucuuccagaggugcugaguucaauucccagcaaccacaugguggcucacaaccaucugcaauggggucugaugcccucuucuggugugucugaagacagugacaguauacucauauaaauaaaauaaauaaaucauuaaaaaaaaaaaaaagaauagcagugguuuucacaguuguaccuagaaucucauacacaaggcauuccucacacggcaaucuugagggcagcuccggguacuuuuuccuuuuuuuaaagauuuguuuauuuauuuuauguauaugaguacacuguagcugucuucagacauaccagaagaaggcaucagaucucauaaaagaugguugugagccaccaugugguugcugggaauugaacucagaaccucuggaagagccaucagugcucuuaaccgcugagccaucgcuccaaccuagcucgaaguacuuuuaaaacuuagacaauaaaaaaaaucucuuuuagcuacuuuuaaaaauucuucugccaggcgugguggcgcacgccuuuaaucccagcacuugggaggcagaggcaagcggauuucugaguuugaggccagccuggucuacaaagugaguuccaggacagccagggcuacacagagaaacccggugucuuggggagaaaaaaaaucuucuaaaauggacacguuucucuauuuuccuaaacaguuccaauaauaaucuaaccaccuugucucaguuucuguuuuaaauugccagauuacgauauaauaaccaucucaggaucucauauacugaacaguuuaaccccauaccuaaugcucuuggguuuugauuucaaaguucuuacaucugucuuuucugugugcuuuuuagucuggggugugugugugugugugugugugugugugugugugugugugcacaugcacauucaugcuagcacuuucucccagguucucacuucuugcuauaaaaucgcuguggugauuugaauaguuaggcccccauagacuauguuuuugaaugguuagcccauggagaauggcaguauuaggagauguggccuugggagaaguaugucacugggggaggacuuauugcgauccucugugcucaaguucugcccacuauggaacucaaucuccuucugcugucuucuggaucaagacgggauauacagaacgcucagucccuccagcauaauaucugccuggacgccgccaugcuucacaccaugcugauaauaaacuaagcuucugacacuguaagccagucccaauuaaauguuugccuuuauaagaacugccuuagucauggugucucuucacagccaugaacuacacaaucacuguaucuaucucaguccccuauaaugcuccuugaacuuuucacgguuuuuggggagcaauuaaagcagucuauuacaagcuuuuuugauguucuaguuaccuauuuugcuuuugaaguuaaagguagggagaggacaacugacaaaacuugccaguuuacaaguuaccuucuauuagauaugcacaucuguccuuucaaaacacgccuuaggaggaaggagggagaaaggaagaagggaagggauacggccuacuuccacucauaauuugcaaggcuuuuuguguaaauucaggcacauucaaccuuuugacaucaugacacaguugucaccuacaaaguccauacaccagaccuugcaacaaagauaaaacaacauucauuuccuugugggauggaugacuggucuauacaaagcaaacaaccaaccuauccuaaucaacuuuaucaauaauugcaaagcagcucaaaucagaagguuugccaucacaauaaaucugcuaacuuauuuguauauuacuaaggaaaguaaaauuaaagagcuaauuagauuguaaagcacugucaacuucuuucaacugauugacagcucuccaggaggacaguccuucuuguuauccuacuaucaguaguagauuuuaauaauuguucuacacauagggcaauagaugaaaggaacagucaaaauuuacuaucaucugacacugagaaauauaaauuaaaauguuucuauuagagaucaaguacaaacuacaaaacucaaacacagccagauacccagcuucuaacgcuuuugcaucaaugcuuacuaagaucuggacugauucucuaacuuucuucuccaagcagaaaccagucaccaucaucugcuucaaguauguguucauuugcucagaugaauagagaaaauaucuugaaaaagcauuccauucuauugcucgggcagauggugcgcuuaaguuguauacuggacucuaacaucaacuagauuuaguuaagugcauugcuggaaugccaguuuaauaaaggacaaaaggcuguaaguauuacaucuuuuagggcuuucuugaaguauacucaacauaaaauaaacuacagacuaaaaugcauaauuuaauaacuccuggcuuuguuauauaaauaucuaacuucugaaaacccagaucuaauuccccuuuaguccaaaaaaaaaaugauuuguuauguaaguacuuacuuucauauaauucacaaucuuagcaagaacaccgaacuuauauccagagcuuccagacagagcuuucaaguuaaaugauccauuguuaugaucugaaaaugaaguucaaaugaauuauuuuaacauuucauauaauguuuuaugauuugagcagugaaaauaaauauucuucuuugaauuuuuucaucuaaugaagucuauccugcuuuguuuuggcaaaauucacaagauucaugcaugugcauugaauuaucaauucccaccccacaccuacccuuuuuagagagagggucucauuauguauacagguuagucuuaaacucaccauccuccaccucaguucaaaaguguugggauuauaagguuacaucauaccccuaugcuaaauguaauuuaaaagcacuaaaauauagcuugggaaggagagcgcuggaaaccaaacucagggccuuguuaugaauuaggcacccuaacacugagcugcagcacgagccccaauacuaaucuucuguuguugcugucuguuuggagacagggucucacuacucgaccacuguagccuccagcucauaaagauccaccugccucaaccuccucagcuggaauuaaagcucugugccaccacacccaagucaaaagacaauucuaagcacguauaucucauuccacuccuaccuuaaacuugauuagaggccuccaauaauuagacaagagaauauuauaaacacaagaagugaguaauagucagacugguaucuaucucccuaaaauuuccucuucaucugccucccuucuugccccucuccucucagaaauccuuauguguuguuucaaaacaucuaccauuguguugccucccuacagaaagaacccuaaugccaucacaguaucacaaaugcauuugagucacagccagaaggguuaaaaauuucauuauaaauucaagaaaagaauuucagaagcacacacucuauuagcaagcuaucagaucagaucuacacuuccacuuggaugguccacagagagagugguuaaauaaggaaagacgggaggcuauuucuggcauccgcucaguaauaaccauuuaaacaaaagauugcauuagauaauaaccauuuaaacaaaagauugcaaaagauugcacagucaaacacaacaauugucagagauccaaaacaaguuuuagauguaauauaauacuccuuugaaauuagugaaaagucuuuauugcauguuuccuuuccuuuaauacuaaaauacaauguccuuugaaauuuucccuuagaaauagccuaucauuuugaaaaaaguaacucaauuggcacauuaaaguauaccauguucccaaacuagcaacacgaaaaaugcuuuccugucagcacuugggaaggccagccugcucuacaaagccaccacccuccccccacaaaaaaaaaaaaagagagagagagagaaagaaaagaaaagaaugccuuauugaucuuacugaucugcugauaugccuuuacauacacuguuucaaaauccaggggugguagcauaauuauaaucuuagaacuugguaggcugaggcaggaggaucacaaaagaggaaguacauaggaggggacggaggggaaagaagaaaaggaaaaugaucuauuauuucaaaaaaaaaugggcuggcgagauggcucagugguuaaaagcaccaacugcucuuccaaagguccugaguucaauucccaguaaccacuugguggcucacaaccaucuguaaugggaucugaugcccucuucuggggugccugaagacagcuacagaguacuuacacauuauaaauaaauaaaucuuaaaauaaaauaaaauaaaauauaaaaacaaaacaagauuguuuuucuuccagaggccaugaauucaaucucaacgcccacuucuggcagcucaugacuuguagcucuagcuagcagcuccaggaaaucuaaugcccuuuucuggacuccaaggacauucacacacacauggcauacacucauacagacauauaaaaauuacauaaaaaauauuuuucaaaauguuuaaggucagccaggcagugguggcacacgccuuuaaucccagcacuugggaggcagaggcaggcggauuucuaaguucgaggccagccuggucuacaaagugcauuccaggacagccagagcuauacagaaaaacccugucucgaaaaaaaaaaacaaaaacaaaaaguuuaauauauauauaucucaacuccagggcuagccuggacuacaaaagagacugucucaaaaauaauaauauauuuguuucaguuaugaaauacuaacuauaugguuauuuucccccaagacguuugaaagacuuaauaauaguaauucucauugucccuauuaucugucaaacaucacacuaaaugauuuucacauuuaauccucauggggggaaaaaaucaauuuaagagcuuuuuuccuccucuuuuauuuauuuaguauggggggggguuggucuuccucaacugcuucucuagcuuauuuuuuuuaauuuugucuuacguguauggguguuuugccuauuaccccuugaaugccuuggugcccccugaggccacagcagggcaucagauggcuggagcugggguuacagacaguugugagcacccauguguguaaccaaaccaagaucuucuggaagagcagccaguguucuuaacacuaagccagcccuccugccccuacauuuuuccaaacagggugucucauggaaccugaagcucaccaaauggcuggcaagccccaguaaucuuccuguauccaccuccucaguacuggggugccaggaucuuucauauggaugcuggagucugaacuuagauguuuuugcuugcaccauaagcacuuucacaacucagccaccacccuagcucuaauugcucucuuucaaacauacacauugugaggguuauaaugaggcauugauuuaaaucaagcuguaaacccugaauauugcccuacauaagaucuuuacacaucauuaucccaucugacauaggccacuuugucagaacaaagacauccauaaauagacauuaaccuaggaccucacgaauccuagacaaggauucuaccacugagcuuaaauuaaccccagccccauuuuuauuuuuguuugagauagucucauuaacuuacuuagucuggugccggggagauggcucagugguuagaacacuugcugcuucugcagaggacuacgguucauucccagcacccacacagagguucacaacuaccuguaacuccagcuccaggggaucugacaccugccuccagccucugggcaccaggcacacauguggugcacagacaugcaugcagacaaaacauccauagacauaaaauaauaaguauuuuuaaaguuacuuagauuggucuuaaacuugugauccugccucagacuccugaguagccggaugauaggcccguaccguugagaaaagcauuuuaauuauaauuaguguuauuaaauuuaucuuacaauacuguauuaagaaaagaaaaacugguaaaacuaaaaauaaaaaaauaaaaaaauucacaguauauuaaaaacuccaaacaaaugaucaauuaugaaccacauauaguuuuaucacaaugucccuaguacuaagucaaugcuaaucaaucaaagucaacauucaaauauuuauugaaggauuacuacaauauaauaagggcauuucuaugaacuccuauagcuaggagcuacagcucuagaaacuaauauaaugauuuaccuauaaauuuuuauuuaccuuuacuaugauuuaucuauauauuuauagauguuauaaauagugauuuaucuauagauauaaacaauauauaaauaaauagauuauauauauccaauauauauauauuuacccaaucucccacugguuuguuuguuccauugauugauuuuuggugggguuuuguuguuuguuugagacagggucucaguauguaaucuggaacucacuauacagaccgagccagcuucugccucucaaugcucggauuacaagugugcaccaccauguacagcucuuacuacuccuuuaauuaaaaguaaaucuugauucugcuaugauuaggccaaacucuuuucaccauaacuaaaaauaaugaauagccaagccaguuggacuagacccaauuaaaaacauaaaagcugucuauaucuuaaaauuuagaaaaaaaaauuacccaccuaaauuaacucuacuauaacuaaaaaaacuaaaauacuacuucuuuucucucaaaauuucucccaaauacaaguguucauaacucuagaaaucaagacuugagaacauauugaaaaaaaaaaacuguuuuaauuuuaagcuuacuuaugagauuuuaugaccauuuccugcuaacauuuuacuaaaaugguuaaccugagcaguuguuuccuagguaacuaccucuagagacuauguucuagccuuagcacuacacuguucagagauacguuaaauuuuauagagggaaaaaaaaucuaggaaaucagcaacuguuccuaugugaaaaauuagcuuaaagacaaaacaaacaaacaaacaauuuaaagagguggcaggugacagcucagacaacccuauucaaguuuaugaaugaucuacuccucaggacggcaggacuuaauaaugcaaaugagcacagaggaaacugucagcugcauuaugcgucggaccaauagaagcacagcuccaucuuggcugugcaccagaccgcauuacaaacagacgguaccaucgcuucaacagcaucuuuccagacaagagguagguuuauuugauccuuuuuauucaguagcucauacccuuauaaaacaguaaaaaaauauuuuaccaugaaagccagaaagcacuaugccugcuaaagacguaaaaacaauguauuaacccauuauuugguaagauuuuaucaugaaaaugccgacugccucaugcuauuugauaagcauccuuaccaucugugccuuaauggaaauucauuacauuuccuaccaaucugaucuccacccagaccuuaaguaggacaaaagcauuugauguuuaaccugagucuuugcuaauuucauuuucucaaagcaaauuuauuucagcagucuggucugucuuaacaaaggauguuucucaaaggaaaaaaaucuaaaauagcaaagccuuuggcuaaagcuuucugauuauauguacaaauuauauuggcugguaaaaagcaguuacaagaaagcuuguauaucaacaaaggagaagauaauucaaauuauuuauauuugacuuugaguacuaauguagagaaagcaaagaaaaugccaguuauaauuuuuauauaaaaauuuuuaacauguaucauuaugugagucauauuauauuguaagcagagauaauuuauaaaucaucagauuuuccuaacaucuuaguuaaaauaauuccucacaguaaaaucuuacaauacaagccaugcuaucaaacaaaaaucuuuuaaaauguccuuaaauuacaaggcacacaaaaauguaaaguaacuagguuacucuaaacagguacugauccacacaaauucagucuuucugauaaagcacaucuuaaaauccaguguguccuaggagagcuggcuaagguacaacagugacucucccuaguaaaaucacuuccccagcucauaaucauccacauuucugcacacaguaucuagagaugucagcccuacucagcagaugccaguucugcaaguacuuaacaaucuaaacauccaacucugcccuuuaccuggaugcuaaguauauuuacuccuagguucuuuuauuuuuaacuucugcuuuucuuucuauuccuucuguuucuuagcauucagguuacacagacagauuaucucuugaaaaacucaaaagguugcuguaacaagauacuagaccucucaaguucggcacagcagguuaauuaccuagaaaccauucugcuuaccauacaguaugggagccaaguaauauuaaaauaacuaacaauuaacaguuaauuuaugguuuauauuuucaaauugccuuaagacucauuaacagacuacauuuucauauagucuauaucuauuauuagcauacauggagguucaucaucuuucaaguauaccuuaucucagagucucagagucugaacucaauuagugguucuauaauuuaaaggcuaguacaauuaacugaucauauuucaaagugaugugcuuaaaagugccagagaauuuaauuuaccaauuuucaccauaacuagagcuaaaucauaacuucuaaucuggugauccagggucacaaaaccaauccccauaaauaucccacuggggccuuuugaaaaugauagaaaaauagguacaaggaauauagcaaaaauaacauaaaacaaaaccuaacuaaaaauaugacuuucgcugggcagugguggcgcacgccuuuaaucccuuuaacuugggaggcagaggcagguggauuucugaguucgaggccagccuggucuacagagugaguuccaggacagccacggcuauacagagaaacccugucuugaaaaaacaaaaaaacaaaacaaaaaaaaauaauaauaauaauaauaauaauaugaucuucuuucaagcuucccauuucuauaauaaaauuauaaagggggauccacaaaguacagacuguuauugauuguauuuuuaaucaguuucucccaguuuuuauaauaugcuuacagcacuuccuuuauacaaauuuaauuuucacuuggaaaauguaguccagaauaggacaaccucaugguauacuucuuucaggugcuaaguacaccaaauccauugccauaagauguagucuuuaccuaaaaacuaacacacacaaagccuacuggagcuuuucuauacuuuggagcagcacacacuuaacugaagggcagugaggccugcuauccagguuuacuuguuucggguguccagaagugaacuaaagcaacacuguuuugaauucccaucagcuucaacacuguccacaguggcaaagugucauagcauauacauaaacucagucacuguuguacaaugacuacaguaacucuuacauaagaaaguauuuaacagaagacuugauuacagcuucagaggguuaguccauuaucaucaugguggggaacauggcagcauacaggcagguacgggagcaauaacucagaguacauccugauccacagggaaagagccuggcugggccucggaaugugcuauugaaaccucagagcccaccuccagugacaaacuuccuccaacaaggccacaccuccuaauccuaaucaugacacucucuggugacuggaauaauugaauauaugagcauauggggaaccauucuuacucauauauacuccuccuuaaacugcuuagacacuuucagcaaaacacauaaauaccuuuuguaaacauucuguuacuccauggucacggcaaaucauuauaugaauguucauauguaacuaaaguacacugucuagggucaguauauaagacagugacagagugcuccccagcccuggguuugauaguuuccugaaauccgagucuuucuauccaucacuauuaccucuguucuucaaaaagaaucugaaaacucauuuauguuaacauaaaagcaacugugacaauauguggucuccuugcaagaauauucacauuauacuauuguaaagucacaugggaaguuugcacaagcaugugccuuuacuaaaaaggccaacacacacacacacacacacacacacacacacacacacacaccccuacauuuugucucuauguaaccagguuucugaguacuuguacauuugcauccauacuguucugacccaagacacugacaacacagacgugggauaacagccuaaggggcauccacaucccacaagaggcaucacuuaacacugcauuauaaggcaaugguaccauaaagcccaaggcaacugcugguccuuucccguaagaaugcauuccacagggucugcaucagaugagguccuacaacuaaaaggagaaauggacccacaaucccauuuucucuagaggaaucucacuggggaaacagagcacucguacguaggacgagccaugcucagcaguagguggccaacacaaaauaaacucaaaugacauccuuggagguuucuuugguucauaaaguuaggucagggcuuuuuuuuuuuuuuuaaaggccuuauuuuuuaaccuuacaaguccuuugcauaaauauuauggcuucuaguuuuauguuuuuaugagaucccuguaugugcagaugggugugucucuguauuuguuucuugugcuauuucuuuggcucuucuucuuguuuggcuuuucuguacuacugacuuguuuuuguuuuaucuucuuuuuauuaucacucuuuagaugccuauuuguuuucuaaguagagacagaggaguagaaccagaugguaggguauuggagaagaacugggaggcauacggggcugggaaacuauaaucagaauauuguauggaaaaaaaucuauuuuaauuaaaaaaaaaaaaaggaauguacucucaagggaacaguucaaggauaagguaauuuugaaauccuggauguagagauauagacugaagaguaaugaaauguaccaugaagugacauaccucaccuacugacaaagcaacucuauauguuccucaacuaacaaaaguaauucaauuacauuaucacccacuaaaccuguugucucucacugaagaauaaccaugcaccaccauaagacagaagucuuaaauacaaacagaacagguauuuaaaccuuuacuuuuggauuuagauaaugaaucuaagccuucaaaauauaggaaguaagcaagaggcuagucagagaggugaaauuuuguaaaaacaaacuugauuuagaacagaaacuaaaaccuuauauaacauaaguauaaaauuuuaaauucuguuuuacuaagacgaccaagaaacuuagccaauaugaacucacaguuuggauguguacacaccaugcuuguauuuagaaacagucucaaucuuuuagaaauaaguacugaaagccagacagugguggcacacaccuuuagucccagcacucagagaggcagagggagguagaucucuuuaaguucaaggccagccuggucuacagagcaaguuccaacacagucagagauacacaaaagaaacccuguuuaauuaauaaauaaauaaguaaauagcaaccaaacaaaagaucagugaauuauuucuacauaaauaaugucuaggaguuacuuuccaaugacgcaugucacagaagcaaguggguaaccacagaguguccaucaacugauaaagauguaauaugaacacgcagaggcucauuacaugcucuuuuuugcuuuuuugagacaaaggucuaacuauaaagcuaagacccaucuggaacuccuacuguagccuaggcuggccacaaacucacguuuuuacugcuucugucucccaggugccuggaccacaggcauguaccacgauaccaaggguauuauacucuuauguacuauguugacauuuucuuuacauaaaacauacacauaaaagacaucucugcaauuuagaaaaacgacuuggcacuugggaggcagaggcagguggauuucugaguucgaggccagccuggucuacagagugaguuccagaacagucagggcuacacagagaaacccugucucaaaaaacuaaaaaaagcaaaaaacaaaaaaacaaaagugagacaggaaggaacuggaaacacuagcaccgcauauauauauguucauuuucucccuuggugcagauuccaagcaggaguacaggaaguggagucuccaggauggcuucuggccgcuggaacgaaaccaccaccucuguguaccuuggauuucaaguccaacagauucacccuuuccaugacaacuggaacacugccugcuuugucauccugcuucuguucauaaugacugugguguccuuaguugugcuggcuuuccuuuaugagguacuugacugcugcugcugugcaaagaacaaaaccgugaaggacuugaaaagcgagccgaauccucucagaaguaugauggacaacaucagaaaacgugacagugagguggucuagccuuccacugaagauaaacaaaguuuuaaaaacagccucugccucuucugggaaaaaugaaaauuuccugaggccaaacuuuauuacaaaacugaucugacuugaguggcuaaaagauuucuaguagaaaagaaaccaugugaaaugugcacucuuguguauguauccucauuaaauaugcaguccauaaugugaacuuaccagucuacuuaauacaacucgaaaacuagaugagcacccccagcaugcaccacuggcaacacugagccgcagcuuccaggcagaccauaaaaacgaagcacaacuaacagcuaaaauaagucacuuaggcaaggucacacagauuaaaaaguaguauuuagguagcaaaauccuaccuaaauugugccucuauuaaaaugugccugccucuaaacccagaauaaaacauguccauacagaagcccuuuguuauagcacaaggaaggggaugaagcagucuugauauauagcccaggcuaacgucaaccucaaucgauaggccccagucuccaaaguaaugggauuacaggcauguagcaccacagcacaaagccccuauuuauuuaaacuccaguacuguaaaacugacugaaaacaauauauucuuaauggcgugccuuucagacagcauuaguguuaauaugaauguacucacaauggucaggaaggucacaaauaugauccccacaaacugacuugcuuuggguccaaaagucuaggguauuuccaaacuaaaacacacuacuaugugcuauaaauuacauuucuugaaaguauucuuuuauuuuuacuucuccuauucacucuaucaggaucuaaagauauucaaugcaccaaaaacuguuaagaaaggugaaaagcacuggguggugguggcacaugccuuuaaucccagcacuuggaaggcagaggcagguggauuucugaguucgaggccagccuggucuacagagugaguuccaggacagccagggcuauacagagaaacccugucucgaaauaaccaaaaagagaaaagaagaaaggugaaaagcuuuuguuagaguugacagaguuuugggggguggguggguuugguuugggauuuauuuuauuuuauauuuauuuguuucucuuuguuuagccuugcuuauucuggaacucacucuguagaccaggcuggccucaaacucacugaaacccgccuuccucugccuccugagugcugggauuaaaggcguguaccaccaauacucagcaagauugauuuguguguguguguguguguaugugugugucuuuauguauaugaauguuuucuugcauguacagaagagacuucagauccuaugggacuacaguuacaggugcuacugagccuccauuguggggcguggacuucaauucuauaagagaagcuagagcucuaaaccucugagccaucucuccaguccccugggacuugggauuguuuuauuuugagauacagccaaagcuggccuccacucuccaaguauugggauuacagguuuacacuaccacaccugucucuuauaagaguauuaaagacauuaagcaucucuuaagaacuguggcagucuggggguuagaagauaaacucaguagguaaagaacuuuccauaccauggggaaguaaauucagauccccagaacccacauaaaggcaauugcucgagucuguaaucagcauucauaagcauucauauagcagaagaugaccuccucaaauuuaugggccaaguagcuagggaacacagcaacaagaagagacuccuuuaagauggaaggacaggggacaucuacagcuguugucuggccucuacucuucauguuacaaguguguacacacauuuuaaaaaaaaaggaacauagcagcuucaugccagguaugguggcacaggccuguaaucucaacacucaugaagcagaggcaggaagacuccacaagaccaaggucagccagacccugccucaaaaagaaggaaaggaagaagggaggaagggaggagaagagagaaaaaaggaauaaggaaguucucucucucucagugcgcuaagggguagcccuaccugggagccccggagcuacuuugcuaaagcccugggaaccccuaaagccaccaggguuaugggagagagggaugagggaagagguucccaacacuggcgagaguaagugcagccuugaugagcagagacuaugguuuuagagcuuuauuguagaaaggcagggagaaagagaaaagguagaaaaagagagaggagaaaggcuagagagagaguaagagggagagaggagaggagacaaaaagagaggagagggugagagugagaagugagagagagaggugggggccuaacagccccuuuaauagucuuuacuguugcuaagguaacuggggaggaguuuagccugaaggucagaagcuugggccauugccuaugugacuucuagccaugcuuuuuuugugggggcuguggggggugguaacuuaggcaggagccacaguccaggagcaugagggaaugccgugucauguaggugaauuaucacccuucgggguucagaccucagcuugacuggagacuagccugucuaugcauagccuaauuccucacaaagguaguguaaugguuuucuuaggugauaguaaaacaguauuaagaauguaaacuguucucugcguggccauugggguaacaagaagugaaaugggauggagggauggcugagcaagugcacuugcuguuuuuguuuuuguuuuuguuuuuguuuuuuugguuuuucgagacaggguuucucuguguagcccuggcuguccuggaacucacuuuguagaccaagcuggccucgaacucagacaucugccugccucugccucccaagugcugggauuaaaggugcacuugcuguucuugaagugagcugggcucacuaccuugaacccucauggaaguuaggucuccaacuccaguucuagggcaucugaugcccucuuguggcuuauguaggaaguaggcacacacauauagugcauauaacacauguaaaacguacaaacacauaacauaaaaauaaaagaaagggcuggugagauggcucagcagguaagagcacccgacugcucuucugaaggucuggaguucaaaucccagcaaccacaugguggcucacaaccauccguaacaagaucugucuccuucuucuggagugucugaagacagcuacaguguacuuacauauaauaaauaaauauuauaauaaauauuauaaaaaaaaauaaaaaaaaauaaauaaauaaaagaaagccgggugguaguggugcacaccuuuaaucccaguacuuacaaggcagaggcaggcagaucacuguaugagaccugccuggucuacagagcaaauuccaggacagccaggucuauacagagaaacuuuuacuugaaaaauacugagagagagagagaacuuccuuauuccuuuuuucucucuucuccucccuuccucccuucuuccuuccuuuccuucuuuuugaggcagggucuggcugaccuuggucuuguggagucuuccugccucugcuucaugaguguugagauuacaggccugugccaccauaccuggcaugaagcugcuauguuccuuuuuuuuuuuuuuaaauaaaauaaacaaggcuagagagauagcucggcugucaagagcacugguugcucuuccagagagcccagguccaauugccagaauccauauggaagcucagaacugucuguaacuccaguuccaggggauccaacauccucacagacacacacucauacaugcacacaaaacaccaaugcauuucaaauauaucauugaaaacauaauuuuuaaaaaugcugaauauaacggaacuguugauccuuuguugaaauuacagauuugugccaccauacccagguuauguaaugcuggggaucaaauucagagcaucauacaucguaggcaagcacucuaccaacugagauauagcuugcccaagaacagugaaauuugucuaagagaucaaaccagguaugcauguaggaucaguguaaacacacacacucacacacacacacacccauuuuggggcuagaaagauggcucaguaguuaagaauauuugcuguucuugcagaaguccuaaguuuggguuccaguacccacaaugguucacagucaucucuaacugcaauuccaggggauuugacaucaucuucugaucucugaaaacaccaggcacacaugaaguacacucacacauaugcagguaaauauucacaaaaauaaggaccuaaaaaauaaagaagaaaaauaaaacacaaugaagcucauaacucaugccuauaaccccagcaucagaggaugaggcaggagaauugccauguuaaccuggacuauacaaugaacuacacaucagccuggaauacaaaauaagagacugucucaaaaaaauaaaucaaauaaaaaugcacaaugaugcccagcgugguggcacacaccuuuaauuccagcacucgggaggcagaggcaggaggauuucugaguucaaggccagccuggucuacagagugaguuccaggacagccagggcuauacagagaaacccugucucgaaaaacaaaaaacaaacaaacaaaacaaaaaaaaugcacaaugauacucccacaauaauauuuacucacauccaccaagaacuacuauaaacaaaaagacaagaaagaauuaaguacucgugaggaugagaaauagcuagcccuucauucgucucuggugaaaaguaacaaucuacuuacuaugauggcuaacuuugauugucaacuugacacaucuggaaagagggacccuuaaucaaagagcugccuccaucaagacuagcucugugcacagcacaucuguggggcaccaucuugaaugauuaacugaugugagagggcuagcucacuguguacagugacaccccuggcugggcuagugcuccugaguuguacaugacuaagguuaaagagauggcucaguaguuaagaacacaggcuguucucccaaagaaccggaguucaaucccaguaaccacaugguagcuugcaauacuccguaacuccagucccaggaaaucaaauuaauuauuuuguccuccauaggcaccaggcaugcaugugguauacagacauacaugcagacaaaacacucacauaugugaaucuugaaggaggaggaagaggaggagucugacaaggggaagcagcccaguaggcagcacuauacccaguggucuuugcuucaguuucugccucagcuucccucaugaugggcuguaagccaaacaaaucuuuuucuccccaugguauuucuagucaguguuuuagcucagcaacaaaaagaccaaaccacaacagucauuuugauagauucuuuaaaaguuaaacauaaauucacauuauccagaaauucuaagaauuuucuaagaaucuaggcaagagaauuauugcauuugagacuauacugaccuaccuagugaauuccaagucagccuaagcuacacagcaagauucuauguauucaaacuccaucaaccaguaaauaagcaaacugugauauaucaauacaauggaauacucuuuggcaauaaaauacuaacucacccaauaacauggauaaaaaugaaaaacauacuaaauaaaagaagccacguauaaaagcacucccuguauacaagucuauguauagcaauugucuagaaggcaaauguacagacagaagguagacgguugguuaucuggggcuaggaucagaaaucaccacaaacgagcacaucagaccacugaaugagaauggaaauguucuaaaaugggaguaauuaguugcacuauauuuacuaaaaaagauuugcccuauaauuuuaaaauguaaauagcguguucuagaacccaacccucaguaaaguguagguuuuugcuuuuguuuuuuaaaacuuuucccccaguaagagugguauauacacuuuuucgcccuuuaauuuuauuguauggauguuuugccagcaugugugcccauggagaccagaguuaaagguaguugcaagcugucguauggguucugaaaacauacuauggauuuaaauucaucuuuuauauuuaaccaagaaacucauuaagaauauuaagcuugcuuggugugacagcacaggucuauuaaagcucuaggaggcagggcagccaacucugugggaccaucuugucuacauaggaaguuccaggccagccaggaacugcauagaguccauaucucaaaagagaaacugaacgugccauuacuagcuucccgaaaaauaguaacagacgucccaaaacaguucuccucaccugaauuuuguuuagagccugaggauccuccauguucgacuuuugccuucuucuucuuggaugaggaggaggagggugacucagaaggcacagcacguuuuucuaccacaggaguggaaagagcucguuuuuugaacagcucucgaucucucaauaggcuuggauccauaaugcuacaagacaaacacgaaccuuuaauauauauucagaucacucaaacccacaugccaugucuacagcccuuggcaaguuaguucccacaacauagagugucacuguucugugcagcagcugcacauuaaguggcaugagcagggcugcagcagugugcacaaggacuuccagggcuaccucaugagcgagcacuucggggaaccagcugccaacuagggucuccccauugcagccaucaaugacauuuagaagucuccagagaucaucaguggauagauggcuuucauccuuuguugccacacugugacauucaugagauuugccuacaagguauaaccuggaaucuggcuucuaucugcacaucauguaacaaaugaaguagaucagcuccuucagggagcacagcuuaucaacugugagacgaauuagcaauacaagaaccagcucuuaaaagggacagugcccagucacuucugccaaaccacaggucauuguaaauagucucgcugaggggaaaacacagaaugcuaucucuaauaaccaugcuaacuuuauagaacagccaagaaacccuaagccaagucugcugccuuaucaguuguaaacagcuaccuucaagagcaguccaaaauauguaacuaauaauucugaauggugguuaucuccaguaauauggaguaugcauauauagugauguucacauauugggauuuguguaauaaaaaucaaagggaacaaaauuuuguaacuguaagaacuuucauauucaaaauucuugacuuucucuuuaaugacaacaauauauccuucaguuagccaaauacugacaaauaauuuccugagguaaaaaguuucaguguuuuccaguguauagacucagacuuguaacuuaauggcaauaaaugacuuaaguauuucuauaaaauacacaugcauacauacauauauguauacauacauauauacguuauuauauauacauacgcacacagagacagagaaauuauccuccccagcuggcucuagcugaggauauaguucagcugauagagcacuugccuuguuucauggggcccuggguuaaauccucagcacacacaaauuuuaauuacaagcauaacucacacuugaagcucacauuauauacuguguaccagugcucuagaaguuagaaagcauauuuaggcucauugaagaaggaagggggagaagggggaggggaugggaaagggaagaaaagggaaggaaaggggaggaguggaacugcuauaaauuaaaugguguguuuuaaaaaccagugcccucuuauuaauuaagaaagcuggauuaagguauuaaaaacaucuauagaagcugggcauagugguugcacaccuuuaaucucagcaauuaaccuggagcagaagcaagcagauuucugugaguucaaggcaagggucuacauacagaguucuaggacagccaggacuacauagaaagacacuggagggguaaaaguguacagaaaauuccugauuuaggagguaaaacuaaaugaucauucccgcuccucccccccaccccacccccaguuauaaaacuguaguuuuauaagcauuuuuaagcaaucucaacacaaccagaacacaagaaccaccaguugaaucaccaugaaucuuacaaaaagucuuuucucuuccuagcacucugcagcacgguucagaaaagcucacucuugccccugugaaugaauuucacacuaguguucagucaggggggaaagaccacucuacagaggcuacuuccaaugauaacccuuucauacacugaaaauauuuuaaguugaaaaaaaaugcauucaauccaucuuuuguacugaacauaaaugccuagcaaccugguacacaacagcauaucaacugugccuuugugauaucgacugggagcucacggcagcugccuagcaucauuaaaguacuaagucacuagccuagcaaaacagcguuaaccucaaguucaguuuuuacuaaguauugcuuccacguacaucuucaggaaagccggagcauccuaacugguuccacacacacugaguuccuugauuaaauaacagggagauggagacuggagauauagcuugcuggaggcaaguggcagugugacagguucaaucuugauccaaagggauuuaaaaaaaaaaaaaagcacucauauggaaaacucacugugaacuuuauguaagaagagucgaagagucccuggucuaagaguaaaacaucugcuccucccaguuucaauuccuaacauuugagcaaauaaucuacagaacugcucuaaauguaguuuccuccuaggucuggggaauggggcacuaucaguguuguacauacuuggcucaacucuaaaagugaggaaguauuuaugaaagauuuuuuuucaagaguaauuguuauuuugguuguauuagguaagaaauuaacauuaacuuaauaugcaagugagagagguaugaguagggaaagcaugaaaauaagaaaaaauucacaacgugagaagacugaggaaacaggcaguuugcaacuccuaaaacaggaacauuuuacuucauaaggucagaugacuaaucuggacgucaaauaaagacuuuaggacagaucaaaccuguacaacuuagaaaaaccuaacuacauaaugcccacaagucugaaagacuaagcauuagugcuauggcuaauuuuaacacauaaaaccugaauagaaguggcacaacuaaguaagaagucaugugucccagcccuggaacccuagcaaagcuuucugaaauaagagagaccucucuauaugaugauaccaacaaaggcacccagagcaagcgguuuacucuccggaguuccaacuaacuuuuccuccuuuugcaaccaacaucuguacugcagugcacaucuuagggcuaaccugggugguaaagaaacuauauccacgucuacuuuacauuaaucuggucaaucaaaagccccgaacaggauguuacgaccgagagcugguacguuucacgguggauagcuaccggaaaacuaacauuucaaaucuucaggcuccacuguccaguucuuuccuaccccagaaucugcaaucuuccagcagccugucugucuacucugucucucgcuucacggcucgcccccgaguaccggagcacaucaggaaaacggagcgcagaguucgaucgggaaaauaccucucgacuccuccgaaaacucacaaccucaaaaaguuuaaagcagcauuagaaaagccagucgggaggggacgccauggugguccccccaacuccacacagggaugagcucggcugcugugguuguggccaagaagcggucggcaccauccgcucgcccacccggaauccuucccgcuuuccaacccgaaaguuugcuguauggacguccggccuaaaagacaaugcuggcuggggcgagccccuccucucgggggcucggcuuuggagaacggcucggcggcguggcguccacgcgcgcguccccucggaagacgcgucccgcuucggggcagccgagucccacgcgggacucgucccccuucgcccgccgccgcagucccuaccucagcgcccgcagcccgcgccgccucccagccuccgccucggccgcacgcacgcacgcacucacgcacgcacacacccgcccaccgcgggcccgcuucccgccccccgccgccgucgcggcgcgcacgcccaacacggaccugccaagggggucgaacccgaggcggccguggugguggcguuggcgacacagccccggccccgcccuccacuuccuggugcggcggcuaggacgcucgcucccagcaaccaccgcgacgccgcuccgaaaaggcgccugcgucacggcgug

SEQ ID NO: 4388 - RNA, 3520 nt, Mus musculus
cagcaagaaccagccucacaaaccucauguacccaucuguaaaaccucaaaaccaaugaccuucucagcaucccuuguuuucuuaacccuuuguuaaagaguaacauugaaugccgggcagguggggaugggaaaucgaacauuggcacgcuuccagcgcacgcacacauccaugcacacacacacaugcacacguaaacacgcacucacaaaauccaguugucaucucauggggggggagggcugaggggaguaugucaagaacagccuuggcuacaucgugaauuaaaugccauccuaguccauuuagagcccuaacaucuuaaaggaggggguggagcacagugaauuaguauccacuuuggacuagguacauaaauguuaaccaacuaucagggcaaaccauaagccuuuuuuuuuuuuuuuuuuuaauuucagguuuguuuagaaacuacauaacccuggcuauccuagaacuugcucuguagaucagacuugccuugaacucacagagauccaccuuccucuggauucuuuuuguuuguuuguugguggguuguuguuguuguuguuuuuuuguuuuuuuuuuuuuuuuuuugagacaggguuucucuguauagcccuggcuguccuggagcucacuuuguagaccagucuggccucgaacucagaaauccaccugccucugccucccaagugcugggauuaaaggcaagcgccaccacgcccggcuuuccucuggauucuuaagacuugguggauucuaaggcuugugucaccacugccuggcuaucuccacuucuuuuucuuuuuucuuuuuuuaagauuuauuuauuuauauauauacacuguugcugucuucagagacuccagaagagggcaucgaaucuuacagaugguugagagccaccaugugguugcugggauuugaacucaggaccuuuggaagagcaguuggugcuccuccgcuucuuuauauuaacauugaaaaagagaccccuaccccuaugagcacgacuccaccagucauuacaggaaaagcacaaauaaaggagagggcuaauugaaaaccaagacuagucccuaaugacccaacauccaaaaagcagguaaggcgggggaggguccuuacucacucucccagcacacuagcuucuuggagcauucuggaaggauacuacauucaaaaacagagagaggccuuuuggaaccucccgccuccuaagucuugcgaaucacacauacuacaagguaauuacaccuugguagcacuuccccucugagcacaaagggagaccugggcuacuucaguaauaagaucgcacuuuuggagcuuguccccugguccccggcggccuugaguaggcagccuagaggugacaaagaggaauuuucacaaaaugugauccugaggcgucaagaagaaaauccucuguaggcucuccccugggauugcacuggcuagugaccagcauaucuacacggugacauaaaggagucucggcaaucagaugaccucucgucauuagcaucacuccugaagggacuaacugaaguacccggcuaauucugagacgcucagguuucuccuaccuuugcgaaaucccaaaugcugacaggauuaaacuaggcugccuaaacccgucuuuuggcuuuuaaauuggugcaacaauaccgcacuacaggucgaaauccuggccucucuuccuggugugucccugucuuuuccuucucuuugcuguucauuaacacagaucauaauggcuugcaaggucuagaccuugcaagaaaugcagccacaaguugugacuguuuccuuuccuucccgggacuuagccgggcaccaaacaagacagcagacccacagaaaagccagaaaugaaaauucugacccauagggcauacggccuugggcagucuuuuuuuaauuuauuuuuuuuaaucuccgauaaaaauaaaauucaagcuucucuagauuuugauagcuuggccuucaacaacaacaaaaaauccugcaagucugggagcugaugacaaguuuaagaaaaaggcaaacuccucggacucugaugaaagggggaaaaaaaacccaugagaaauacuauauauaccuagauauuucugacuccugcccucccccacccccagcugauaaagauagcaaauacuauuauaaccaggcaguuucuaaguaauacaucuuuauguauuaaaauuagucuuuuucccugagaacucucgauuuuucccccuguccccagaagccuuuucucuuugcuugcuuuucaucacaagguuucccagggaugggaacuccauuuucuggacacucgccgacaugacccacauuuucaauuaccagcagcuacauaugcaaacuauucugaaaaagaccuucuuucaacaucuggccuauccugugcaccccgaacccagaacuccuugcugccuggccucgucuguacuucgacaaauaucgucauccaaagaaggacccuucuauggcacacuucagcccuuuccugcagcccggggccucgcugauucuucuguagcuggcugcgcuguguguccugucccacugcaacaggaugcugcggaggacagaggcccccacuuccuagcucagaaagcaacugccuuguucaucaccugcuggucaauacucccccuaaacacccucuuuucuuuuggcuuuugcuugcugcuccucaaacaggauccacacgggcucccugccugccaucuucccgcagcaaaucggaucacacucagaagagucacugacucucuggugaagcuccaccaccuucuuaagaauaggcuugcgggcuggagagauggcuuagcgguuaagagcaccgacuacccuuccaaagguccugaguucaaaucccagcaaccacaugguggcucacaaccauccguaaugaaaucugaugcccucuucuggagugucugaagacagcuacaguguccuuacauauaauaaauaaaucuuaaaaaaaaaaaaaaaaaagacuaggcuugcuucugguucaagccaccucaaccuucauggcaccuguuagcuugugcaugacugccccuccgugaaacugagcagcugugccaggcaggcaacgcacauuuucaguggcagcauuagggaagcagaggcaggcggaucucuugagugugaggccagccuggucuacgaagcaaguuccaggacagccagggcuacacagggaaagcugucucgcaaaaaaacaaaaaaggagcaacagaaaaaggggagacucuucuggaucccagcaucccuccgggguccacaccugaaggcccucaucagucagucacagucacacgggcgcaguuccauaaaaccaacagcgaaacaccagugcuggcuggacucaucuggacacaccuguaaucccagcaaggacacacaaacaugaaggaaaaacaaacaaacagaacccugcauuagcuucugaggauacuaaaggaaaaaaaagaaaaaaaaaaaggccgg

SEQ ID NO: 4389 - RNA, 3520 nt, Mus musculus
ccggccuuuuuuuuuuucuuuuuuuuccuuuaguauccucagaagcuaaugcaggguucuguuuguuuguuuuuccuucauguuuguguguccuugcugggauuacagguguguccagaugaguccagccagcacugguguuucgcuguugguuuuauggaacugcgcccgugugacugugacugacugaugagggccuucagguguggaccccggagggaugcugggauccagaagagucuccccuuuuucuguugcuccuuuuuuguuuuuuugcgagacagcuuucccuguguagcccuggcuguccuggaacuugcuucguagaccaggcuggccucacacucaagagauccgccugccucugcuucccuaaugcugccacugaaaaugugcguugccugccuggcacagcugcucaguuucacggaggggcagucaugcacaagcuaacaggugccaugaagguugagguggcuugaaccagaagcaagccuagucuuuuuuuuuuuuuuuuuuaagauuuauuuauuauauguaaggacacuguagcugucuucagacacuccagaagagggcaucagauuucauuacggaugguugugagccaccaugugguugcugggauuugaacucaggaccuuuggaaggguagucggugcucuuaaccgcuaagccaucucuccagcccgcaagccuauucuuaagaaggugguggagcuucaccagagagucagugacucuucugagugugauccgauuugcugcgggaagauggcaggcagggagcccguguggauccuguuugaggagcagcaagcaaaagccaaaagaaaagaggguguuuagggggaguauugaccagcaggugaugaacaaggcaguugcuuucugagcuaggaagugggggccucuguccuccgcagcauccuguugcagugggacaggacacacagcgcagccagcuacagaagaaucagcgaggccccgggcugcaggaaagggcugaagugugccauagaaggguccuucuuuggaugacgauauuugucgaaguacagacgaggccaggcagcaaggaguucuggguucggggugcacaggauaggccagauguugaaagaaggucuuuuucagaauaguuugcauauguagcugcugguaauugaaaaugugggucaugucggcgaguguccagaaaauggaguucccaucccugggaaaccuugugaugaaaagcaagcaaagagaaaaggcuucuggggacagggggaaaaaucgagaguucucagggaaaaagacuaauuuuaauacauaaagauguauuacuuagaaacugccugguuauaauaguauuugcuaucuuuaucagcugggggugggggagggcaggagucagaaauaucuagguauauauaguauuucucauggguuuuuuuucccccuuucaucagaguccgaggaguuugccuuuuucuuaaacuugucaucagcucccagacuugcaggauuuuuuguuguuguugaaggccaagcuaucaaaaucuagagaagcuugaauuuuauuuuuaucggagauuaaaaaaaauaaauuaaaaaaagacugcccaaggccguaugcccuaugggucagaauuuucauuucuggcuuuucugugggucugcugucuuguuuggugcccggcuaagucccgggaaggaaaggaaacagucacaacuuguggcugcauuucuugcaaggucuagaccuugcaagccauuaugaucuguguuaaugaacagcaaagagaaggaaaagacagggacacaccaggaagagaggccaggauuucgaccuguagugcgguauuguugcaccaauuuaaaagccaaaagacggguuuaggcagccuaguuuaauccugucagcauuugggauuucgcaaagguaggagaaaccugagcgucucagaauuagccggguacuucaguuagucccuucaggagugaugcuaaugacgagaggucaucugauugccgagacuccuuuaugucaccguguagauaugcuggucacuagccagugcaaucccaggggagagccuacagaggauuuucuucuugacgccucaggaucacauuuugugaaaauuccucuuugucaccucuaggcugccuacucaaggccgccggggaccaggggacaagcuccaaaagugcgaucuuauuacugaaguagcccaggucucccuuugugcucagaggggaagugcuaccaagguguaauuaccuuguaguaugugugauucgcaagacuuaggaggcgggagguuccaaaaggccucucucuguuuuugaauguaguauccuuccagaaugcuccaagaagcuagugugcugggagagugaguaaggacccucccccgccuuaccugcuuuuuggauguugggucauuagggacuagucuugguuuucaauuagcccucuccuuuauuugugcuuuuccuguaaugacugguggagucgugcucauagggguaggggucucuuuuucaauguuaauauaaagaagcggaggagcaccaacugcucuuccaaagguccugaguucaaaucccagcaaccacaugguggcucucaaccaucuguaagauucgaugcccucuucuggagucucugaagacagcaacaguguauauauauaaauaaauaaaucuuaaaaaaagaaaaaagaaaaagaaguggagauagccaggcaguggugacacaagccuuagaauccaccaagucuuaagaauccagaggaaagccgggcgugguggcgcuugccuuuaaucccagcacuugggaggcagaggcagguggauuucugaguucgaggccagacuggucuacaaagugagcuccaggacagccagggcuauacagagaaacccugucucaaaaaaaaaaaaaaaaaaacaaaaaaacaacaacaacaacaacccaccaacaaacaaacaaaaagaauccagaggaagguggaucucugugaguucaaggcaagucugaucuacagagcaaguucuaggauagccaggguuauguaguuucuaaacaaaccugaaauuaaaaaaaaaaaaaaaaaaaggcuuaugguuugcccugauaguugguuaacauuuauguaccuaguccaaaguggauacuaauucacugugcuccacccccuccuuuaagauguuagggcucuaaauggacuaggauggcauuuaauucacgauguagccaaggcuguucuugacauacuccccucagcccuccccccccaugagaugacaacuggauuuugugagugcguguuuacgugugcaugugugugugugcauggaugugugcgugcgcuggaagcgugccaauguucgauuucccauccccaccugcccggcauucaauguuacucuuuaacaaaggguuaagaaaacaagggaugcugagaaggucauugguuuugagguuuuacagauggguacaugagguuugugaggcugguucuugcug

SEQ ID NO: 4390 - RNA, 16689 nt, Mus musculus
gaugaucucugcaugggauugcagagccuggcacggccugggagaggcggggccugagagacccgccuucugcuuuccagguucgcgcuugcgugcugaggaugguuugcuuuucgggguuggcuuggcuugcuucgcuucugccuccuggaaagucguuuuuuccacuugacaguguuuaccaagucuauccuaaccccaucagcccugauccuuaucguuaaguucacucuacguuuaacuuccucccuaagccugucaaaaucucuuuugaacaucaaauccaguuuuuaaacgucucuuuacaagcgcgcgcgugcgcgcguaugcguguguaugugugugugcuuggcucuucugaggcuuugucaucucacgcuauuaaacuuugaagaaaccaagcugucuuuccaucucccaacuacugcuacguaggacccagguggcauaauaaggauucauucugagaagcaaaaccagcaggagauaugaauuacgaggguuuuguuaggaauuaguuagggaucugcugugcaaguucgaaacccguagaucaagcugggacuuuuucauuuggaaggccaagcugcuacccacagguggaauuucuucuuuucaggggggaaguuucaguguugcucugaacccuuuaaacugauugaaucuggcccacuccugguuauccgggacaaucuguuucuuaauuaagcaauuucuagucacaccaagaaauaucuuaaaggggguguguuggggcuguuggcucaguugguacagugcuugcuuagcaugcaugaaguccagaguucauuccagagagucacacgaaacuggccauggcagaacccacccauaaacccagcccaggaaggaucacaaauucaaggucacccuugguuacucagaguuauggcuccugccauuuuccugguuuuuauagugguuguuguauuguuuuaacaguuuuucuagugugguuuauucuuuuuuaugauuucucagagggacuuguuucucucuucaaucugaaagauuccuucaggucuucuguagaccuggcuuagugguaauguguucuuugagucugguuuuguuuguuuguuuguuuguuuguuuuugguuuuugagacaggguuucucuguauagcccuggcuauccuggaacuaacucuguagaccaggcuggucucgaacucagaaaucuaccugucucugccuccggagugcugggaucaaaggcgugcgccaccacugcccagcuuugagucuguuuuugcaguagaaaguguuuauuuuuccuuuagcuagaacacguagguuuagugggugcaguaccagaguacuuucagacuuugaaauacaucauugugagcucuugcaagacguuuaaaguuucagcugaacagccuaccuucauucagagggacacaccuguucaggugaugugguguggugaugcucucuugcacuuuaaauacacuuuuuuuuuucuuuuaugguccuccauguuaguguuuuaaauacaguaugacaggggagguucuuuucuggucuuccugucuagugcuuccuguaucuacuuccucaaucucccuaaaccugugggggccuuuccugucacaauucuuuugaaacuguguucuaagccuuuaggauaagauucuucacuucauaugucuguagcccacagaguuugucuuagacuuuagaguagaucuuggaacucccauuuauacuuuuuuuuuucuuuucuucuuauuuuuuaaaagguuuauuuauuuuauguaugcgaguauauugucacucucuucagacacaccagaagagggcaucagaucucauuacagaugguugggagccacuaugugguugcugggaauugaacucaugaccucuagaagagcagucagugccugucuucaccucugagccaucucuucaccguuguccuugcugaauugcucuaguuccugcaggugucucuaagaucaaacauucuguccucuccuuggucuguccugucucugagguuucccacggggcuauuuguguugguguuuuuguuguuuugagacaagagccucacuaugcaucccuggcuggccuggaauuggcaguguagaccaggcuggccuggaacucacagagacagaacacaccuuuagaaagaaaaggguuauuuuggcuuacggauccagaaaaauaagaguaugugacugcagaggugaugcagggcagcaauuggcggacacacgggcaggaacaggaaguuaagagcucacaacuggaaccacaagcacagaacagaaaaagcaaggaauguggcaaagccuaccuucugugacaccuuccaccauuaaggccacaccuuccaccguuaaggccacaccuccuauuccuccucucacaacaccaccaaauucugaucaaguguucaaauaccggagacuauagaggugacuuuucuuuuuuuuuuuuuuuuuuuuuuuuuuugaaaauacaacuacagaacauuucuuuauuuuucacugagacuuucccagaggcuauaugacuaaccuuguccccaccccacccccacaaaggguuagugcgcucacugcuuaaaagcagacucgacaguuucaaggaccggaaccaaccuuaaauggcaaaaauguuuucuauuuguauuaucauaaaaauguuuaaguaaaaaaaugaaaguaaaggagcaaagggccacgguggcuucagagugacaagaucauucacgguucaugucagacauucaaucuuggcuugaguguaacaacguugaaacaggaucgcuaucauacaaaagguucgcuacagcacgcuguauguaccuguuccaaguccacccccagccccaaugcuuccgacucaauuacuucccagccuguugggccugccgacggaggagcacguagaucuucucuuugauccagucuuuguuauacggcugguaugucuguguaucagcucgguaaaccagacagcugaggucugccagaucgucaauaaaaucaaacaacuggcugauaucguaugugauggaagggcuguugggauucauccucuucagauguucuucauacauuuuacaaacaccuuccaugcacucauucacagacucauagucagcauaaguccugcccucuggccucuugguaggcuguaccagcaaaauggugugagacaucgcgccaaacgcucuugcugcagccgccgcuaaccuagaggugacuuuucauucaagccuccacagacucacuauguuuuucacuucuagcaucucagaguaguuuuucuucaguauuucugucucauuauuggauccuucuauccuguaucccuuccuuauucagcugucugugccuuugaacauguuugcaauccuuaguuugaguucuuuggguggguucaacuuacucucacuaaaugcucuuacuagaggguuagcaucuuuuagagaaguuuuguugucauaacugugucauacuaugucacuguguugggauuuguauaucugaugauaguuuuguugcuugguuuauuauuuuucgacuuuacugguuuguauuguguuaucguuuuuauuauguauauaggagccuugcauguauuucagugaccuuggaggccagaaggugucaguuuucccuagaacuggaguuuuagacaguugugaaccuccagguggaugcagagaauagaaccuggauccuuuggaagaacauccagugcucuuaaccacugagcaaucuugccagacucuugguugauugguugguugguuuuuaaucauuaauuaauuuauuuacaguuuuuaggaguauggauauauugccugcguguguguaugaaugcuauguguauuugugugcccagagaguccagaaggaagugucuaauucuuggagcugaguuauagguggucgugaaaugccauaugggugcugggaaucgaaccuuggugauuuggaaagugcuauuaaccacagagacaucucucuagcucccggcucugggcuuucaguugaaauacuugcagggcucaaggaggaccugggugugguaguguugaguguguagcuuagaaaguaauuccccaguccaggggcucagggugccugcugugagcucuguauuauucccugagagggauacgcuagguugucaucacuauggggcugccauacaagcaaguuaacaaugagugaccccauaacuguuagaggagaaacaccaaggauaguguggugcuucuucagguuuuaguucaucagaucaggaaaaggagggaaaugggggggggggguuauguauuacaaugacuuugaaaagaaaaaaaaacccacaaaguggguaaaguaguugggagaagaaaugaagacacugucaggaugcccagauuuuaggaauaauuaaugcuaucaaagguuauaaugaaggagcaaaaagaagggccuggagagauggcucaguggcuaagagcacugacugcucuuccagagguccugaguucaauucccagcaaccauuugaaaguucacaaccaucugucaugagacccaaugcucuccucuggugugucugaagauagugacaguguacucauaaaauaaacaaguuaauuaaaaaaaaauaaaguaagaggaggagguaagaaugagagaaagaaggcacaggaaggagaggguguauaugagauauggcugaagagugaagaaugugucauacuggagagugcuuacgacagauggcucacagaugcuuuuaacucuagcuccaggggaacugauauggucuucuggccucugugggucacacacacacacacacacacacacacacacacacacacacacacaugucuuugaaaaaaugaacguguuguagcagcaaauucaauggagaagcguaagcaacagcccuaaggccuggccgagcaaaauacaaacaagaucaaagacaccaugagauguguaugcagcgauacaaauggcauaauagaaacugagaggugaauauuggcagagugaauugcuggcacgguugugcugaguuaaaggugaaguucucagaucccucuaacucuagcauguuuuauguggcauugugucggagcugaauaauagaaauuuggcccacaauuuuagaggcugggacgcuugagaucagaguauuauaguucuauggugagggcuaguuccucauggauggugccugucacugcagccucauggaguggaaauaaguucugguaagcccuuuuguaagacacuaaucauauacgggagggcagagaguuccuugucaaaucuccaaagccccaccccuuaauaccaucaccuugaggauuaagcuucaaggagagacacagauauccagaaccugguauccuguaauaaaacgcagaccaccccucuauugugauuauuuuucuucauaaguucucauuaagcugaauuuauuuauuguacugucuucccuggaacugagauccgugagaguaagacucuggagguguuucuuucuuucuccagcaccagagagccuagcgugggggcgacagcacccuccucaaauguauugagcccagcucgguaaggaccuccuugcgauguccaggcuaagcagacaggucucaacuagccgagagauggcuucucacucuugcuuuaaggaagucucuuuuacauuacuuaucccucaaagaaaagauuuuauaaaaauguuuccuuucacacuugcgugacacuuaacuucaauaaauguuuauugaauacaaagcauauuuuuaucccuagucugugugcuggagauguuguaauaaaugaaacaggguccuggccuuuguagaucucuugcuuugcuuauaaagggcagaaaauaaacuaacccagcaauagguucgugauuugggaggggugauguugcucuggaagaaaagucacucuaagagagguaguugaagcuggcaggugggggcacacgccuuuuaucccagcacuuacgaggcagaggcaggcggauuuuugaguuugaggccagccugguuuacagagugaguuccaggacagccagggcuacacaaagaaacccugucucgaaaaacaaaacaaacaaacaaacaaauaaacacccccaaaaaacaauaagaaaaaaaagaaguaguugagaagaggaguuuuauuuuuuuguccugugguucugccuuccuuugguccuaagccuuucuguccacaaccauugauuuuucucauuaacuuagugaagaaaauauagaagaguguaauggccggaaagaagauaauaugccacacugccugcaagguacagccucugagagugacuuuucaguaaacacugcgaggggagagaaugccugcauacuuugguuuccauggcuccgccccucuguugggaagccaaccuuuacauugcuuaucuccagugcuuccauuucauuuuguccggcaggccuuucuacauccuauaaaaaggcuacggagagcccaguugugacuucccuuuuacaagggcaccgcuuagggacucuaggaaggacagugggccucacauucaggauggauuggcuccagcucuuuuuucugcauccuuuaucauuuuaucaaggggcugcauuccccuuugcgcuucuguuuaauuaucucugcaucuuggacaccuuuuccacccgggccagguaggcuggauggcuaauacugccuuuccaucuagggcuacaguaauaggguggaacgcgcagaguggucauuuaacuacccuccauuugugaugcgugcgugugugagcuuauaucccuccacccaugguugacugcuugaaaaugauugucaauggcucucaaccuucccaaugcugugauccuuuaguacaguuccucauguuauggugaccccccaaccaggagauuauuuuuguuguugcuacuuccuaacucuaauuuugcuaguauuaugauuugugauguaaauaucugauaccuaggacagcugauacuugacuccaaggggucgcgacccacagguugagaaccaccugauuagaguaccgcagacuccaaaauuaacuucauguuugcguugagaugccagagucccgaaagguaugcuacuuaguuuguagcagucuuaguuuuuauagaauuuugcuuaccauaaaauuaaaguguauggaaagccuugcuugugaguuauacaucuauaaccgaguaugaguuuuuaaagaugucuuuguuucuuugcuuguuuuguuuuugagaaauaacucaaaacaaaucuugguagauuauaccuuauuuggucuaaaaucauugccacuaaagaucugauaacugcguuacaugcuuucuuugugaacacauuagaagcagacucuguuuugaagaggccuuaguggaagauauccuuuugaaaagucagcaggcuauugcccaaagcugccuccuaauuuuucuuauuuaggaaacuaagauuuuuagugaagcugugugcggguguauguguccucaugugugugguguucaggugugugcguguguguguguguguguguguguguguguguguguguguguguguguguaugucuguccacaugucugugggguccagaauugaacccagggcuuucacacauguuuaaauguacucuacugcuaagcaccaucucucagaccuaguggaucuuccuaaguaaaaugcagcuguaggugauauuuauaauuacuagguuugauuaaacuagaauauauuauacaguguugacaauugguagguggcccuuacccuuguuucugggagaugaccauaggggacaguuauuuauuuguuuuacuuguuuuguuuuuuguuguugacacaggguuucuauguauaguucuggcugucuuagaacuggcucugcggaccagucuggucuugaucucagagaucugccugccucugccuuccaaguccugggauugaaggugugcaccacuacccccggcuuuaggggaacgguuauaaagaagcuuucuauauaggaagauucacgaaguauuaaagcaaagugagcauaaaagucacggcuaaccccgugcagcuacgcuagggcugagucuuacgugucugggugugugcaugugcaccauguguguacaagagcugauggaagucacaggagggcaucagauccucuggaacugaaguugcagauggguguggucuucucaauacggacucuuagaaucaaagcagaacuccacaagagcaauaagcacucuuaaccacugggccauuucuccaucccuaagacuguugagucuuaauucuuuuuuuuuuuuuugcccccccuccaagucuuaauucuuggacacacacacaacacacacaccuucacuaaauaaaaaucuagguuuccucgauaagaaagguuagggggcagcuuugggcacagccugcugacuuuucagaagcaucuuccacuaaggucucuucaaagcugagucugcuucuaaugugcugaacuguguaugugaauagcuuccuaaggcacccuguccuuaccuauaaagugaagaagaagaagaagaagaagaagaagaagaagaggaaggaggaggaggaggaagaggaggaggaggagccugucucuggucucuugcaguuaugcucacuuuggugcuggggaugaaccaggagccuugacaugccaucaaggguucuaccaggaugacaccccuaacccucacgauuauuuacuuguuuguuucugagauagggucucagcguauaccccaggcuggccuuccacucuuaauuguaugaucucagccuccucuguacuagcagaaagccuagaaaugaagucaaaaccacugggcaaauuaugcauccuacacuguauacauguguagauauuuguuugauguuuauuaauccuuuaauucuguuaccuuugugugugucccuagcuugcacuucugcaguacaaggaauaaauguccucucuauuuuuauauaguggcuuuaucaccguuccacugcugugaagagacaccaugaccaaggcaucuuuuaaaaggaaagcauuuaauuggggguucgcuugcagguuuggaggguuaguccaugacuacuaugucuggccgugugguugcaggcaggcacugugcuagugcagucgcugagagcucacauccugaucugcaggggggcugaguaacaccccuccuccagcaaggccacaccucuuaaucuccccuaaaccacccacccacugagaaccaaacauuuaaauauaugcgccuaugggcgucauucccauucaagccagcagagguugcaagugaaggcugaggucccaagaacagacucacacgaaugcccagggcggggcuugaauuguaugggcuggggugucucacugagguaucugcuggucucaguaacuguugcuaacacgugcugggcacuccacccagagccagaugugcauccccagugacaguuucuccacgcuccaaguaguagagagaugcaagcuuuguccccucaccucgcuguacccagccuagacccucugacacguauucucacgccuuccuccagcuuuacuaacuuggcacaacugagaugaaaaccuuccauauucugcauaaagaagaaccaagaccacagaauauggucucucccagacucuucacaccuucuucuuuggggcuucugagcgaggaccggggcacacacugcugcuuccaugugggcauggaaccuuucaacgcugaagaagaugauuguguucugcuuuccuggaugcuugaagacugaucacugugauggaagacauguugaucaugugacuucgucagugucaaugaacggucacagauguuguuuacccuaggaaggcaguaacacuaaagaaagaaaacuggcacagucagcuauuggaugcaucacauugggcucccaauggaggagguagagaaaguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaacuuuauaugccucaguacaggggaaugccagggccaaaaaaugggaauggguggguagggaagugugggggaggguauggaggacuuuugggauaguauuggaaauguaauugaggaaaauacguaauaaauaaaaaaaaaaaaagaaagaaaacugggaaaacuugggcaaauguacaaagccauaccagacaaaaucuuuucuuuuuucuuucagucuuuuugaaacauggucucacuauauaugucaggcuagucuggaacuugcuauauagcccaggguagcuguagaauuuguaauucuccugccucagucuccugaguguuuugggauugcagacauggaacucuguguccagcaaguuuucuuuauuucucucacaucucauuuggugauagcaagacaaccaauaucauuuaugguucuuuggcuuacacaaugaagaaggaagccacggauugcaugagaugaagaaagacugaaagguaguggaauaggggagcugaggacagagugaagaaagcagagaagggaccaguucugugcuggagagaagaacaagagauccugcagugacugauccgcaggaauugcagauuuucauaacggaguugguaaaccauaaaaacuuaaaaacaaaacagcaaaucaugagguccuaagagucgaaguacaguagugaggacgaaaugcugacaucaagauuugcugcucaugagugcagauacuugcccaagagacgcacugggucuccucucuccagcucccugaaauacacacugggugugcacgccgugcgugaggagggaggaaaggguaugugcuuuggaagugggguugauggcucuucuacucucauuuacacucagucagaucuugaagagccccguugccaagcuguuugagacuguccucguuauuguucuauugcugugaagagucacagugaccaaggcaagucuuagaagagaacgcaucuaacuggggccuuauucaguuuuagagggcgagucuauuaucaucuuggcaggaagcaugguggcaggcagaggcaucaggcugagaacuuagauccuaauccacaggcagagagagagagagagagagagagagagagagagagagagagagagagagagagagaagauuggacuuaggaugggcuuuugaaaccucaaaacccacccccaaauaucacauauccuccaacaaggccacaccuccuaauccuuccuaaacaguuccacuaacuguggaccaagcauucaaacauaugaaccuauggcgggcauccucauucuaaccaccacaagcuccuacugguuauagccacuuguaccauggucaugcaagagucaccaggguccuugccacacuguucuaaaugucacuuuguugucccuuucuuucagguaccucuuucuccuggcuggaggagguguccuggcuuuugcugccaugggucccuacucucugcucaucuucaucccugcgcucugcgcuguggcucuggucuccuuccucaguccacaggaaguccauaggcugaccuucuucuuucagaugggcuggcagacccugugccaucugggucuucacuacaccgaauacuaccugggugagccuccacccgugagguaaaggccccuguccgagugguugggcugagcugauucuaagccgcacacaucuguggagcaugcgcauaaguuacuaaaucucucccgcggcucagcuuccuuucccagaaaaagaauacaaagcggcaauagcuuucuugacaggcugugguguguuugagcugauggaaaugcaguuccauaacuacccaccgccauuugguuugcagucuauagaacucaguaucuggcacucguagcugucguugugccugggagugacaugacgacaguaugcucaucucugccuuggcagcuuugacacagccacaucacagaggaccuggcuggcugcugcuggcugcuaucuuuauucaggcagggccucagcugcuuuaucgcuuccucuacccaaucuggaaagcaacaaaggacaaaaaccaagagcuaauuacagaccagagacacuguguugugagucagugggauugacagagacuagcgaagaaaauacccgggacucugagaucuaauguuccuggcucccuguggcugucggcugucugugucacucaugacuguacugggcgggucaccugucugauucuaaccuacuauuagcucaguggauuggccacucccagugcaccuagagucuuuuaaaaguuauuaugacaaaccagaugcggugcuuccugugcaaggcgucacacaugugugauuguccuaucucuuuagucauguuuggaugagugucugcccauuacgacaucucuuuaauugcuucuucuuuuaaaaaucccaccacaaggagggagaggcaagaggaucaggguuuuggcgucgauccucaguuacauagcaaauugaggaccagaccgggauacaaaagacccugucucaaaaaccacaaacagaaacauaagacaguguucaucgaggacuucagacuugugcgcuggagcgauggcucagugggugggaaugcuugcuguguaaauccgaggaccugaguucaaaucucaggaacacagagaaaagccaugugacuaugugugcagcuguaaccccagcucugcauguguugggagagggggaugacaggagauuacuggggcuaacuccuuggcauaguuccagguucaaugagagacucuauaccaagggaauaaggcaggcaucgauugagcaguacauacauguucuccuuuggccuucacacaugcauacacaacacacacacacauacacacauucucucucucucucucucucucucucucucucucucguuggggugcgugauagagauugacauaagguucgucuuucugggaaagaauagauaguaaguaggcaggauuccuguucuggacaugacaaaucaggacugcaguaggaagccagguccugacagaggccggaagggccaguugaacaggcucugagugggaggaacucugugcagaugugcaaugaaaguaucugcuagcuagccagaacuggcauggcaaagccaacugacugggugauacacgcagcagaacugcacagcuuggcggcuagugaugguacaggcacaguggcugcuugcugccuuugaggcuucucaucuuggcuaaucgauggcugccuucucuggguugucacauggucauugcacgugugugucugugucugaucauacacaugugugauuguccuaccucuuuagucauguuggaugagugucugcccaguauggcaucucuuuaauugcuucuuuuuaaaaaaaauugauuuaauguauaugaguacacuguagcugucuucagacacaccagaagagggcaucugaucccauugcagaugguuggaaccaccauguaguugcuggaaauugaacucaggaccucugaaagagaagucaguguucuuaaccacugaaccaucucuccagcccccccccuuuuaaauuuauuuauuauauguaaguacacuguagcugucuucagacacuccagaaaagggagucagaucuuauuacagaugguugugagccaccaugugguugcugggguuugaacuccggaccuucagaagagcagucgggugcucuuacccacugagccaucucaccagcccccucuccagccccuuuaauugcuucuuuaaagacccugucucuaaauaugcucacacucugagucacuagggcuuggaacuuaaggaugugaauuuggugggggagggggacacagccugcaacagaggggaaguuggauuuggaggugacccugcucucaagauaagucaggcaagaggaucugaugaccuuaagucagaaggagacacagccauggcuggggacagugcuggcuucuucauuauacauagugugauugucauuuucucuggcuguccucagcaaucucagagucuccaagggugucacggagagaguucagaagacugguggaaaacaaguguuaccugcuuaggugcuacuccuccuccucacccugaugcguuuucagugugcacccccaggcaccggaauauuauaaucagggccuggcuuauguuuaacaauucaacuuccuggaaucaucuuuuuacuacgaauucuuauuuauuuuauuucuaaacuucuuccaugucuccagucuuaauuucuuuuuauugauuuuuauuuuuuuuauguauggaauggucuagaaauuacucuacaguauaggcaaaccaacucacucuccuccugacccagccucuugaauguaguaugugucaccacaccaggucugauccuaauauuuguaagccguucucuuuuuaaaggaacauuuuuaauuaauuuauuuaugauugauuuguuguacacaacacaguacuccuauggaguucagagagcaacuuuugggaguuaggugguuuuuuucauuuucauuuucuuuucuuuucuuucuuucuuuuuuuuuuuaaccacgugggaccugggaauugaacugugguugucagucucaagugcccacugagcuaucucuccagccguuuauaagcuauucuaaaauauuauaaccaggagguggagagauagcucaauggcuaagagcacugacugcucuuccagagguccugaguucaauucccagcaaccacaugacagcauaaauaugagucagauggguugggguaagguuuucucuguguaguucugacuguguaguucuugcucugaaaaccaugcuagccucgaacucagagauccaacugccuuugccuccgcaugcugagaugcugggauuaaaggagugugauacccggccugggauaauuagugguuuugcccuggaauaaugcacgguucugaaagauucuaagaguguuuguggagcgugauuugcuaugagaucugugggcagguuggaggcgagagaacaagugugagacaauaaauauggcguggcuucacauacauguuuauuuaaaugucuuucagguucuacaucacucuuucuucccucaugcucuugacgcagagagucacaucccucucacuggacauuugugaagggaagguggaggccccgaggcggggcaucaggagcaagaguucuuucucugagcaccugugggaugcucuaccucauuucagcuacuugcucuuuuucccugcucuccugggaggcucccuguguuccuuccggagguuucaggcuugcguucaaagaucaagcucuuuguauccgaguaucucuuuucgggcucugaccuggaggggucugcagauucucgggcuggagugccucaagguggcgcugaggagcgcggugagugcuggagcuggacuggaugacugccagcggcuggagugcaucuaccucaugugguccacagccuggcucuuuaaacucaccuauuacucccauuggauccuggacgacucucuccuccacgcggcgggcuuuggcgcugaggcuggccaggggccuggagaggagggauacguccccgacguggacauuuggacccuggaaacuacccacaggaucucccuguucgccaggcaguggaaccgaagcacagcucuguggcucaggaggcucgucuuccggaagagccggcgcuggccccugcugcagacauuugccuucucugccugguggcacgggcuccacccaggucagguguucggcuuccugugcuggucuguaauggugaaagccgauuaucugauucacacuuuugccaacguauguaucagauccuggccccugcggcugcuuuauagagcccucacuugggcucauacccaacucaucauugccuacaucaugcuggcgguggagggccggagccuuuccucucucugccaacugugcuguucuuacaacagucucuucccugugauguacggucuuuugcuuuuucuguuagcggagagaaaagacaaacguaacugaaaucuuucccugcccuucaucucaccuagccauuaaauacugcuuaggaaaugccagaagaugccuugaugaauaauguauuuaaaacuauucauagugaaaguuuuuaaguauuggauggauaaaccugauggcuggccacagagauguguuucucuucuguggugguuugaauaguaauggcucccauauguuuauauauuuaaaugcuuagagggugacacuacuugaaaggacuaggagguguggcuucaucggaggaagugugucacuaggcuuugaaguuucaaaagcccaguccuaguuuagcgucuuucccuguagcuugccgaucuggauauagaacucuuagcuccuccagcaccaugucugccugcaugccgccaugcuuccugccaugaugauaauggacuaaaccccuggaauuauaagucagccccaauuaaaugauuuccuuuauaaaaguuu

SEQ ID NO: 4391 - RNA, 789 nt, Mus musculus
ugacuuuucuuuuuuuuuuuuuuuuuuuuuuuuuuugaaaauacaacuacagaacauuucuuuauuuuucacugagacuuucccagaggcuauaugacuaaccuuguccccaccccacccccacaaaggguuagugcgcucacugcuuaaaagcagacucgacaguuucaaggaccggaaccaaccuuaaauggcaaaaauguuuucuauuuguauuaucauaaaaauguuuaaguaaaaaaaugaaaguaaaggagcaaagggccacgguggcuucagagugacaagaucauucacgguucaugucagacauucaaucuuggcuugaguguaacaacguugaaacaggaucgcuaucauacaaaagguucgcuacagcacgcuguauguaccuguuccaaguccacccccagccccaaugcuuccgacucaauuacuucccagccuguugggccugccgacggaggagcacguagaucuucucuuugauccagucuuuguuauacggcugguaugucuguguaucagcucgguaaaccagacagcugaggucugccagaucgucaauaaaaucaaacaacuggcugauaucguaugugauggaagggcuguugggauucauccucuucagauguucuucauacauuuuacaaacaccuuccaugcacucauucacagacucauagucagcauaaguccugcccucuggccucuugguaggcuguaccagcaaaauggugugagacaucgcgccaaacgcucuugcugcagccgccgcuaaccuagagg

SEQ ID NO: 4392 - RNA, 1200 nt, Mus musculus
guccagcaaguuuucuuuauuucucucacaucucauuuggugauagcaagacaaccaauaucauuuaugguucuuuggcuuacacaaugaagaaggaagccacggauugcaugagaugaagaaagacugaaagguaguggaauaggggagcugaggacagagugaagaaagcagagaagggaccaguucugugcuggagagaagaacaagagauccugcagugacugauccgcaggaauugcagauuuucauaacggaguugguaaaccauaaaaacuuaaaaacaaaacagcaaaucaugagguccuaagagucgaaguacaguagugaggacgaaaugcugacaucaagauuugcugcucaugagugcagauacuugcccaagagacgcacugggucuccucucuccagcucccugaaauacacacugggugugcacgccgugcgugaggagggaggaaaggguaugugcuuuggaagugggguugauggcucuucuacucucauuuacacucagucagaucuugaagagccccguugccaagcuguuugagacuguccucguuauuguucuauugcugugaagagucacagugaccaaggcaagucuuagaagagaacgcaucuaacuggggccuuauucaguuuuagagggcgagucuauuaucaucuuggcaggaagcaugguggcaggcagaggcaucaggcugagaacuuagauccuaauccacaggcagagagagagagagagagagagagagagagagagagagagagagagagagagagagaagauuggacuuaggaugggcuuuugaaaccucaaaacccacccccaaauaucacauauccuccaacaaggccacaccuccuaauccuuccuaaacaguuccacuaacuguggaccaagcauucaaacauaugaaccuauggcgggcauccucauucuaaccaccacaagcuccuacugguuauagccacuuguaccauggucaugcaagagucaccaggguccuugccacacuguucuaaaugucacuuuguugucccuuucuuucagguaccucuuucuccuggcuggaggagguguccuggcuuuugcugccaugggucccuacucucugcucaucuucaucccugcgcucugcgcuguggcucuggucuccuuccucaguccacaggaaguccauaggcugaccu

SEQ ID NO: 4393 - RNA, 11469 nt, Mus musculus
ugggaggagaaaugggcucgcggggcagaaagugaggcgaucccgcaaagacaucgcccgcaucuucacgagcuccgcacgcucucuucucgagaccgcggggacuccgggccggagcugccccgcacguccccagcuggccccccucagccgcggaaggaaggacgccggcccggcccggcccggccucgcgcgcccccacgcccccgcgcgagccgccggcggaagugcagcggggugcacuuccggguguugucuggccgccgccgccgccgcgcgucucgggucucccggccaccgcccgggucguggagccaggagcgacgucaccgccauggcgggcaucaaaggugggccugggccgcggggccggggccguagggauggggcggggcggcguggggacgacccagccgggcuccuccggcgguggcgcuccgccccuggaccagaacggggcaacccggccaccgacgcggucugcgcgaguuugcacccagagacauugagggcugcgaucgggaggaaugcccggcacggcaaaccagugugguuucccacccgaggcacgaacgcgcccgucucccaaacccgggcucugcauccgcucccgggaucgcggugcacaggcuuucccugccucuuaaaucgaaugcaucuuugguguuuuuaaggugcaguagagcccggaugcuaacccagagugcuccuggcuuccuuucccccacaagugcacguugacacuuuguaguugugauuuuuuuuuuuuuuuaagaagaaagguaacgaacaccuugaugaaagguuacuugucuauugguguguuuucuucagagagaacgggauguugcauucuuugaagacagggaacuuggcucaguaguagucuugccccugggguuagaagcaaaguuuuguauuuacuuaucagcggaucacuuugauuuccugaccugcuuuguagaagagauaaccuaguuggaaguaaaaacaguuggauaguggugcuuccaccucgcugguaagggcgacuuuggcugagcuuuuucccugguucacguuuuuucuggugucuuguuuauuuucggugccuaaaaaaaaaaaagauguuauuucucguauagaaccuugucaucugagcaacuaggacacuuucggaucucuuuuugagcuauaauagacccuuucaaguucuaacguggauggaaguuacuguaaagugcuguucuuuuuaggauguugccugcguuucucuacccaccugcggugucauuaaugagggacucuuuaaaaaaagaaaacaguuuuuaugguucuccaaaucuggauaauguuaauccuggugacagugacuggggggggggguaauuuuacuuuuuaaagauuucagugccuuuuaaaguuacagguugcuuaucaagauauuucuuccuguuggccuuuagauugcccuuaaguaaggaguauugcuguaaagaccauuacauauuucuugagccaguugccugcuacucugugauacauuauauuuucugcuaacucccaggccggggaacuugaccccuucaccucugucuuuguaguccaucuuuagagaauuuuugcuagguaauugggcuguuccaucccuggcccagaggcuuuggaaguagaaaccacacuccucucuguuucauuuuccgaguguugcaucagucaauuacuguaugaauccuuaccuuacuggugugucacuuaagacaccguugauauaaaauaagccaccuagcugccagugucauaagacuggagagacguuacugguuuggggagcauuguggagcaguuuguuuacgugugucagcuuuuaucugugaugacuuaagagaugagaugucacaugcagauggcuuugaacgucuuuuaaauacugaguaucgaaugcauggaaauaugacccuaggguaucuccauuccccaaacacuucuacagggcuuguuuuuucauaugugaguacuugaaaggaauuggaucuuguauaaauaaaugcaucgguaauuuuaugggcuggagagauggcucagcaguuaacagaagagaugagcucagauccaagauccgagcaucccuacccagcagcucacaaaagccugcaccuccagcccauaguuaccucaucgacacacagacagacacacaccuccauaauaaaguaagcauuuuaaaauaaggauucucuuauaauauugauacaguggcuguaauuuaagcucaaguuuuaaauguguuucaaugccagaaccuuauauuuugguuucuugauuuuuuuaaaguauuaugaguuaacuuguguuauuaaacuuuuguauuagcauuuuugaacauuaugcaguccaggcuaacuggaacccacauucaacuugccucagccuucuuacuaggauacacucaaucaaucaaucaaucucucucucucucucucucucucucucucuguguuguuguuguuguugugguuguuguuguuguuguuguuguuguuguuugauacagggccucuguguauuacugacuauccuggaacucacucuauagaccaugcugacccucaaacucaccugcuucucugccucucugccucggccuuccuccugggugugcaccagcaccucuggcagccuuuucuuauuuauaaaaggaagaacccaguuaaauaaagguaacuaguuagugggcaauaggggacacaaugcuguugccacuccacccccucccccccaggcuguauucauucuuuguuacugauuguuuaagcugggacaugggugaccaaagcugaccaggaacauuuggaaaggaaagauguuugggaagcaguuuagaauugcaacucuggugacagagcaaggagcugcagcugaaggcccggcacacaccugcaccucucccugcauuccuugacuauugcccaguugccaccucuucagagacaccccgucaguaaccugccuucccaccccuuacccuaccugcuuguggucaucacuggacauuuguucuuuaagucuuuaacuuccuucagaguucauguuuacugagcaaacagaaugucccaucucacuuucucagcaaguccuuuguuaaguguuuauugagcaccuacuguauggcaggcccuacacaaaaucuggaggauacggaauucauccuuuaaggguuucuaucuuugugggagaccauaaguaagguccauggacauaaaucguguucugggaacagagagcaguucagaaagugaaagugcacagugagcaggcugaaggcaccucaggaggacccgcagcagcuucaccguugacacagccugguugcuuacaugcuggcuugcuuccuugcuugcuuguuuuugagacagggucucaaguaacccaggcuagccuuaaacuccaguucaguauauagccaaagcuggccuuaaacuccugauccucccugcuuccaccucccagcugcuagaauucccagagugcaccgccacaccccacccuuguugaucauuuuauggacuagcaagauggcccaucagcuugugcacacagauagcauacuguaaauaaaaugugauaacuuuaaagagcuauuucauucucccacuagaacgugagcaccauaaagguaaaagcuuugauuuucuuuccuccccguugcucagucuucgguagcaggaaccaugugacacacauucagugcucaguguguugugugaauaaauaaacacaaguggggguugaauccagagccucaagcacugucccccugaguuagcccuuagccccuccguaacaguaguaacuacagugacagaguuggugugguugugaggagcgggugcuugaguugccgucugaagagaacgaguccucgcuggaagagagacagagcaggguaggaacacuggagcucgagggagccggugagaucccugcugaguccucggucucugcuguguguuuggcuucaaucaguauuucccgaaugaaugaaugaaugaaugaaugucacccugcgguagggugacaaacgugcacagaagcccuguaggugacacagcugcuggcuuccagagaaggaaagagggcgauguaggaugucacaacuauugccugugcggcggagucaagggcuguagacaggacugagagaaccaggagggaagcuucguguacuccugugguuacugcauccccuguaagccucaagugcucuguuugcuguuuaaaaugaaauaaacauucccuugacuuccccccacuguuccuggaaauaucaacuguaaugacguuaagaaacaagcaugcugugaucuuggugaccugacugacucuuguuguauucagcacuccagcugacaccgugcuugccaugacagugucagcggccaucuugucaguaguaguacucaacgucugacuccugugacacuaauuuugguuucuguucuguaguugguuuuuuuuuuguuuguuuuuuuuuuaaccugguaaauuuuagacccucacauagcuuuggguuuuaacuuuucuguuaagguuauauaccauagcagguauuuuuuuaagccggcgaaguggcucagugaguaaggaaagauguuuaccgcuaacuaagccuaaugauccaagcucagcccccagaacucacaugggggaagagagcaucuccugcaagccaugaugcucugaccuccuccugcacacaccugaagucaauaaaucuaaaucauaaguguaacaaaucuuaccaacaaggcuguguggaagucgaacugaucacguuucuaucgguugauaucuaggucauugauuauauacauaauaaaguuguuucucaguuugaaguauaccagccacgucugggaagcuuccaagguggaucuugagguaggaggcaucuuccuucugugcugugguaagacagugguaccaggaccacaccaggcugcacugucacccuacagaucgccuagaauuuagggaaucgggcgcaaagccacugugucucuguaaacuguugaaagacuaacaauaacuacaggcaggucgauacugugaagucucuuucauuuccuuaaaaaacaaucauaaggcagguuggguaucugaguuugcggcuaaccugaucuacauagcaaaguccagcuacacggugcgauccugucuaaaaauauuuaaaacaaacaaacaaaaacauaucauaaauaaacuacacauagucucgggcagcuuuccguucaguuuugugcuuuuguguuucuguuuccaugagacuuuucugccccuucucccuuccccucuucaugggaauauugagugguauugcguguugguccuggaggucggaagacaauuuagagugaucuucuccugucacuucuauauggauuccaggaauugaaguggcuuuggggcaucagcuuagugcuugacucguguauggacuaaauacaguguuggggcgggggacauuaacucucugugccuuaauaguucugagaaauggaaccagaaauggugcguguuagcagucagucaagacugaugggcggguuaaauguucccuauugggagcgauuggguguggucagcuuguggauuuccuaggauuuaggaauauuguacguaauagguacuugggaugcagagcacauguuccagagaagguuucacuguguaucccuggcuagccuggaacucgcuguguagaccagagaagcaccugccccugccucccuagagaugggauuaaaggcgcacaacaccaggccuggcugacaucccacacgucagagccuuuccggggauuaaggaggguguucaaccucuaacacauguuuuggaggugccauagaaacuaauucugaaacuguguaguuggcaguuuugaagaccgcucacauuuguuuugcuuuuugagaugagucuuacccuguagacugaucuuuaguuuguauuaacccuccugccucagccucugagggcugagauuaacaggcugcuacucccaaugugggaugauucacuucuaacaacuugaauuuugaggggaggcggaguuucucacuugugggauuccaggucccgcucagacugcugugcgugugaacagagacggcacuguggcggccugacugaucucuggggguuuuguuuguuuugcagcuuuaauuaguuuguccuuuggaggagcgaucgggcugauguuccugaugcuuggaugugcccuuccgauauacaaguacgucauuuccuuuucuuuuugaauguuuaaagggaacauucuucuacuaagguuuuuaacaugcucuguuuccuacuacuauacaagaagcggagagaaagguuaauucaccaacauagaccuuuuccgaagaucaucacuuaaaguugauuuguaaagacacuaggaugcucaggcagagagcuuuuugugcccugcuucugcaaugagcugguggcagaaacucagcccugcugcccaugauccaccgaagaagcauccucugcagaaggaaaccccggcagcuuccgagcacagcugcaggugguugcuguccguagccuggggagaacuuucuacugagacaucgucucgcuagguagcccaggcuggccucacacacagucagcucgcuccagccucucaaguucuagaauuccagggauccgucacugugcccaguauagaaaaccuuuuaaauuaauauuuaaggaacuuuguuuucaauagacaaauggguagaaguggagcacaagucgcagagagaauugugccgcuaauaagcacgugaaaacacacugaaucccacuccacacuacccgaaauccacuggugaagauaaaggaggugggcgggugcugcugggugccggcagguggggacuaagucaggcugggguuuauaaagggaggaguugccauuucuuggaacuagauugcuugugcccuguagcuccucgaccuggcccuccccuucuuagaaauccccacacaaauccacuuacaaaggcuuacgaugguaccguaguuggguaagagcauugcuguucacaguugcccagggaauagugaaauggaaauaauagcaaaauauguaauauuucauauauaacauauauuauagcaaagauggaaaacugaugaugacaucauaaaugcccaaaccaaagcuaaauuauggagcgagagaugguguaguggaucgagcacuugcaauagagacaugaggaccugaguucaaaucucaagaccccauguggugcaaaaugaaaacaaaaaggaaaagaaucuuugaaagaaagaaagaaagaaagaaagaaagaaagaaagaaagaaagaaagaaagaaagaaagaaaacauaacagauagcucuagcaagucuccacuguauacauaauuaagcuugucaaccaaaaaagaccauucauuucuuauaaguuguuuaauagacuguugaaaccuugacagagauauggacagagcuucccaguccccuucacacagcuuccuccgcugaacuugucaaagccggcaagugacgucagcacagcacagcuaccgacagaguagaaacuaugguuuuaauaccgucuucuguuacauccuacacguagauuucaguaagagcaaucguggauacugugacauuacuagaaggcaggauguaaagguuuuuguguaaauagucuuaaguaugccuucuuauaugcuaaagcaaaucuuggggggaggggccucaauuuauaaagcauuuugucaguagccauuuuuaauauugugccauaauugaacacaggacgagcugacuacgcuucucacgagagcucgcggcuuuguuuccaagcgcagcuuguuugcuaccuugugauaguccccugcucuacagcaggagcaugguuaggguguugaaaggugacgcgucugacugcucugccacugacuccgcucucuuuuccagccaauacuggccccucuucguucucuucuuuuacauccucucgcccaucccguacugcauagccagaagauuaguggaugacacggacgccaugagcaacgcguguaaggagcuugccauauuccucaccacaggcaucgucgucucggcuuuuggacucccuguuguguuugccagagcacaucugguaaguggccauacucuacgaaugcuuuuauagcagacuguccacucucuucuguuuugcuaugugaaagagagguggcagcauuaggguggagaggacggauuaaagccucggcuuuccgucucuucuugcugucagacugaaacuguuggaagacauggcugggcuccgcagcagaaagggcacaguaacugugcugugcauccuccggccagccuguccuguaaagcccgaaccggugguucucagccuuccuagugcugggacccuccaacacgguuccuuauguuguggugaccccaaccauaaaaauaguuuguuguugcuacuucauaacuguaagcuugcuuaugaugaucauaauguagauaucugacauguaggguaucugauaugccaccugguugagagccucugaccuaaagcacagaugugugagacacuuauccucugagccugggaaagugugaaagaggagaaagggcagacuuguacccagaaucacccucagcucuggaaagguggggagaagggcugagacuagccacacgucaagugugguacaggcauuugccuccucugcccccgucagagaaaguacaaguaugucucccucacugguacuuagaguucaacuucugcuccaaacaagauuuuagacucccuaagcaaaacuuccuuuguaaguaguaauuacacaaucccaugcggugcuggcgacacggggcagggugcauccuaaacacacaggacccuggggugggacugcagagagagccgaagcaagcuacaguggccguucucgaaggcgagcuuguuccugagugauuuaucaccuccuacgaucaaucaauaguaaauaaaaacacauacaggguguggaguguugugcugugaaggucacccaagccacauugcuuaggauggugauugacugaugcacagagauggauuugcuguuccucguugccuucacgucgcgugucugcugaaugugucucucuuccugccguagaucgaguggggagcuugcgcacuuguucucacgggaaacacagucaucuucgcgacuauucuaggcuucuuccuggucuuuggaagcaacgacgacuucagcuggcagcaguggugaggagcugcugaacuguagucacguuggacuucugucgucugccggccacccgugcacaggagaaggggccgugaugcugagcuguuggcgagccucugggguguccuaguugcuuccuucucacuguuguucgccuccuguuuccauggggacuugcugaagauuaaaaggauuuucucauuuggaaaagcuuggcugguuucccacuucucuagacugcuuuccaugguguccugcugaaucuaaaauccuuacauguuuucccuguucaguuguuuuaaaaucaguaugcaauguuacccauuuuuaagauguaauagccauuugcauugguuuaggaauucagaacuucuggcuguauuaugggcuaaaguauauauuuucucuaaaaaucaguuaaucuccauuauuaaaaaaaaaaguauacaugaguaaguuuucauucagucaggaugacaucacuccaggugaaugcaaaccuucagagcguugacauaccuuaucuacuauuuacucagugaaagauagcugcauuuauaccucaggggggccgacugauacugcccaugcccuccagaaggguugcugguuuuacuaguggacagguguuuugugaauugaaaacuauuuuguggaauugcuauaaaagagugcuuuucuccucaacuguuagaagaauuuauguuagacuuuaagguacaaguguaaaaacaaguuccgggauccaguuucuauccguguguguuauggucaaagcaagcgaguagcugugugggaaaaagcaacauuggcuucccacugucugcgugccguuuccauccuuagugacaggucugagcucugucaccucucaugguuuggagggugaaagggacaugcaugggacaguuguguguuugcaguguagauauucaaaagcuucccucugcuuccuccuuuuaacuuauuuguacauuguauauauuaaguaaaagaacuuuucaaauauaguuuaauaacguuuagaaauguuugacuacuaggaaaccaauugcuaugccauacaugcagagugccccucccccacaaggccuugacaugauucacaagugacuuguuagucuugcagguaauccaggaacgugcaguuguaggacuuagaccaccguaagaguagucucccaaccuuacagcguauguacuugaaaagcacuuaaggcagguuugcuguaaaccucucaguugucgcgguuugguuucaucgugauggauccgcugucgugaguaagguauuuauuguaugaauucauacagaguagccaaauccagcugugucaccucuucaaacacagcccugaccaaaaucuucucagugaccaggcaugaccaaaucguagcggucauuggcaucuucaguucucaguccuuuccuuacccaagagcugauuuugaaaauguucucauugauccagcaguauuuuuugugaggacacuuguaugucucuccagugugcuuauauaaaaagaaguguucugccuuuagcugaaaaaaugaguaaccaugacaacugucuuuuguuguuguuuuuuuuccuacaguuuauuucucaaaaaaacaaaacaaaacaaaaaaaaaaccuggaacaugcaccaaguuuguucagcuuuuacuaaagaugucuacagccgcgguuuuuauuuuguuucuguuugcccugacccauguuuuauuacuaugguggugaggugggaagcguuaugaaauguccaaaugcggccaugccauuuguggguuagaccagcaguggcuuguugaguaaugaugacagagacucgccggcggugugcgcauggucagaacccucucugggaucaagaauggagcaggagguuuugucucugguccucccugcccucugcuccuucacaagcgaagugcugagcgcuuggccauagacuccuuucuaacagcugcauauucuuucuggguacuaacuaaucuuagcagcagcauugcgugucugacaugacacuggcuugccaaucccaucucugguuucuaggcuagcuacuuaagaguauuuucaugaguaugcgccaacacauugucguccuaccguggagagagagaaaacuuuugaugacaaaacaauaaagauuuuaaauauccauuuuag

SEQ ID NO: 4394 - RNA, 644 nt, Mus musculus
uuuagcacuaacacguuuauuuacuagccaaaggaaugauccuggguaaaccaaguuugacaugaaguuccauguaaaguguuugugauaaagagaacucaacagucaugaaaaauaaaaccaaagaagugaagcuguuuguuguuuauguccgcucacugaauugagcauauucacucuggcagcuaacuccuguccaggaugacgaggaagcucucauugcaccuucucguagacccgagugcagguggcauuguucaugacacgcuccacaaucaacuucccauccuucaguuuuccuguuaucgugcuccccuucccauugcuggugcuggaccagggcaccaucuuggaagguacagaccaucucaguuuuucugccaucagccauaguuucaucaaacuucucucccaggguacaagagaacacggucgucuucacugugcucucgguuuugauggugauguuguugccaucacaaguaaugauagagucuggcuuggccauggcagccaucuuccuaagagccaguccuacuccuagcucuuucgcguacuccucaaagccguggcuuuccaucaggcgccacuucccuucgagauccuuaaggcuggccauggcgggcgggagagcacaaaagcag

SEQ ID NO: 4395 - RNA, 644 nt, Mus musculus
cugcuuuugugcucucccgcccgccauggccagccuuaaggaucucgaagggaaguggcgccugauggaaagccacggcuuugaggaguacgcgaaagagcuaggaguaggacuggcucuuaggaagauggcugccauggccaagccagacucuaucauuacuugugauggcaacaacaucaccaucaaaaccgagagcacagugaagacgaccguguucucuuguacccugggagagaaguuugaugaaacuauggcugauggcagaaaaacugagauggucuguaccuuccaagauggugcccugguccagcaccagcaaugggaaggggagcacgauaacaggaaaacugaaggaugggaaguugauuguggagcgugucaugaacaaugccaccugcacucgggucuacgagaaggugcaaugagagcuuccucgucauccuggacaggaguuagcugccagagugaauaugcucaauucagugagcggacauaaacaacaaacagcuucacuucuuugguuuuauuuuucaugacuguugaguucucuuuaucacaaacacuuuacauggaacuucaugucaaacuugguuuacccaggaucauuccuuuggcuaguaaauaaacguguuagugcuaaa

SEQ ID NO: 4396 - RNA, 3977 nt, Mus musculus
ugcuuuuuaauuuuuuuuuuaauuauuuuuugacucccuccuuaauucaugagauucuaguucaacaguucucaaccuguggguugugauccgacugggggucgcauagcagauauccugcauauccgauauuuacauuaggauucuuaaggguaucaaauguacaguucugaaguagcaacaaaagcaauuguacaguugggggccaccacaacgugaggaacgguauaaaagggcggcagcauuaggaagggugagagcugcugcuccauucagaucuacuuagagcccagccaucaaauuauaugcuauuucuucaggcaagucacacugaacaccuagucucaaaguagaaacaagaaaaaaaaccauggguguaauugaccacaaauugauaccgauugugcugguuugccauuaaaauggacauugauucucuuugggguuugagucaaaacuucuggcuuuguucacugauccauaauugaaaauaauuucuuccuccgguggugaauucuucucccaccccugccucaguccaggauuauuaaauucaagucacaugaaacagcacuaaucugucccggaugaaauuuuggaauuuuuuuuaaauccucaaacggcuugaguuuaucugaggcucggaagaaaaugaggaacuauuaauaccacaagguuuccuuugaaggaagaauaagcggguuguuuuccucuuacauaauuagcuuucagcccugggugaaggagcugucgauggcuacuuuucuuuaucuuaaauguucucucccuuauuucugauggggaaaugaaaacguuagaaggcaagcacuguguucauaccccagcuuucagcauuuuucuugggaaaugcauacaaauaaaagguguccuugccuucuaacuucuguauucagccccuuaugagacucuacaccgauaugguuugccucuuggggaaucugggcccugggagucuuuaaaugugccuagaaggauuuuuaauuuuuuuucauuuuuuccccaaaagcuccacaggcauugcacauuucugaaaauaaaacugccuucauuaacuagaaugucaugguauuuuuuugcuuuugauuagagucaaauuaauucaguuugauaacauugauuacaagcugaucuaaagcugugauuagagcuuuauauaucuuagaugauuaaauguggaaauagguuaauuaugucuuaauaaaugcaguugacuugauagaaagaaacuuaugcaacccgaaauuaggcagaaaaguaugacaaaauuucagaaauuccuguauacaucuuguacagacagagugguaagaccaaugaaaauuucaaauguaucuauuuuagaaaucuucuggaaucauaagauucaauauauuuauuauuuuuggucaccuuaaugugaaaaauacaaaaucaaauuauuuauucucugucucugucucugucucugucucugucucucccucucacacacacagagacacagagagagagagagagagagagagagagagagacugaccuaaacaauaaacacaacuguacaaauauuauauuaagaaacaaaagaaaaauguaauuuuccaauugcugaaagucagcagaugcuaucucaugugugaacacuuugcacgggcaguugaaccaguuuggaggguauaaauagaagcacaccagauuuucugaucucauaugaaucauuagucuuguugaaagccaucucuuugaggaagcggacaguuugcgucccugagcuaaugcuaugggcggggcgggguugggguuuucacaauccugcucugaucauuguggcuuugggcgugacuuuugugacucaccuggcuccggcugcuuagacacacagcccagaguucaugucgcugaagggcacuggcuguggaucauuguuuccccaggguaugcccuuuaaagguuacuggugaggagaugggagaggcuuugggguucagcaacacgugacugcguuuaagccguauuccucucuaggacaguagcucuagaggggauugcagaguauuucuucgcucuauggaaauguugagcugcuucugucuucaugcagaacucggagacaucagagugucaguuguggaguugcgugcgugaucguggcaugccuagcagaacacauugcucaaaauaaaugacaguggcagaggcuucuucacguacccagcguccucgaauguaaaagaguuguggggcagauggccuuuauagaccucuuaggcacuaauuaacuuucuguagcucuacguuuccuugaauagcaaacauugggauaaagauuggcccggguacagcagucugaugacgcugacaucggauuguuggcauauuuacaggugcgggagacuuuuauuugggauugaggaaagcuagugccuaguuuaacaaagggaaggaagggaaggagagggagagaggagagaagaagacguggaagaccaguuuuguagaggagagcaguuuugacccuuguauguuucuauucuggaucguuuaccccgggggacuuuaaagcuuaaugaucagaucuuuagcugugugacuuuccacuguccaugucuuuaaagcucuaggcuucucaugugguuuucauucccaguuaucucucccacauaagacccggggggcucugcuucugugaaugcuuugcuagguaagucucgcuaaacucagcugccaucuacuuagaauuuaagcaagacuuauugcucugagccucucuuauagaaccuuuucaauacccucaaugauuuauucucccccuuauuuuaugggaccaagaaguggagguuuuguuuguuuguuuguuaguuuuuguuuguuuguuuugaaugaguaauuuuccugcagccacacaauguggaaaaaacaggauucggaugaagugaguuccgcgcuucaucuuuccgcugugauucgcuuccguuggcggcgaggguggccacuuccggcuuuuuuauccugugcagagcacaggaccagcagaucgcccuuggcccucaguuauccucagagguggaagggagggugggauaguggggaguccuugccagcuuccccaggaaagcagaaauauacaaccugagauccaggcuagagauuuaaaaauagauaggcacaaagcaaaaaaccgugcaccuuuuacaaaagcacauucaaaccagauguuguagguuucucagguugaauggauccucuugggaggggcuaggggcggggagaacagcuauaagaugauaagaaaggauuacauaaaacagagggggugacauugugaggugagcuuggaaauguaaucaauacagucuucucuugcaaaaaaggaaagggaauaacaaaaccaccauuagggcccagaaaaccaugcaagaacaaaacaaaacaaaacaaaacaaaacaaaacaaaacaaaacccaagaaaacaugcauggaagggcucauuuuaaaauuaauuaauuaacuuuacaauagcaguccccuuucuccugguuccccaccaccaccaccaccaccacacacacacauagucccucuccucacuuccugcuucugagaagggugagaccucccuggguauugccccacccuggcacaucaaaucacugcaggacuaggcacaucaucucccacugaggccaaucgaggcuacccaguuaggagagcaggaaccacagucaggcaacagauucaaggacagucccugcuccaguugaugagugacccacaugaagaccaagcuguauaucugcuacauauaugaggggaggcauagguccagcccuugcuugcucguugguuggugguucagucucugggagcccccaugggaccaaguucguugacuguguuggugccuggguaggcuuuauagugagcaucagccacacauagacaugagcuuagcuccacuggauauuuaggcucugucu

SEQ ID NO: 4397 - RNA, 14733 nt, Mus musculus
agaacugguugaaaauguauuuauuuuucuucaaaugaucuuuuuucaagcaauaaauaaaaacagacaugguugacucuucuaaaaaaaauguacauccuacagaaauacaagcauaucaaauguagaaaugacaccacucagaaagauggggcuauuuacacaaguuacaaguauugcauuguuaucuuacugaagucccuugaaugauuugugaacucuaaggaagggguggggcacuagaaggaggacuucaaaacagacacauacuuucucuaucuuucuugcagacaaaauuuaaggaaauaacaucaacacccagacacuauauugagcucacucacaaugcuccacaaaacugguucucagaggccucacagaaaccaccucaucccucagcuggcuuguggagagcaagaccacacugacaccauuacaaagcccuacuggaaacgucugugucacaagcuagcugugugcuaagaagacccgccuuucaccauagugacgcaauggcaucuccaggacuuggccguaccagugacagcccauaggaacacuguaacauauuggcauccagguccuacccacacaaguccugguuuauuuggucaagggucaccuagcuaugaggagauuaaaggcuaccuuaggugauaggaugaacccauaugaacuauuguuauuauugccacaggcuuucuuggccauugcccaguccccuuccccuugggaguaacuaucaaaucuucccaaggacuuuuaaucccuucccauggcuuucccagaagccaagaaccagggcacaaggucucaggggcgaauggagcggagagcugcugcuagcuaccugcucgccugugcuucagcccucagucucacaaacacuauauggaugauggagccaagauccccagggagaacugagugucccucacucucgggcagauacucaacagccuucugacauuccaaaacuucccaucaccagaaaucagcucacggaugggauacugucuuuugaaacuaacuaaccaugaggaauggcaggaucuucaacuaacgcuauugcagaaacuucuggagagcuuuaagguguaccccccgccccccccccuuuuuuuccaaucaaaccaauguccuacuuucuaagcguuuuggaucucaugcuguuaucaaguacaaagaaaaugacuuuauaaauagccccuugacacugucauaggagguuugaauuaggaagcaggggagggacauuuggagcucccaaugccugugucguugggauccagucugggaacuaggacacauuuggcaaacacucaucuagaaagugaauguagucuacaagcuaucugcucuccagaugcccucaacauucucagagcccaggacucgacuagcuacagagcucauuuaaucuaauucuucaccaaacaugaaacagcugccaggaaggcaguggggguaaaaauaugggaccauccaacuaagcaaaggcaguccgccaucggggaagcucggacccgcuaugccuucagccaagccuucggacaguaggggaagcgagcagggcaccccucacuucucaccuaaaggcagaauuuggcacaggccacucaauccaaguucuaccaacacagguucacauuucauggaaggaaaagccaugaacccaggcuugucuggggguucuggaugucaccacgugacauggaggcuugguuacaugucugcucaaggugugggggaggagggcacggggaccaugcuaauuucugccaagucugcagugaccucuaaucugacacaccaucacaaaacuugucccccaauacuacagauaaaacagguucccuccccuaccccucacauucccccuagaaaacacacuuauuccuccaaagccauuccuccacuuggaaaggcuccuuuaaaaugguguuggcccaguuggaacccagcauggcuccuaagucacccuauaucaguaaaacaggagcuggcauccggccccacacccucuuuucucucaccuuuccagacuuuuaggaggcccaagucaggcauaugcguaucuuuuuauucaaaagagggagggcguuucagaguauucaccagauuuuguaacaagaauuucuugguauguauacuucaaguaaacugcuaaaucugaaacacccaauguauccgcgagagggagauucauuuuuaguucaucuucagugaucugguucugaucuggccuuaccaaaugauucacggcaggaaaaucugaacggcacccaguuuuccaggagcaccuugguaaagauggcguuuaccacagaccaauagccagauccuaggccaagugggaagaaaccacucuauccccagccaaacagaccgcuggagagaaaaaucucacguggcugggucagugggcccaggggccagcugcaaaagugaccaaccauaaaccuuuuuccuugcaugucacccugcgucugaugguaaccauggugaccaccuacccgacgcuccucucacugcucacacaccuguguguuucucugcucgacugugugaccucaacagaaauaucucccagagucacuagacuccugcacacacaugcugagguucucaauaugcauuaaacaguaagugauuauccaguugacgacuaaguauaauacuguggccuagaaggaucuagaacaaaauuccugugaguucaacaacaggagaacagacacacacagaaccaggcacuuuccuggcaaacucauuuuuucuccucuuuccuuucccucuccacucaauaaaaauugguugcgcacauuugccaggaucugugggguuucauaacuuucaagcuugauugcuuuuuuaauaauaauaauaaugagguaaauuucuaccugcaaaguaaaaacugacacagaaaccaagucuucucuggcagcggaaaccgccguuauugcuuauguuagaguguuuaguuguguuuguuuuuaauguguauucaaagucguuauugccauccuagcuggcccugugguuggccaaggagaaauggagacggagccuggucaccugaucccccacuggucagucccuauuugcuguucacagguggcuggcaacuggcugggggccgacucuggauuugggguccagagacgaguccuaacagcugggggagguggugauggggcugugcagguacggcagguuacugggggccgcgugcacgcccacagacacagggaagcugaagacgaacugcgaggugggggucgggguggccuuuccccucucccgaaggggcccagaagggcuggcagccucggcggcgcaggacguggugagcaccugagacucaaacugcagcaacuggcccaugaagcugaaguugggcgagaugaugcuucggcgcugcuugacgaacucaaaagccuccuccagccucacccgcuucuucaucaucagguaggccaggcagaugguggcugaucgggagaugccggccuggcagugaaccagcacucgcccucgacaguccuuuacugcgucugcggcagaaaguggcaugugauuagggaccuuggcgggcuucagggauucgccacuagcaggugcaugugacagaagccaagacaucgucacaaacacauacacacagugggaugaggggcgcuacuaugggaaggucagcuacgcuagaccgaagaugaagacaagguaucccacucaacccaguggguuuuguugucguuuuagauuuauuauuauaaaaaaguacacuguagcugucuucagacacaccagaagaaggggucagaucucauuacagaugcuugugagccaccgugugguugcugggauuugaacucaggaccuucggaagagcagugaaugcucuugacugcugugccaucucuccagcucccuucccccccccccaccccguguaucuuuuaaacaacagaaagauuuuuuaaaagcagggaagucacauggcagagccaucagaucaaagagagcagugacuccaguuuccuccugacuuccucaccaugcaaaagccuuacuuuguacacacgguacacuuuccauuugaggaagugacaggcucuccagccaggccucaauaaugacuuucaauucccaccacacaagugugucgucugucccuguccccgucccccccccaccaccccccaugaguggccugggccuuucuaguauuucaguugaaauccccacaggcccacugcggugggaguuggggggcagaggggaagaccaugaaaccuacaggaggggcagccaugcugaggaacagauuagcuaggggcaggcccugagugaggguugauaaccuggcuuggcuuccuggcugcaccagucaccaccaggucuuccccacaaggacagacuacauucuucuuaaacugcaagccagagucaaucaaucccacccuuuaguugguuuuuaaucaaauauuuggugagagcaacgacaaaauacaaggggagugucacagccugcgccuaacgccuaaaauccccaccagcagucccugggucccccccugguuccccugaaguuggagggcagccuaccgauguacucgauggcuuccaugaaccaggagcugaugucggccuugugguugucuucgacggggaugcacuuguacugguaaugacccucaaagugauugggacagucugaagagacauucaggagggccgugauccccagggcauccaacaugucccugcgggcagcaugguaggcacugccgagguagaggaaagggaggauuuccacggggccccccugcagcaagaaaaagcagaaagacauaggcaaaacaugagugaugcagggcugaagugccggaaccagggacggaaaggcuuucuagaccggggggggggggugguguaggagugggagugggggguacugacaggcagagcuuuucuggcucuuccuucccuggcuugaguucagcgcgacuccaggggucagaaacagggucuggucuggucuuaugggcaccagccagccaccuucccgugacaacccuggcaguacacugacugaccaugaggcacacucggccacaaugggaguucacacugcugauggaucuguuuggcuggguuacgucuacaaugaacacaucugagaaaagaugucuuauacuaggagagaugguagcaugauguaaggauacuuuauggacagaggcgguggacucuuuauccccgguccaucggaugggaagggugggugagcauguauucaauggcucaagcgguuccuucguguucuccugcacugccugaaccgggguacacauaccuggucgugcagcgggguuccacaggagcugcagcccagguccaaggacucauuggugcugggagguacagggggugggauggcggccagggccuugguuuuagagcagaauucuggguauucagaagaaaaccucucauagccaccuguaaaggagaaaagugguucuggucaguggagacgcggagccagaaagaaaggaggaacaacaaucccaccaggcuaaggggagcuuacgccacuagguggcgcugugggucuagagauaaugacggccggagcauuuucucagagguuuguugggucggacaacagaggacaguaucaaggaagaaaggaugcuagggacuuuccgggcagagauaaaaauacacaaagaaagauguacacacggaugugccagaaggacuuucuagaauaccaccgcguacaacgagggacccaugagcacuuagcacuuaggcaaccagcaaaccagauguguccuccucuagccuagugaggauuccugccaucaccagucccuucugaugggggaaagaaucggaggugggggcuaagauacccugccaggagcccuuccuucgguuggagcagauaccacaagcacugucuuuaccaacaggaucacaagaggaaacugacuuccaacacacaaaccaacccugccacacagguuggagcaaggaaggguuuuuaugaccugaguguggaugaggagccuggcaaagguuaucacugugucuucugcggaaggaaggguuuugugacaaagauagugccaguugucugguacagcugggugcuguuccacaaggaccugagaccaagaugcagaacaguaggaaccuccaggacuagaaacuauuagcaauucaaaaacauucuacacgucagggaucaaccacucucacagagguacccacacaaugggcuaaaaugguaggugcguauguagguggcucgcuccuucucugugcccggccccgcuagaaagucaccucuggcacugugccuuccagcuguucaacuaaaggggugacaugugaccaguuuagccaagugccaggccccuaaauccuaacccgagaaaacugcuuccugcugcuucugagauaaagaacucucgccacaucacagggcuuucagaagcagggaacccauuuuuuuuccucucugaccggagguuuggcuugcucucugcccgcucccuccggauauaaaagucuaucucuggucaaaguucuuccugcugagucacagugaccagccucccaggcggaaaagccugcagaccuggugaugccagcuauggauauucaugggcucaguggccacagcacccaaggggcaggacucccucucccucccauuauaaauccuucuucuuaaagcaggccgaaaaggcagggaugagaaucugagggaucaagaagcaauaaaggucugucaccaaaggcccuuggucccuaccaagaaacucugucccacaguccacaccuucauuagcaaagcucauuugcccuuaggugugcuucuguaagacuucaaauuuuuaaccacccguuuguuuauuaacauccauuuaagcaaucaaaacuuaaaaaaaaaaaaaaagaaaagaacaguagucccugacaaaaugcuuuccacccaggaaacaggcacaaccugucucacuuaaaaaaauaaaggggguggggcauggcagcccagauuccaaggucacaaugcaggacucuccagauagccucccggcagaaggaaaaguucccacccuucccuucauagaaaggguacaggacccgcuggccugaagguccuuucuggacuuugcagacagauuccaucccagccuucugagucaucaacugugcgcccacccuacuuccgcccuccucugaccucugucacagcccccugcuccuacucgguaagugauuaaucuccccuggcacagaguuccugauccaggcaccuuuugucuuugggaagcugcggcugguuucuaugaggacaaagaugggggguggggugcugugcaggaaggacauuggugagugcaggugaguuguuacccacauagaggaagaaacugaaaaguccuugccucgccuggccaugccgcucgcuguuaaagccuuuugggugaauccugaguuacuaagaacugaaauaccccagacagagggcauuuacuuccugugcaucgagcagcccccgucgaacaugugaagugcaccagaguuacacacacagcacacagccaccuggggucucacagucagguuaaggacaggggccagcauucaccguggccagcuugaagccagacuuaccaucaggagccccugcacuagccauucccuugggaacacugccgcaugcccaugggugauuccagagggugcuggcagcgauacuccugcccagacaccagcugacccgcacuucaaagaagagaaccgaguaguacugugugcucauuuuuuuaaaagcguguccguuuagagaagguccaaagggguccaugugaccuucuuccugaucaugguguaaacuuacugggucugguauauugucacgggggcgggggguaguccccacuuuguaacccaggcuggccucgaacucaugguaaucagacuucccacuccccauaugcugggauugcagguaugaaacgcacaugcagagagagggggggggagagagagagagagagagagagagagagagagagagagagagagagagagagcucuuauuucucaguguguagggaaagcugccuuaaaauguuuuccucucaggcccuccuagcuaguagccccaucuucaugcaaguaucaucauggccacagcgccucugugguaaagaaccagguucagaggacccaaguuuuauccagaacuuaacuccacgcagaaggggccagauuuucacugaaccuccggcauaugucccaaaguggaaccgggacacaugaaucagauggucagucugggccucuccaaggcauugggcaucuucuggauaaaauuucauaacaugccaggcagugguagcacaugccuauaaucccagcacuugggaggcagaggcaggcggauuucugaguucgaggccagccuggucuacagagugaguuccaggacagccagggcuacacagagaaacccugucucaaaaacaaaacaaaacaaaacaaaacaaaacaaacaaaaaaaaucauaacauauaccaaugaauuucggccuguuuuuccaauguccuguugaacauaaguaauuuccuaacagauuucuuaaaggucuuauuuaacaauauacuuccuaagauuggggcugugcagcuccgugguagagugcuuuguuaaacaacaugucgauuccuagcacuaaauaaauaaauaaacaaauaaauaucagcccaguuugcugcugcacgccuuuaaucacagacacucagaaggcagaggcagacagcucucuuuugaguuugaggccaaccugaucuacuaauggaguuucaagacagccagggcuguuauacaaagaaacccugucuugaaaaaacaaaaauaaagauaaauaaauaaauaaacaucaaaggauaaagaacuuauuuccuguacuuauugccuuucaaccuguaggucagaaauggaaacuuaggccuggccuucaaggggcuugccugaagggcaacuaacuauaucuccaguuaacuccauggcucaccuucaggauauaaaccaugaccacaaggggcugcugcuagcuguaacuccuccacucuagugggcugccaggucagccggaagggaguggagaucauauacauucguagaagugcuuuacaagggccccugacuggugcugguaaaccaccauaauaggguuccuagagaggaguugcucggguagugccuauggcggggaaucuuaaugaggcugccacuuucccuagauccgaucagucaauauugagauuaccaccugagccugggucucacucuggcccagaaaggaagucuaggucgucugaaggucguagccuuugggaacuucacuuuaaacagucuucagaugaccuaagugaacuccugaucuuagaauucccaagucagagagccuguccuucccaggucacuuggccgaaccgccuaaggaauugauucucaaccugguggucuugacccuuggcgggaaaguugaaggacccuuucacaggguagcacgacagaaauccugcauaucagauauuuacaucgugauucauaacuaacaaaauuaguuacgaaguagcaaugaaaugacuuuauaauugggguuuauacaacaugaagaacuguauuaaaggguggcagcaucaggaaguugagaaucacugcccuaaagccuugcuuagggacuagaucuuucuugcagucccucccaggccucccacccuaacugcccuguccagcagacuggcuucuaucagagucacuugacuuccggccauguucccucucucugacaggaacuggcucuugaaguaaggaaauuagcaauccagcuuuacagguuuggaguauuuaaagggauuucuuggcucuuuaacuaccaccuuuuucuacaagauaagaagcccugauggucuuaaaagauaaaggagaaaguccuuggacaccucgcccugucuuuaguaaccuugguugacuagagaaguccauucgcuugaugccacaguuguacuuucuccguuccuuguaacuauguagcuaaugccuaguaacuauguagcuaaugcuuuaaggcuugggagucuugcuuaaguaauugcuuugguaauucuaacacuccaacucuuucccucucuggagcacucuguucuauguacaaauagaaaaagccagaaaucuuccucccucugaauauaaaauguagguguaagcaggccccugagcuaugcccugagacgccugagcuauacacugggaaagcuggagagaaguccagagaaagagacgugcaggcaccaacaaagguccuggugagcaagacggaguccuccacucaacucagggucagacccaagaucuagacagauaaguugaggaaguaggcugucuagaugacucuaucccaauagcucaaaacagcccccugcauaauuuugcaauuguguuugaauaagaacuuaggucauaugguaaauucuacacaggacaguagauaaaauugcacaaagaagauccuguguguggagcaguucgugacgcaacugccucagccagccuccaaggucuggugaucacacgcauuucccacaccagguugaaauuauuuguguguaacagauugauuugugauuggggauacuggcauuaaaaaauuauuuccauucggauaagauuuuuuuuucuuuuaaaaggcaagcaaaucuaaaauuccaacccaaacauuuacggagguuaagaaucugaaacauguaaacugagauaaaaucugaaaaacuuaaaaauguaaguuagagaauuucaaugauuuuuuuacucacauaaaggaaacauaagauuucuaguauguaccaaaacuugaucgauguauaagauuaacaauaguuucgcaaaguuuuaauucuugcuuuuaaaaccuugcuuaugaaaaaaaaucuuuuaaagagaccccccccaaaagggggaacaucaauuucuuuuaaggggggggccgacaagcgcuuuggccuggaaggacaucacuucuaaaaggguuauuuuuuauuuucucuccccuaucccaagguuggugggcacccacucugucuccacuugccuacugccugccuccucacuccaccagcagaagagagccuugggccaaugcucucauaccuagccacauuucccgggcaggauugggggugggagggagguuugcuuaguuccuaugacugcccccuccuagagcagacauuuccuucuugcucuaccaagaccuuucaauagcuggcagagagaaggaaggacgaggucguggcucagcacacacaucuacauaaacuaaggcugacaaacgcugaucucuaagaccaacacauacacacacacacacacacacacacacacacacacacacacacacacacaaauuaucauguuaggcucuugcuuccaagggcugcugaacuucugucuagaagagggaaggagcuguuccugaacagaugaaaacuaagcaguccaggccugugaccaggccuagaagagcgucaccucagaggacugggaagaaggccuuuggcauuugaggggguagggugauugauccucccggcccagugagagaaggggguggaaaacgcgacuugaaggaaaugcugccuuucugugggccaggcacccauuacggaugggacugucauuuugcccagaggccaccuguccuguccagucuuacaucaauauucgcccugaagcaucucucagaacuggucuggccucgccugucuccagauccgaauccaggaccgguagagugccgcaagccauagguuuaacauuaaaaauaugccucccucccuaggcgcucggccgaccccggggcccgcacccaggaaggaagccuaagggcucaggcucaaggcagcugccgcuccagcuucagggcagucccaggcggaauucuuccaggaagaaaaacaaaacaaucccugacuccacgugggacugaaguacuccugaagccaggguuggaagacaugggcuccgacucucaauccaaccgcugggcaacccaggacaaccuaggacuuucaccccgaaacaguuucaccuuucccacccgcgcgaucucgauucaggggcccaggcaggacaccccgccgagggaggacccgggaccugcgccuuuccuaggcagggcuccgcggauacugcguggggccccgguucagaccgcuggccggucgcgagguccggaaccuguguuccuggccgucgcuccuaaagcguuuuagggagccggcugagagacuggggcucggcugcaggagccacaggcgguccuugcaaaaaaaaaaaaaaaagaaaagaaaagaaaagaaagaaaaggaagaaaaaaaaagaaaagaaaagaaaaaaaucgcccuggcaguucagccucagaucaacagcagcguuuccccagcagcugacgggucaaauggucaggaaacaacugcggagaacaaagccccccgcuguuccgcacggccagccuggcucgcccgcaccgggugccguucggaggggacgcgagaaaggguuucgcucccggccucccuuccuuaaggaagacaagacacuaagaggaaaagucuggaagacggggcgaagagccucggcagggaaaugggcggcucuuggaaggcggaggucggacaaaccuccaggcuuuggaagcaaagaccagacccgcgcgaaagaaugcacggaaugcgguggccggagguaggggagcagcgcagcagggggcgcccgacccccccacacacacacacaccccgcacccuacagugcuccccaaccgguggccggcacaccgagcgagcuggcaggugcggcgagcggucccuccccuuugccaacgucugagauacugcgcgauccuuuuggggugucugacuucucaaugugacaagccacccucucuccggccaccuaauuuccuacgccaggguucgcucgaaccaggcacgcgccgcuggcagagucgagaaugaugugugaacaaaaggugguaacucucugcucccgggauuagcaggagcaggcgcgguugugccugguguccccccacccccccaaauacagcacuucagccucccuuagaccggggcaaguggggguuggccgccauccaagaaagcucugaguuuaggcagcggggaaaaaaagagauagcuccccaggucugcaccccaauucuccuuuccucauugaccgauguguaugaacuccugagacagcuccuacccuagcauucaccuuccuucaccccccucuaggguucccgggguuauaccgaaccaggccucucucguccccgugggaccuaagagcgcguucucaguacuugaagcugggcugcgcagaggaaccgcugccagcauccaggccagaaccguucgcguaaacaaacacggaaacuccaagacgcgugcggauugcaggugauuggggaaacgcgccagcacggccuccccgggacucaggcuccaaaccacagcaaaaccguucacacugacacgcacaaagacacgcgaggaaggggacuccagcaccccguagucacucggguacuuuccucccaaugcccagcagggcucaggccgccaagucccuuacacuaccuacccucccaccucgcucucccgggcacccacguuuaccuuuaagcaggcagauguccgugcgcuccgcguuccggcgcaacgccugcacgaccagcgacaccgugcuguccucccggagacucucggcgcgcgggcugcgcucgucguagacgaugacagccgaguagaggccagagcgcaggcgggcacgcaccucuuccucggcgggcaggaucugcuccaggcucacggagcccuuggcccuccgccgcacgaugguauugcagcgcacguucaccgagccucggauguagcccgcgcugugagccagaaacggccugcaguccagcagcaggcacuugccgccgcucagcagccccaaggcgccguggcugccgcugccguugccgcccgcgcugccgccgccgccguucucaucccgguucaucagccuuuugagcacgcugcaguccaucucccgcaguuccuccaucgucaccaugucgccggcaaaacgcaguaagcuggggagcuagcuggagaaggccaagggcaccggagccagcuaggcuaacaagaaggaaccaggcgagggcuaagagggcgccugcagaagugacccgcaaacuuggccccaggcucuucucccucuaacaccccugcuuccaccucccgcagccucaacguuacauagcagucccagccuucucuggcgccaaagcuggcgggcgcgcggcacccggggcaagcgaucgagcaggggaguguguuuacgagagagggcuccucucgguuugucgccucugguguguuuugcuagcuagggcugcuucugccgugggcuccgccguuucccccaccgcugcaccgccggagcugcacgcacugccccagccagaguuuccuccucuggcuuagagauuuauuaaugcucgccggcucucccgggggagggaagagucauuacuaccucgccaggccccgcccccaacgcaagcuucccgcc

SEQ ID NO: 4398 - RNA, 139235 nt, Mus musculus
cagugacaguacgggggagugggaagauggcggcgucgcgucgcucucagcaucaucaccaccaucaucagcaacagcuccagcccgccccaggggcuucggcuccgccaccgccaccucccccgccgcucagcccgggcuuggccccgggacccaccccugccucgccuacggccggcggccuggcgcccuucgccuccccgcggcacggccuggcgcugccggagggggauggcagccgggacccgcccgacaggccgcgaucucccgacccgguggacggcgccgucugcaccguggcugcuccggccgcggucccggcagcuuccgccgccgucggggucgcucccaccccagccggcggcggcggcggcggcgggaacaacuccgcgucguccgcuucuuccccgacuucgucuucgucuuccuccccguccuccccuggcucgagcuuagcggagagucccgaggcggccggaguuggcuccacggcaacuuugggagccggggcggcgggccucggcccgggggucccagccgugaguggggcccugcgggagcugcucgaggccugucggaauggggacgugucccgggugaagagguugguggacgccgcgaacgugaaugccaaggacauggccggccgaaagucuucuccccugcacuucgcagcaggucugucugggacuugagaauugugguuuacgggguucggagcggagggugggugauuggacccaggacaaagaaguuacagguuguuagcaggacuucaccccgagagcugaaguuuuuagugcaugggugguggggacuuggaagcggggacgaggugugaauucaccccucaguguuugcaaccgugguacuucaacuuaugcaaacucuguguagcggucaacccuggaugugggcaugcuuaaaacuuuuucaguucagagugugccugccugggacaaguugcauuugagucgcuuuagggacagcuuugucguucgugagacaguuuuguuuuuguuuuuguuuucggcacgguuuuguccccggaggacagacagucccgggccaaaagaaguguacgguaacucaacaaguguuuuaagaaucucucauauucuuaagauacacaacgcaagacaaugggguuugugaaacgucacguuuucuaugaagucgacugucuguuuggagagacuacagcgggccagucggagacaguagugauaaggguauugugugccuuaugauaaggggcagagagagacagagagcgagagagagagcgagagcgagggcgcagcuuugagguccauuguguauuuaccuugucucucagcucauuuucuuagagacaaagaugagagguuguuugagcaaggaucuaggaagaagucucuggcggggaaacucuccacauaggcacugauugcuaaaugcugaacugaacuuuuuuuugccccaucccccuucugaguauguaguuguuuucuuuuugaaacgcagaauauuuuuauaaaacacagaaauguagaacaaaacuaaaagggcuguaaucucacugcuuugauacuuuugguugauuuuuuuuuuuaaauauaggugaugcccuuaaaacaguaccuuugaaguguguacuuacacauuuauuauaaauucaaauaggacagaaagauacaaaauuaaaagacacuuuuaaaauaaaguaucaaacauuccacuuuuaaauguuaguuuuucuuaaaaaauuuuuuuucaugaguacauguaauucauuaauguucuguggugugaugccaggugcguguguguguguguguguguguguguguguguguguguguggggacaagagggcaauccauucccuggaauaggaguuacagguaguugugggucacccagcaagggugcucagcuacuuuggaagaguaagcagugcuuaauuaacuucagagcaucucuccagcgccuuuucugucuugagaugcagucgaacaccaaccaggacuuugcuuuugcuggggaagcgcucuaccacugggcuccaugcaccuccagcucccuccucuuguugcacauuucagugggugugaacuccuucagcucuggaaacguaagcuuagaaguuuauauauguauuuuccccuauaucuuggcagguccugggauucucauuuuacagaugauaaggugaggcacacauguuuaagugagucuaguucacaagcaaaguagggaaacauugcuguugagucagcaguuugauuuccagcguaagcuauaaucuauacuuggguuuggaauugcagugcccaguuccuaaauuacuugguguuuuggggagaaagucguugucuggggcucauggaaagagauagcuagguuuguuuguuuuuuuguuuguuuguuuaauuuuagccauugcuuagagcuuauauuguuacaauuuaaucagaacuuugaggaaaugggaacuacacucuuccuuguauguguguuuguauagucuucaacuuaaccguuagcagauggugucugugauucauucaugcucugugcugugcugcccauuggagauggucagaugacuggaucuaugcuggauacuuagacgguaacuauugagugugaugaacuggcuuauaagucggcuuucaucgaagcagaugaaaagucaaggcucuugcuuguuuuauauggaauagcauuucuuuuucuuguuuugcuuuuuuuuuuccuaguacucauuuucucugucucucaagacaggucuggccggcucaagguucuucugccucagccucccaaagccugggauuuccggcaugcgccacuacaauuucuuuuuuuuuaggcuaaaggaaaggucugagucugauguaauacaucauuguagacuguuuacuuuuccaaaucuggguaauacauugucucaggggugucuaacugccagcaugcugcuuccaucugucucugcaucacuucacucacuuagcgcugguccacaaugaagggggcuuguuucucgucauggcuucucuuccucacagauugcugaggagucuuuccuggaguguacuugcaugcauuagacugcagacaggaagcagccuucuguaguuauuguggaguuaggaggaccuaaccuugaucagcuuuacuugcucuuuuuuucguucaguucuuuagcucauuuguacaaaguagacaaaacaauaauuaucaaauucuccacagucaaaaacauucucuaguuaaccuauacuuuuauauuuguuuguauaaccuuaaagcuuaagucuaguuuucauuagcuguaggcuggguagccaaaaguucuuguuaguugacuguuaacuguuacuauagucauuguuuguccuggaauagcuguuuuaaggauaagaaauaggcaaaugacuuacauggaaaauuaaaaaaauuauaguuaguaauaguucccaauguguuaaauacuggcaaaaccuuaggguggcagguaauucuuaacuuaauagagcccccugugcagugaggaaguuucucaaaguguaaccugucagaguauacuauaguaucuuuuggaguacguggaagaggcuauuaauucuggguguggagcaguuggggacucuuuccuuuaaaacagguuguuuagcuuagguuuguuuuugaaagcagaguuuuacucugcagcccugucuguccugccuacuuagaccaggcuggccuggaacucacagagaucugcauggcucugcccuggagugcuggcauucugggugugcacuauacuggcucaccagagcuuuucaauuauuaauuuaaaguagaaugaucuuaauuuauuuccuacuagugauguauuuuuacuaacaaacugguaucauuuuggugaaauuucuuuuuacagaagaguucagaugacauuuucuuuugagaguucaguuuugagaucucagaauuuaguauuuauugguaaaacuuaauuugaguuuuuaaaguuuauguguguauguauguauuuauaugugagcaugugugggguguguguguguauguguguguguuugugugugucuccucugagggugcuggauccccucagccuggaguuauaggugguugugaucugugugaaauaaggggggacaggggaacuaacuugggugcacuggaaaaguagcagacacuuguaacccugacucauccuuguagccccucauaguauuuacuguuccuccccuccccucccauuuucuugagacagaggcucugcauaucucuggcuguccuagaauucacucacuauguaaaucagguuggucuuaagcucacagagccuccaccaugcccagcauaguguuuacuguaaauugaagacacuugaugcaggcuucuguauuguccuguauauuagcaggcauuuuaguaucaaagguagccaaagguaggauguaauaagucaguuuucuuuucuugauuuggaugaaccccugcagcacacaccccacaaaaguugcuccagaucuugauuuuuuuuuuuuuuucauaaagacgaugcuggcucccccacccucaccccuuccaguacagcuguuuguuuagcugaauacucgaugcugucuaaccugugguaaaaaauaguccaagugcuucaggccuggagugggaaucugcgcagucugggccgcucugauuuuuacugcgacaacaaccuugauucggcugcuuaaaguuacguuauuugguucucauuuucuuagagacagucuuccuacuuuagguuagcuuggcuuccugaugccccugucacagccucuuaggugcugggaucacaggcagugagugccacaggcccagccugugauugcaaagucuaacugugaugguagaaaaaacaaucuugcuuugcaaauucuuuccuagacuuaaaaucacugguuggaaaugggguugauuguacuuugcguuuucuaaaacaucugcauguuccuuacaguucacagggagcuugagauagggagaugcaugaaggcucuuuuucuuuugccucaaucagguaucacucuugaaugauuuaaagaagaaacuagcuguuugaugacguuacaaauauaucuccaauaauggaaaaaguaacaagcacacuguuaucuaagauuacucauauuucugccuuauacugucugcagaaauaucccucagucucucagauuguuugcuugaaugccuggauugcagacaauugaguugguguuccaaauaagcagggaauggaugcauacaaauaccucagacccuuauaaaaagucaccacaaagucaggacguucaguuuucugggauuaacaguuauguuuuaaacacucuauaaauggaaucauacaguucacaccugccagucccacccccuauaauagaugaauaguuucuauaugcucaguaguuuuccuuauaucagugugcuccaaccaagcuucuuucuauugaugggcucuuaggcuguuuuccauuuugacuaaagauguuaugacauacauuuuuuuuugaauccucaucuuaacagugauuuuuuaauuuuaaauaauuuuauuuucauuguacuuuguguauauuauuguuaaguaggacagauaauugcugggagugguggcguaugcuuuaaucccagcacuugggaggcagaggcaggcacaggcgguuuccugaguuugaggccagccugguccacagagugaguuccaggacagucagggcuacacagagaaacccugucucgaaaaaaaaaaaaagagagagagaggaagaagaagaaguaggacagauauauuaaguagcggaagucaacagcaggucagaauaauuguuaucacuguccuucacuucccaguaccauugcauuggaagcuaggauuuuccccccuggaaugugcucagggaccaucuccuaugauagcagugccuucugcaggaucugcuugaagcugcuuuccuuguauacacuuuuuaaguauaaaauaaugaugacaagcauaauguaguuaauuaauacaucaagcuggugacuuagcauaaccaagucuuuguaccacagguaauuucaugagcuacaguuucguaugauaggggcaguacagguacaccacauggguuuguuuacaucagaaucgucacagaacauagaaguaaugcauugugacaucacaguggcagugauaucacuucaugauaguuuuuuagcgcuauuaugauccugucucugucaugugacucccucucucccugacccaaaacuguauucaucuugugacaauauacuaguucauugguguccuagaagcugccuuucccugcaacuugcuuuguugucuagcaucagguacaacagaauauucaguguuagguuugacuuuucuaagaagcugaagaauaaaugucucuuuagccaaugcuucaacaugaagccugaugcucuuacuaauguaacaguugcugagagccaauggcuaagauuugaaaaugcauuucuaagcauguuugcaggguuaucuauuuuucucuuuacuagauuaguuuugccuuugugugguauguggucagguugacuucaguguuuaugcguguguacauauacuccaccaauagucacaccccuagcucagcaucauucuauuaaagcaacuaguagauucauaaauauuuaugauuauuucuuagucaguuguacugguauuaugcaaguguaacaguuggguggauuauaaguaauaaaaacuucucauauugcuggaaauuugagaucagggucccaggaggguggcuucugguaagagcugucgcugaguugcugacuggcaacuuuuuaguacuuuuuaguggugagcagagagcgguacaaagagcacucaugucuuuccuuacaaaggcucuaacuuucauucuaaguugcccagucacuuuccaaaggccucaccuccuaacccugccacacuggaagguuucagugcauagauguuuaggagggcgugauaugagcaaauggugagugcauaugugugucuuccuuuagagcgugugacguuguguguacaugugcucgugugcaugcuagggggagggcugacaugugagugguggugucagaacuguuuggggaauaguuccuaaucagaaggcugggugggccaguuccuuaccuagagcguguguacccugcuuugccauuugaccagcuggcuuuguacagcgagagagggugaucgcugcuuuagccuccuugauguuaaagacuugccagauaaauuuguuuaucacuuaaauguuuguuuuuauaguuguuuuuuaugauagaaagugagcugagcuacgugucauucaugugguuucuugaucagaacugagcaggauuagucgccaugaguaggcuguagcauaaggcugaggucaaaggaaaaacccuucacuuucuaucaaacgagccauaacgcaaagaagcaaauauccagcaguugacuuuuaguguauuguuugaaaaacacuguacuucuuaauauguauguauguauguauguauguauguauguauguauguguggguggauggacuagggugagcuucuugugauuuuauuaaagccuaggcauagccugggaugauggacuuugagucuaauuuuuuugaaaaucauuugacuucaagucuuagcggugugugugucuggggcccugugcuuuaggggcuccguuagguucuaagguuguuguugccugcuuuguggaaguuugcuuuccuguuugcgcaggcucucuauagaauaaagcggcaugaccaugacauuggguuccuuuugguucuuugugcaauggcagcuccuaguucaguuuaaaaaaugagucuuuuuuuuuuuuuaaacuguaggaaauggagaaauaaaguaugaagauucuuuuugguuguaacuacauggcuaguggcagguuuuuguuuguuuggacuuguaacuuuuuccuucuuaaagaauggaauaaacauuaauaguuagaugacuuuuguuaacugcagaaucaaacagccuuaaaaagaguuuacugcuuaacccacaauucuuaaaagcuacagucuucauaucaccauuuauaguuuuaaaaauuacugaaacuucacaauuuguagcuaguuacggugcuuuugaaaaggcuggguaaguccaaguggauucagcaggauuggaugcccucauucugauagagcuaggggggccauuuugaugccccauccagucuguuuauacauugugcccuucuccuuuuucaugugcuuaccugguacugacuauggagacuugccuuuuuuuaaaaaaaagaugacacaguuaaguacaugauagcuguuuuguaaaauaaugucuggaauagagaugacaaauuguucuuuuguguaggaaaaauuucauuuggaaaaaaauucuucugaacuaauuuguagagcaagguauuaaaaacuugacuuauccaguauuccccauacaaggcaguauucauaauguagcaguggaauguauaauuguuauccuauugggaauuuauggaaacaaggagaaccuuaauauagguauucaguguacuuuugaagagggggccuuuuagguuaauauuucuaacuuuuuuuaaaaaauuuuuuaaagauuuauuuauuuauuuauuuauuuauuaauuauaugugaguauacuguaguugucuucagacacaccagaagaaggcaucagaucccauuacagaugguugugagccaccaugugguugcugggaauugaacucaggaccuccagaagagcagucuuaaccacugaaccaucucuccaggccaagguuugacuuucuuauauauagaaauaaugauuuuuuaaugugcuaauuuaccuauuuauugucaaagucagaagucacauagcuauuaagugucacaguagacuaaaccuguauaugugguugucuucaaaucauuagguuugguugcuugaauggcaacuucauaguaaugagaaauaaaauuauguuuugaguuauuuuauaauuugacagcugucaugacuuucucaaauugguuuccugaugguaaaaacaaucaucuaaauuugaaagugaagaagaaauagucccucaucuuaccacuccaaggcaagugguggagucugugguggccugaucccucuagcccuuauccuuggcauuuaaaguaaaacucuucaguaaguaggauauuagaaugcuuguuuuaaagauugcuuuuuacacuuacauauguguguguauuugcauguguucauaugcguguuggaaccuguggaggccagaagagggacuucgagccucuggagcuggagucugagaguccucugugggugcaggguaccaaaccugggucucccgcaagagcagaagcacccucuacugcagagccaagccggcucacacgguucccaggggguggggcuguccuacccuuuguucauuuguuuguaaauauauagugguugacugagugaucgauccucauuaaaucaaagggcauguuagaaauuuugugacaucuaaagaguuuuaaggaaauccugauaaauuuuguuaaauauuuugauucacagaagcaaacgaaaaauuaaauagcaaauaaaaugagggagucacaacuauuugaaagcacauacugagcugaagacuuaaaagaguuucagaugggagcgggugagauggcucagcagguaaaagugcucgcugugcaagccucaugccccgaguugaucccacagcgaugguagaagggaaguaccaacucagaguuguccucuaagcucgucauguguguuauggcaugugcuuguuuucacucacauacuaauuauaaauauuaaaaaagcucugauaguaaguuuuauauaaaguauauuuugccauaauucaaaugaaacaaauauaauaguagauguuuuggccuuugaugucuuaauagagcacuguguguguuauauguacgugcuuguauaggucugcauguguaugcauaugcguguacauucaugugugaaggucaaagcuggagcucacaguuugacuaugcugguuggucacugcucuagggagccccccugucaucccagccugagcacuaagguuacaaaugguaacccuaguuaccugguaacugcugcuuuuccagggugcuggagagccaaacucaaguucucauggaugcaugauggucacuugacuagcugagccaucuuccagccugagaacucaguauuuaaucagugugaaauauggaaauacugguauucaguaucaugaauuucagcaguuauguuaauaaggccuuuucaguuuuucugucaguuaucgaugugucugaaugacuaugguucuggcagugugaaauucaucuuuaaagaaguaaguguugguggaaauccacacgcuuaaugaaccuuguguugguuaacaguuauugagacaaucccucccucuuaggccaccuggaucucuacuucuaagggaccuacacaguagggauuucucagggcuguagauaguaggacucuacuaaaauuguaugauaguucucaagucuucugcaagaugaugagugguguuaguuccuguccuuguuguguaauguuugcuggguaggugggaauaaucaccuuuuuaccccagaucaggcaccagugacagcguagaaagaguccucccaagucuggcuuggugagccauugagcuuauugggguuguauaacggguucacucacugaaaagcacuggcggugugguugaccacucacaaaagcagcacaacagcccccugcccaacuugcaggccgugcucccagagucugugcucuccagcaguuguugaccucugugaaguauucuaagggagcagauuaagggugggauuucuaccaagggagaauuucuacaaucccaagggagaauuucuacaauccuaagggaggucuuuuaagggugggaagagagaccaggaauuuuuugcuauuucauuugaauugagacauuuccauuucaaagcguuaggguuuaaagcaauaccaaaagaucucaucaccugcaucagucauccuaucaguagagcaguuagguauggcagcgagaagggaggcagccuccuuauuuaggcaucuuauuagauagagauuacaaauagcuaaauaugcaguucuucacaagccacccugcuaccucaucuguggcugcugcacacccuuccacccacacugggugucccagggguccagccugacuggggaccaaaggggagcaggucucuauucuugccuuuugugcuugcugggauccagcuuccugguucugacaggcuuugauaagcgccgugguuuugccuuuccaugagucaugcccgucugcugaaagguucuaggcugggcaaacguuuacccuagugagcugucuucuagggagaagugugcacagcauacccuuaguggauaacugccugccccaggaggaaccugcuguuuuucacuguacuguucuuucccuucuuugacccuuugagauguuucaggcuuuaaaaccuucaggggcugacaggcacacagugcauggcuuuuugucagccaauuaccuggaaauucuggcuugguagaaauccugucuggagaccuggauagacucuuugucugcccugccuuucucuuaugccccuugcuuggacacuuuaugagcaauguaagucauucaaauuccauuucguaaagaucauauuuuuccauggacucacucugcaaagccacaaaagccccacccccaucuuaacucuccugugaauauaaugcugucuggccugguauuguauacuuuuucagcauaacacacgacgacuuacccuagacagggauccuaugacagaccagagaauggauaccagcaaagucccacuugguggaccuaugaguuuuauugggagcaaaaaggauuccaaggcagcuauaccaucaccaacgcccacccagcaugauggcagcucccaaacauugggacaccuagagcgcacugcagccugcaggcggcucaacaggccuaaaccucuuccaagcaacuggucugcuuccugagucgucuuugccauucagcucucucuugugagagggacucucagccuuuauugcuuacucugguagggaggggccuaaugacaguaucuggucaguuucagggacuucaggaagcuauuuugaguuguuuaccuuacuauuuaaggagcuuccugcaggauggaauguuucaaucucgaggaaggagacuguuacacacuuggaggaagcugacacacaccugguggggacacacacauggucuuucacacucaguucugcccauccuauuugcuguacauucuuugacacaggaacuccuggucauaaccaaauauccuugugagcggcauugcaagugccucggggacuaauuuuccucacguugucucagugagucguuuucucugcuuccagggcagccagacugaucucacuaccccauguuccagcagcuucaugcagcaguugugagggacucuugcauugguuuucagacccaguguauuauucccugguuaccauagcccccugaacuggcccguuauugaggcugccaucugcuuguuaaucacagagguuucucuuccucucuauuaaauuuagaugggaggaguaucuuguucuaauucgucuucgccaucuuccuuuucaccauuugguucuucccacacuuucugagcuuuuggauguuaggggcuauuuagcauggaucuaauguguacucuauucguugcaccccacaaagaaacagcagucuagcaccuucacccuagugcccucugccccaccuuuccugccaaaccugggcucaugugaagaaugcauucacgucuuuauccugcuucagccauguggcucuggcucuagaguuaagaauggaaggaacuacugggacaauugaugcugguuagcuggagcuaaggaauuagcagugauuaagaagagaccagcaucacugaggugaaaucuucuggaaauuguuuucugggaucacaaagaagcuguguuccagagauacccaagguuguaccucaugcugcggcuggacuugguaauguguaagagucacucuggugguacuguuugugaaggaaugaagggaucauggagaaaagcugaggcuuagcacugugagaggccagggaaggccauuggagaaggugaagccucagcuguaguugauggcccaggacugaaggggucaugcaaaggauuugaggcuuggcacccugaagagagccuaugagaggcuauuggugaagccuaguuggaguggaacaccccaguguauuggagaugucaguaccaugggaugaucaccaagaacugcagccguaguggaguggaucaaccugagcuuagagugcucucaugcuggcauguucauucugagaagacagcucagccucuguuguaugucuuaucacucauagcagaacucugacugccagcagccacagccugcuuacagucguauccaauaugugcugcuuugggggacugcaguauaguuucuagaccaccagcuauuugggaggcauccucuaacucagucaguagaccccauuuaucagggaagaaugccacaccccauaccacauagaggaaaccaugaccuggggauuuucccaaagauguuccaugcccaaauaguucagacucaguugcacauauugagguacacaacugccacuauaucaaacugauauccaguauguacucuauuccuuuguaucccacaaauuguaagaaacaacagucaaaugcacucuauucccuugcuuuguuuucuauucuuuugcacccacaagcuguaagaaacagcaauccguagcuauauugggauugcuuguguggaugcuccaccuucaaauagaucagcuucaguugcuuugggcuuuguuugccuuguuuggauugcgauuccugggaaucuaugaacauacaguccuccacccucaagaaugaugccaauggcagaucaaagaaaugaugauugcacucaaguuuacuuggugaaacagugacguacuggcugguucugugugucaacuugacacaggcuggaguuaucacagagaaagcagcuucaggugaggaaaugccuccaugagauccagcuguaaggcauuuucucaauuagugaucaaggugggggugccccuuguguguggugccaucccugggcuggucgucuuggguucuguaagaaagcaggcugagcaagccaggggaagcaagccaguaaguaacaccccuccauggccucugcaucagcuccugcuuucugaccugcuugaauuccaguccugacuuccuuuggugaugaacagcaauguggaaguguaagccgaauaaacccuuuccuccccaagugcuucuuggccaugauguuugugcaggaauagaaacccuaacuaagacaagugaguuuauuaaaguuaaggagcuucagugacucggagcuguaucaccaaaaguccaugucagcucacgucauaaaaccgccgcccuugaguugcugguagcucuacagaagcauggcuuccuccaguaguuguuuacugcuuauagauccuuggagaggaacaucuggaguuuugaguaacuuucuuaggaaaugaaccuucucucuuccuuccaggagggauuguuuaguugggaggaaauauguagagagcgcuuagagugaaaacgauguuucucagauguuuuggucucaggccucuuccuacucaaagguggaguuacaccccccccgcccccaagagcucuagagaaaucgcuuccccaaaacauacaucuaguguaagguuugauuuauaaauuaauaagggauuagcagcaauaauaaagaaacagaagaauugguggcaaauuaugugcagguagucuugauccacuccagaagucccuaagucaagaacccccaucguuucuccuagaggaagcacgguuagcucguucuguuguaucuaaauugucagcuccgguaagagugacaucaggaaaagaacugaaaugccaggagagugaggugaagcaaugacagugggcgauagauuggguaccaugggcaggacacagcgcagaguacccaucaccacauugcuacagacucacauggguauaguuuacacauucucguuucugggcagauagauuggguaccaagggcagaacacagcgcaaaguguacaucaccacacugcuacagacggcauguggguauaguuugcacauucucguuucuggucuuuucccacucccagucaguggcuggcugcagaccacuagugcagaaagcaguacuguggagagaagaaaugacuauauugagugugucuuuguuaauccggguuacaucuguugagacuuaugguauaaguuaaaauguagaaguaaaaguauaucaacucugaugucugagaguaaauuacacuugcaguuagaaaccuugugaaacuaagauuacugaaaaaagguggugguguguguuugagucaguuuaaugccagauuuuguagaagacagcccaguucuugccuuuucccugcuguuguguauaguauauggaucaaauucaugaaauagaugauggaguggagaagaaaguacuauugcaauggucuuuucaaauaauagauuuuuuuuucuuuauaauacaggguuuggauaauuauuucuugugaggagaauuuugagccuuaucagugaaauuuucauauuccugguauguuaaaauucacgggcuuuauuuuacagaaauagauauuauuauauggguuggucuuuugggaaguauuacuucaauaugucaugcagaucguucaaaguauuaacaucuaacuuuguaagaauaacaagcaacacguuuguuaguaacaccagucuuagaaaaguaaugguuauugggaaacugcuaauauuauaaaagcuuguauaauacuauaaaauucagauauuugucuaaaagcuuaaagucuaucuuugggggcaaagauuguuguucucuucuaagucacaggcucccauguucauccuggagaacgugggccaaaugcagagguucagaccgucugaaacagcugcauaguguuagucaaguaggccgucacaucuagaggugcuuaugugauucucauugugguagucuuaacucaaauauguacuucagaggcuagaauuuaauguaauuacauuugcaugaaaaauauucccauaugaaacuggcucaggaaaacuagcaugaaaauaccacgaagaccuggugauaaagaggaugacuggcgugugccguuugauggcucccuuugggugauguaguuaguguuaagguuuuguuuguguugagagcauuauuguauuggaugcauuuucugaaugaccaaggcaugaugcuacagaaucaagcaccgucacuauuggcagugaggaaagcaagaucaucuuaguauuguuucacaguuugaacuucucagagcccagaaaggaugguccagaucacuaggaacccacagugaguagugugaaaugugcugauuaauacaaggagcucguaauuuuguuaacauggcuuuaagaaucugcugaugaguguggauagucuuguauacaccacaguuuauguguaauuuucaggagaauuauacauuccugcagcuguacaaucauaguucucaaacuggaagguuuguuucugugccacacccuagaguuucucuucugguuagucuguagcagagcuugauaauucaccuuuuuaccaagccccaggagaugcccauacuuuuugggagcagauuucuaguccugggcugauuauauuacugguguaggguaagcucggucuuuuaaaaaucucucuucgcuguuuucauucaugugcaaaauugaggaucauuguuggaggaugcauaaaauucaguuaagacucccguguuuagugaggugcugugaccgcugugcaugaaccuuucaagugguuuuauauuggaggagaaacaguccuguguuccuuagagaguacuuagaggagcccugggugcugagucugugcagugaguagacacaguuacugaaacuccucgugacagugcuguaaagugcugcacguagaaucccagagcuuggcuugucagucugugcugcuggauuggcuuuuucaagagacuaugcuaguuuauguuccucacacaguccuuacaccuuacauaggaguuuguuuuugagaugcaguaaacacagauaagcgcaaaucauaguauauuauaaggcgaauuuucagaguuuaugccuggguguaacaggcacccggauuaagaaucaguccaucugcagcugcaagccugucugaaugucuagcccuuaaccacacauaggguagugcagucagcuuuugaacuuggcgagaggauucuaucuuguuacuuguugugugugguuuggcugucaaagggcagugguuuguugguuuuuaguguuguguacaaucugcugugacugcugcaucuggauauuguuggcugugugcacagugcucuuaggaacaguucuguguagcuuucacauguuuauuauauuuguuuucggaggugaggugcuugugucaugcacacguguggaggucggaagacaacuugucggaguuaguguucuccuucugccacaagacuuuggugacaagaguuuuuacucacugagccaucuugcaggcucaguguuguaauaaagcaaacaaauacuauauuuguuuuaauuuacauuucuagugagucauugguugugauuaauccuuuuuuucccugcccuuggccauuugguuguggaauuuuuuuuggucugugcauuuuuguagucacucuaaauagcuauuguucuguuuuuauuuaaucuaucaauucccuagauuuacugccuuuaaagcuuuuuuuuugucuccuuuuccccugaggugaugugucuaccgacacucuuucuucauuuuauguuagucuuucuagaguuugcuuugcugugcacugagagguauagauuuaaagaacuauucuaaaaaugguucaguugcuuagaauuaagauaaaauaaagcuugaggguuuuuaaaaauuguauuaguguuuuuguguguuuuuucucugggcuucuaauuaugauuuauucauuggguugcauuuaguguuuucuuucuccacugucuguagcucucugagauaaaggaggguggacugaaaacuacugacagauuccaagugguggcaguuuucugccuucugaugcauuggugugugugugugugugccacuguuucuauucuccacuuaguuuucguuuucuuguuguucugcauuuucuuucugaaggacuuaggaaguuuuuaguaguugacguuagacugcuucuguagugucugucuguccucacugcaaccugugagcucccgaagucuggaaguuagaacuuccgucagcugugagaagugucauuuuugcagagcuucuucucuuccuacccucauuacucugguaucuuacugaaugcuugccuuuuguaccuguuucagagccuccuggaagaguucuuaaggagcuugggcugaggagugaaguaugcauucuagguuguggaaaauggcgauagauggggcuaggacagagagcgaacgccccagugugauuucuuuuaucaccauuuuccaaacuuugcuuuuuaaaaaugcugucaccuucgauguaauugugcacuuggcccucugguccgauugcaguauuuccccuugauauaucccucuacuuuuggcuagcgcugcagugggaaauccugucuucauauucacagcagcaaaggagacacagugcugguguugaguguaggccuucucugguccaucgccugccuaggcaggauaauuaccuucugcuguugagcuaaucuuuuugcguuggaauuuaaccaucuuuuuuucuugggacaguuuauuuuuacucccuguuucuuaccuuuuuuguuucugguaguuucucuguuggguuuggagaaagcacuccuuuaguucucuguacuuuagcauucucucccucucucuaccucucucccucucucucccccucucccuccccaaaccagguucuauaagauagaauaauuuucagcuagggucugcuuuugacaaaugagaaaucaacagggaaauauacuccuuugugacuuuugaugaaccaaucagaagcuaguuuaucuucuaaggauuaaaagcuaauauaguuacaaugaaagcuagaagaggaagcaauaacguuaaauauaaaauauuugucauuggaugguauauuacagaguaaucagaaacuucuaacuaggugucugugcuuuguuguguauuagaugagguaaaccaguugguacauagaagacaaguaagguggagguucuuuccgcaguucccaguacagauguucacaacagcauacacauuucuuccguaaaauacaguaaacccaaauaccuaaaaacaugucagaagaagaaaguggacagaaugagagugaaggcauggugguggagcugucgugagauaaacagcagcugccuuccacacaucagccaggaugcacaugauucagaaugaacuuagaguuagaaguuccuccaugucuggacccucuggaguaggcagugauguuagggagccacugaauacccuggggagaaaaguguuuaaaagcucuacaguuauuguucaaaagcuucuguguugcuaauuuuugugaacgugacacaggcauaucugggaggagagggacucuagguuuaggaguuuucuccaucagauuggcucgugugcaagucugugaggcaauuuuuugauuacugauggaugugggagaaccccagcccacuguggguggagccauuccuggguaguugaugguaauucuuauaagaaacagggcuguugggcuggugagauagcucagugguuaagagcaucaacuucccaagguccugaguccaaaucccagcaaccacaugguugcucacaaccauccguaaugagagcugacuccuucuucaggagugucugaagacagcuacaguguacuuacauauaauaaauaaauaaaucuuuaaaaaaaaaagaaagaaaaagaaacggggcugagcaagccaugcaaaggggacagacaccaguaaggaggguuucuucuccaugggucuugguuucacuuccuguuuccugacuacuucccuucauguuggacugugaagugggaagccacacaaacccuuugauccccaagcugccuuuggugguguuugaucccagcaguagagagccaaugaggccagucuuguggcuggaauuacguaaacaguagaucacugauaccuucccuucuaagguaucucguggauccucugucacuaaaagcccguuuaucuuuuaugucaguguucuugacaauuucaagcuuacuuuacucuuugucuuuuggguguucuuggaucuuacaauacuuacagaaaaauuaaaaaaugacauguaauaugaacuuugcuauugugauccagugcucguugcuuuguugguagucagguuaggaagaaaaugccuucuuagucuguuguuugcuacuguuuauaaaauauuucaguuuauauuacaccaaacgccuuuggguuuucuuuuuugauaacauuguucauguuaccguuaagguuuaagguuguuucuugcagauuuuaauuguaggcaagcuuaaaauguuaaauguuaaguggaaugacuuuuccugguuuuuuagcucagaccuggggaauaaauacccguggcccuacaucuuguacugaaacacuucaaagggccuuaauuauaauacuuuaaaaucaguucuuuaagaauguugcuaaguguauuuaguuaggccuuguacuuugaauuuaguuuuuccuuaaaguacauuuuuuguuuucuuuaaauaugugaaaugacauuauuuaccagcaaacaugugcugaaauuuacaaaucaucuuacacucuacuuacauucuacugcuccuggacagggguagcucaauuuuauaucagaauagugaaaccagagagagcuggccauguguccagucugcuguucuggcacaauaguacugagcagugguagagguccuacagucucgguucugucccucccucccucgaccaucacaacccaacccuucccauuaugagaagcaaggcuccuggggaguuugaaggcuuguugcuuuguuccuguugggacagaaaagacaaugauggauuaggugacaucagucaggucaggccacuggcauucugcgagcccagguaaggagcuugcauuugaggaagggucuauccuguggucucucuaugcuagcugaugucaacagcaggcaugcgaagaugaggcccagaggacuaguaaggucguuggaugagugucuagcuguuggcuuacgucuuucccacuuggacccucacagaccaaggugcucacccagaauuugggacccagcuguccuugccuucuaacucugugccagaucuuuauuguuagacaggagagcaggaguguccuuaacuaguugccucugauuuuguucuugauucuuuacuuuuuauugugauuugugugugugugugugugugugugugucugucugucugucugucuguuagucugucugugugugucuguguguucauacggagggcagagguccaugcuggguguucugcagucaccuuccaucuuaguuuuugagacugggucucuuuguugagccuguagcuccagggaucccucugucccacaccaaguucccagcuuucuucuuuuuuccuaacguggguaugggagauucagauugagauccuuaugucugcauaccgagcacuugaacagaccggaucauuuuccuagcuccuuaguguuuuuaaaagaggaucucuuuauguagcauaggcuggccuacaaacauugcucagucucccuccagcauugugggauuagaggcaugugcugccauauuuggcucugaugugcucauuuuuacauaguguauuagaguuuccuggaggagaagaacagauagaauuuauuauuguuauuauugcauccacuaacagugagauagaacaauuguuucacuugagacaucuaggacugguaguugcucagccuugaggcugggugcuuaagcuaucccagucuggugccccaaaccugguguguucuggagacuuuggucuccuaucagugcaggaaugagcugcagcggucaggaggaacugaagcagcaaaggagggaaggccaaguuagcgggacagccuuccuucuccaugccccuuuaaucuggguugcuaccggaaugcacuguucacacggugcucccagcucagcuaaggcacucacucggucgguacagcucccggcccaggugacucuaguuugugcagaguugauuuaaagugaacaucucauucagcuaucugaaaacuuuuuaaagacucaaauagcauuaagugauuuugcuuacaaaucauuucucagguccuugaaacaaauuucuacccaugacuuacagaagugauggcagaugcuguuauuuauucucccugaauucaucuucuaauuccuuaccaguagauuaguugauuuucuugagacagaugugugcucagcuauaaaagacuuguuuuucagccuguuuuuguaagugggcaggugacacauuuuuggcuaggaaagcauagguaggcauacuuaaaugaagacccuuucugauuuacuaaauauucuguguccaagccuuucuuucuugucugaaaaucauguguccagcuuagaguuguagcacucuuacaagcacaaacagauuaagcagagaaugcuaaaguggacagacaggcuuucagcgguuucugacgccauugcuaagugagcaugagccaggugacucuguaaugguuuagggguuucacucagagcugccuguguuccuucccaauaaaaugaccuuacuaguccucugggccucaucuucgcaugccugcuguugacaucagcuagcauagagagaccacaggauagacccuuccucaaaugcaagcuccuuaccugggcucgcagaaugccaguggccugaccugacugaugucaccuaauccaucauugucuuuucugucccaacaggaacaaagcaacaagccuucaaacuccccaggagccuugcuucucauaaugggaaggguuggguugugauggucgagggagggagggacagaaccgagacuguaggaccucuacuacugcucaguacuauugugccaggauuaagaacagcagacugggcacauggccagcucucucuaguuucacuauucugauauaaaauugagcuaccccuguccaggagcaguagaauucugacuuuguaauacacgucuaugaaauccuuuuuuaaaaauuuuuuauuauuuuuuuaaauuuugggaaacuuccuuaguacuuggcuuuccugaaaaggaguggauuucuauagauagcauggaagacacauuuuuguuguuguuguucuauuuuucaugugguccucauuucuuuaguguaugaaugaaauggaggaagaucugacuguuucauuacccuuuaguuuuauuuaacaugccaguuucuaaguugaucaaguaaguaguaguguggaauuagugccgcacagccacagaguggggcgggucaguaagugcugucaugcacaguuucagccuuuaguccguugcauuguagcucacaguuuguccuuaucaguggccauuucccuuccucuuggucucacuaaauucuccucaaguuacacuuugccuaauguugucugugguuccugccuucugccacagugucaccuguuuggucauuacacugcuucggguccuagccugcuguuccccuucuuccuuuucuagcccuagacugugacacuuguuucacagucugcuucuguaugcuuagaugcgacuagucucauuuuacaccuuguuuucucagauuuguaauccugucacagauagcuuuauugaacuaacuguugcacacaguuugacauuggugcacccuaauaguauucugauaccuucagauucugauacaaccuguaguguucugauauuuaaaggacuuaaauagaaaauuuuugucagcaguuuuuaaguaugaaguacauggaagcuuaugaaugugauuuuguuacaugucguaacacuguggggcagaaggcaccucauucacuugcauuucuggcacaguggccugccccagcaagccauuagaaaugguuucugagucagccacucaguagcaaggagcauugcccuuuuggaaaugggaaggucaguuugaacaaagcuaauguuuuugcuuguuuugccuuagccuuuuuacuauagcagaauacuauaaguaauauaguaguauauauaauauaguagaauucuauaagucauauauaguauguaguaaaagguaggguauaggguaggaucagcacauggguguggaccucguuaaggauuuaaguuaacguauagaacauuuugcuucuuucugcagguuuuggaaggaaggauguuguagaacacuugcugcagaugggugcuaauguccacgcccgugaugacgggggucucaucccacuucauaaugccugcucuuucggccaugcugagguugugagucuguuacugugucaaggagcagauccgaaugccagagauaacuggaacuauacaccacugcaugaagcugccauuaaagggaaaauugaugucuguauuggugaguauuagugcuguauuguugcugguuaaguuuuaacuuaaggucacucuugugcuuucacugugauguaaccagugcugccucagcauauguaagggcguauggcuucuagaggaauucuguucccugggagggaaguagugagcugaguccaaagguuuaaagaauaagauucgaauuggcucccucagagaggcaacucagcgucagccguguagaagacguaaaguaaauucugacuaauuauucucugcagccuaaacggcugcauuuaacuuugcaucagugagagccauacaaguauaaauucuuacugaaccagaugacauauuugacuauuguagguugauuuagagaaaaucaucaaauauuuugacaaaugucuuuaauuugcuaaaauugaacacugaucaguuuguaacuauuggaaagccuuagguauguuucaaauccaguaguucaaagccgaacugugugugcuugguuuugcuuuguucaacuugacacaagccuccaucagauuggccuauaggcaauucugugacgacauuuucuugauuaaugaugugugagagggcccaguccccagugggcaaugccaucccugggcaggugguucuggacuguaugagaaaauagguuuggccagcaauggagagcaagugguaaguagcauuccuccauggugucugcuucuguccuaccuugaguuccugccucgauuucccuccgugauggacuauaaacugaaauaaagccucuucuccccagauugcuuuugauguuuaugacaaaaguagaaaacagacuaggacugagagaaaacaguuacagagaauucaacuuuccaacuauuuuaagauuuugccuuauugcauuaacauuucuacuuugaaagcuaauuaaaccucuugaaagacaaauguuuagucuccuguggaucucuauuucuuauccuucagaugguugaaauguguuuagcccauggcagacuuaguauucuuucugcaugacagaaugguggcucugucucuguggguaucaacauuuuauugcaacauuuucuuuaugcuaaaguauauaggccauuuuuaacauguucugguuaaaauuucccuugauagugauuacaacuauucccucauagccuuuguugugaucucuggaaauuguaguuuucugucaaguucucugccauuauccuuaggcacuuuagcauuuuuggcgugaugcuuugacuauccugugccuugccaccugugacuuuagugccuugccaccuguuaaguucagaugagugucuccuuuccucuugagccuugcacuaauacagccaugaccgaucaacccauuuguacaacuaccugacaaaccugaacuuagcgcauccucucugaucucuauucuggccuccuuuucauaugugauagcuguuguugaaccccauaauuguuuuugucuauguagccuuuuagcuucuguuguuaccucaccugacacuguaugcacuggguuuuucuuagucauuggucacagacuuucauguucuuuucagucccuaaaaacauugguucuagucuccacuacaguauuuuucuauuuauaucccucuggauuuuuuauuuugucaguacuuugauuuuuuuuuaaaguuagaauccuuucuccaucuuaaucucuguaccaaaaaucagauaaugaaauguuuucuuuaauguugccuauguugaaaacaauauaaauggagccuuauaaccuguaaagaaugggccccugcaaccaccacuuccuguaguccucgacaggcucuacacguagcucagguuaaauucuugugaacuguaaaaguugaaaggaggggaaggguaccuuugaaacuguuaucaaaauauagccaagguguagcuacugugaaaguaucuacugcaaucaagauagaccuguagccuggcauggugguacugaccuuuaaucuuagcacuugggaugugagggcagggugacucuccaaguuugaaacccgucuggucuacauaguaaaacuuugccucaaaaaacucuucucuauauuuaauuuuuuaacuuuugggagccucuuaauaugcauuugaaaaagcucugauagcauauguuauacuucaugaacucaagcauacuuaaauccugaaauauucuugugacgcauagcuggacaaaauaggaaaccuguccuuuuucuuuuuucuuuuuuuucuuuucuuuuuuuuuuuuuuuuuugucugaggcugguagcuuugaggcugguguauaaaguuaauuuaaaaaugcacucaccuaguugauagacugcuacccugauuuacuaugucucugauuguaaauagcuaauacaauugacaaaucauaaggguagagccaaaucacaugacuacuaccuaggaaagcauuggggcaaaagcuagggcacagguucucauuuauauccucgacucuccaguuuccacaaucaccauguuuuaaugaugugcagagaggaauagucuacaaaauucucccuguucuucaccaccuuaccaauacaugauacuuggaaggguaauagcuauaguacauaaucaacaauaauaaugccuauuauuaaugacuaguuccaccauuauuaaaauauaaaauuuaacuucuauacuuugguuccucugcccuucccccugccccccacccggccaccccccccaccucugcccuuuuuugauaaagaagucaugugaacagccuucaaucuguuucuuucauugcuacuuuuuagcuaucauaaaaggagaaaauagagauaauuuuuguaaaauucaacuuuaaaugcuuguaaaaauaaaugaacuguuugcaacaguaaugggguuugcuugaauuuuuaugccauucuuuuaugguguauaacaacccaaguguacuuuagaagucaguuuauuuucucuuuaaagcuuguucauuucuuccuguccucagaauauaauccccagaaaaugaaaauaaguauuuauugaacacaugccacgugaauacagaagcuguuuggggucaggucugcuuuguuccauuccuggcuuggagugacuuuucugucagccaggugcuuuguucuccggugguagaauucugaccauauagcugugcggauauuaaagaaucauuuguagcaaucgauuuuuuaauucuguguuaguaguagccuggcuaugauguuccuacuaaagaacaguuaaagauuuugcuuaaaggacccagauagagcugucucuugugagacuauguuggggccuagcaaacacagaaguggaugcucacagucagcuauuggguggaacacagggcccccaauggaggagcuagagaaauuacccaaggagcuaaaggggucugcaacccuauagguggaacaacauuaugaacuaaccaguaccccucagagcucgugucucuaguugcauauguaucaaaagauggccuaguuggccaucauuggaaagagaggcccacuggacuugcaaacuuuauaugccuuaguucaggggaacaccagggccaagaagugggaguggguggguaggggaguaggggggaggguauggaggacuuuugggauagcauuggaaauguaaaugaaaauaccuaauuuaaaaaaaagaacaguuaauuuccuucuacuguguagggguuugguuuuugagguuuauccuauacuuuccugucauuucaacuugaaguaaacuuuggucuguauuaauuccuucacgcgugugugugcgugugugcacgugugcaauaugcacaucaugugugaagaucagaugacagcuuuguaaagucuguucucugcauuuacauggguucucaugaucaaacccaggucaccagacuuacauaguaagugccuuuaccuacugggccaucuugcuguccugaaaucaaagaauuuuaagaauguaggggugcaugguuuucuaacacauacaggauucuuucugucuugauacuucaacaucuagaccagaaguuuuguaagcaaaaugaaaauuaaugcccuguuuuaaccauagcauaagauagagaauaguguguguguccguguccaggauagcuuuaaaaaagauaaacacaagccugcacacauacaacuccuguucuaggaacauuaaauuuaggugacuuuagggccaagaccuuaaucuguuucaaaguaaaacauucaaaagcuggaaagauggcuugcugugcaaggauuagggccugacuugagauccccagccccgauagagcugggcgugguagcaugccucucuaauccuacugcuacgggcagaaauaagagcguguguaaguguacgagugcacgcauacacacagucucaguagaugaagaaaaugcuaguaguuuugaugaucugugagaaauauccccaaaugcagaccagaauacgaacauguuaagauguggaaauccugaagaauaacguaaaucuaggaauguaauauuauuuuaaaagcuuacacguuauaggaguuccagauggaaaagauauaagaacuguuaaagaagucaguaauaaaugauaauaagaaaaugcaucuuaauguugaaaaagcuuauugaaucccaggccagauugagacccacugaggauaaguugccuacacagagaaaaaaaauaggcaaaggauuuuuuguuuguuuacaccaugaagcccugaagacaguggaauacuguuaggaaguuaugaagacuuucggcagaauuugauucaccuguaauucccuugaugaaaagcagcuccuuagcugucggugaguaagaaaggcuacccagugugugugacaggaugcuucauuucuuagauagugccucaaaacauguaccuuuagcuguccugaaacucauguagaccagauuagccucaaccuuuaaucgcaaauacugggguuaaaggcuaccacgcccugcugggacaaagcuccugaugcuugcuugcuugcuuugcucauucaaacagcucuuggguuuuuguucuguguguagagucccacauucaggcugccacaguucgauuuguuuuccaggcuccauggcauuuugucauagugguugaaaucaaagaaaccugggucuuuuugugagcuaccuguuucaggacugaguuagagguaagaacaucaucacacaguuucgaagguggaugaaacgacucaaguagcccuuaguaugcugugcauggaugaguagaguaauagcugaacaggacauguuccauagguuacgcucccucuacuuaguugaaaauaacauagucugagguacuuuuccuuugcauuuuaugauuuguuucagauguguuucuauuuacucaagcucuaugcugucuaggaagagauuaggcaaaguauauagagauaauaaaugaacuaguaaaaacaauuaacugcaauccuguuucuucuacccuaaauuagaccuucaguaaauucuuuaacauguaauagaauuuuuaguauuuuuucccauuaaaguuucuguauuuguuuucucucuccccccaucccccuuuuugcuguauagaaaauaacuggcaugccuuagcuuugaucauuucaccagauaagcucagauuuauucagccaaaugcacuaucaacugcaguaccauucuauuucugguaggacccuuuauucagaagaaaaguuaaaaguauuacaauuuaaagucuaguuuauauauguauuuuuuuacacaugugugcacauauauauucaugaaauuaggcagcauaaacuuaacaaccggauuuaaccaaacuuguuagauugucgguugauaauauauggaauugucagcaguugagacaauuucacucacagaguaauugaggacuguugugaucugcugacaggaccaugaaauagaaugguacuaugauuguagguccauucuacacuuugauuuuaaccuuaugcuuaaucuuucacuuaggauuucaaauaacuaaaauucucauuuaaagaauacaauauacuaaucuagugguacuacacccuauaggaaugucagugaguuuaaaguaauugaauuugcauuuuaccagacacauguuuauauucaaguacaaacacagucuacugucagguaauuaugugccguuuuucaaguaauccucaagauaaguagcugaguguugauucugaccacgucuugacuuuugauuguggcugcuuuucuauaaagaaggggcagccaaucaaccaagugugauaguuccuggcuguaaauguugggauccuugacaggaucaggagcucaaggcccccuuggauauguaauagaauugaagcuacccugggcuguuagagauucugucaaacaaaauaaaacaaaaacaaacaacaaaggagggcauccuguagugggacuuugccuacuuggugguucuucuuucuuccacccuuuccaucccuuuucuuccacucuuugaacucccuaccacuaaauaggagaggaaaaaggauagaggggauggggguaacauuaucauuagacuacuuccagcugaguaggggcauugaguuccuuagggcaaguuugaucuuugcugucaggauaucuaauuucuucuuguuguuucuucuuuuuuugcacaugacuacuuaacaacgucaaccaacauccaguaauccaccuugccuauuggggcccuugcauuuauauacccucugaaaaguacccagacuuccaaaugucacacaaucgcagaaacuaucugcagcugguaaaaucacgucucugcuagggcaugaggcaaaucauagucagcugcugugaacaaucugaaguagcccccgucccacccacaccugggauuaaaaugaagacauauucccauaauauuuuuguguuuuuuuuuccccaaagaaaccaaucaguuucugaaaugguccuaaacauaugccauuugcuacuacauauuuaggcuaagcagcauucucagcauugaugaugauaaaaucaaaauacugauaauuuccaaaagauauauuagguagacuguguguguguguguguccuguugacacaggggucucauaguucaggcuggcugugaacuuuacuaaccagggagaugaccuuggauuauugaucucucccucucccucuccaguacugggcuauugugcaccaccaggcaaacauguaagccauuagagaacagucaacaagcacuugaaucucauuaguaugcaaguuugcuuucuucuuuuauaaaugauaagacugugcacaguaauuauagucagugucuuuguaauugucuguaaauguuggacuuguauaucuacuuuauaugcguguauagcugugaucuguuaacaguucucagguggcauagggaagcaaguaggacucuagaagcacacugccuuacagagcauagcuuucauuaaggucugaguacguuuuaaucaguacuaugauuuaaucaggcuaauggccuggaaagcuacagcuucuuauaagagucacagcagcuugagcuauuggacuacuacacuaggacucuugauuuuaguuugucacauuaucuguucaugugucauccacagugaguuacaaagaacauuuauuuucuuuugcuuccauacuuggaaaaaugaguugaaaauuuaacaaagcuuugagauuuauuuagaauuuauuuuuuaguuaugugucucuguggguaucuguacuggaguacagauacccauagagacuggaagagaucaucagguucccuggagacagugauaggcaguugugaacugccugauguggguggguccugggaccuggacucaggcuuucugguagagcacugaguucaccacagagccauuuccagcccagcuuugggaauuugauugcauucucucucucucucucucucucucucucucucccucucucucucuccccccccucucucccucucucucuccgacucccccucucccucucucccucucucucucccucucucucucucccucucucccucucucucucucccucucucccucucucucccuucagaacaacgcucaucuuguuuucuccucuuuuuuuuucuuugcaucaauuuuucacauauacagugaacuugggucuuuuuuaguguaacauuuuauguuaauugucagaauuccauacaguauccuuaaaaaagagaacaguaaggaaugguaacauuauuuuaucuugugacagaauaacugacucugaguaucuugccugcugguguucaaaugccucgaagaagauaaggauauuuauuuauugaccugauuaauuuggugcuauguagaaggguucuagauaaugguaaugauuauauugucuuucucuuucauacacacacacacacacacacacacacauauauauaauacacauauauuuguucauuguuauuagaauucauaggaaagcacuaguuuaaauucauauuaguaucauaagaaauaaaaugcuuaaauuaagaggaaaaggagggacuaaaacauguuuuugagugauguuggucuucaccuaaucuugaaauauaucuguuaaaagaauuacauguuucuauuacuuuagaauaggcuggccaugauaguucauaguagugugucagugagcugugugguuuaagauguuguaguaugacaauggccuuugaugugcugagguguuguugcauugcaugaugucaugugaccugaagcucuggacauuagagcucuuuucucacuuugcugggauuucaagccaagcuuucuacucucuaaccuagaaagccaaguauaauccuuguuauauagacuucaaaagauaggggcucucuguagcacuuggcuuacuuaagucugccagucuuuuucaaguuggacaggguccagacuuaaagcuguaagccucugugugaguuguuuaauaguuuguuucuugauaugauaguaucaauaagauuuucuacaaaauaucccacugucugucaagaccuauauuuauuuuguaucaaggccgaaauuuucuuaauuuguuuuacuauccuguggagucugacuagagagugagggaggguacagacuuccuguucauauuuggcacucaguuuuuuuuguuuguuuuguuuuuuguuuuuuuuuucaagacaggguuucucuguguagcccuggcuguccuggaacucacucuguagaccaggugggccucgaacucagaaauccaccugccucugccucccgagugcugggauuaaaggcauaugccaucaacgcccggcuuggcucucagcuuuaacugugcucuuuuaaaagaauauucaugaguaugggagugggaacagcagaaggauggaaccaugauguuuuucagaauuaugauuuuaagcauuuaauuguugauggaauuauaaggaggaggacaugggauguaauaggagcaggagagguauuuaggacagaugugaaaacuggccuuuagaacucacauaggagaagaaagcuuggguuacaauuguagggcaaucuuagcuuauggucuuauagauugauaaguaagguagauaagagauucaggguacugacucuaggauuagaaugacaccuaguuuauagcuuaaccucaauguauaaagccugggacacauagcgacacccuuucaaucauacaacuucaugcuaauggcuggccauaacacugaaagagaugcacuuaauucauuaacacacacaggagaaugcaaagguagggucuccccccccggcccccaguugaacccaacuuuugagcauugagguacagggaaauguuauagacagauauuuguguaauaacacaaagaaagguaaaugguuauuagggugaacuaguuuacugcauguaugguagauauuagcaaaucuugacauuaugcacauuuuuauauuaaagacuuuuuuagaggcauaauugaagcccuggaguuuugcauaauaguuguuucaugacuguuuuacaauuuaagguuuguuucuagagucuugacauuauuuauuuuggaaucuaaauuagacauauuuacauuucauuuauuuuaccuauaauguuagucaccugauaggaagaacucuuuaauuuuuauguuuuguaguguuguuuuugcaagcauagauuaagguaauuuuugucugagaagaaauuucacuacucuauuuguaauaaacauuacaauauuugucauaaauacaaaaauaauggacugguguguaaagcagaaguccccauuuuaugaaccugcugccaucacuuuagaacuugagauguguucucacugugaguaccauugagaugccugccuagguagaucuucccaucaucccugcgcguauugccuucugcuuuccugaacaaaccuuuuagaaacagacacugacucaaaauggauuacauucucuuuagugagaauuuggaauuaagaguuuggugaugccaaugaauauauuuauuguuuauggaaaaggaggggagauagcaagauagugaaguuauaggcaguguguuggcuaauuuuaugcuagggucauuuuugagaaaggaauccaaauugagagaaaaugccucuacacagguaggccuguggagcauuuuccuaauuagugauuauugugggaggccccgcccuuuguggguggacuuaccucugcgcaggccguccugguucuuucuaucagagccugcaaggaagucaguaagccacagacaggagcaagccaguaagcaacaggccuccaagauucugcgcucuuuugaguuucugccuugacuucugucagugcucgacucuuuccuggaaguguaagcugaaauaaacccuuuccaccccagcucgcucugaucauggcaacauuacagcaacaguagcucuaaccaggacaggcacacuuccgcuuuucuuuuugaggaagucugucuguucuuucagaagucuuauuaaaacaccuuguauuccuuguaauaaaauagcuuugauaaaguuggcccucaaggacaaaguaaucgauuguuaauaaucauuuuacuuuacuuuuuuacuauuuacuuguguuuucauguuguaaacuuaagaauauuacaguagccggcauauaaaacuguuuggagaugugcuacacuuuguaucugaguguuacaggaguuuggguccugaagaacauaagagaagagagccagggcgaguucguucuuguagcagagugcggggacaguuucaguugucacagucaggaauuguuacugauucguacugggacuaggucaggguuauuguuaaacaucuuagaaggggcaggauacuacccuacuuuuuaaaguaccucugccagacagaccaguuaaguugaaaguaagagccaacuacuucagcaaagaucuaggaagcuaaagacagcaaggugaaagauaaauccaaguugucagcccuuccuguccccugucuacucaccagaaaggaugacacugaaagaaagggccagaugaccgaaucaggagcugagcagccugaagaacuagaugagagaggaaggcagaaggcuccugucucucuugaaaugcaagagaugacagcucccauucuccuggucucaagggaucagagagaaugcacuugacauucagcgucacugcaguuccucuaugcauuugugagccuaagaagaugcaugcaaagucagcugcauaacggagccaucacguuagaggcaggcggugucugcuccacgcuaguaguaucuaggaggagccaagucucuguucugaguagcacuugccaauaaaucuauguaaugcugcgcacaugaagguaaggaguuuccaguagccacauuuaaaagaugggugauaucaagucacugauacuuuucauuaagcacaauaaauacaaaguacuacuucuguauuuaaugcuuauaaaacauuauugauagcauuuuuuaagcuagaguucugaaauauguuuauaguuaaagaauaucucaguuaaacaaaauuuucaugaguuuguguguacacacauacaucauacacacacacacacacacauuuuuuuauuuaagauaauaccauuaccauguaauuuuggcuggccugauuaucauugugcggccaggcuagccucaaacuccauguuaauccuccagccucagccucccuggugcugggaugaugggucuguaccaccacacccagcucggagaguaaugcuuacccuguauuuggaguucauaaaauuugcuguucaugaaguaauuucacaugccuaagguauguugagcacauggaaugcuuguuaguaacuguaccaauuagcaggucuuuaaauuuaaauugaggaaaauuaagcguaacaguucggaucaucagacucccuaacauauuucauaaacucuggucaccuuuguuagaggccaccucaugggauggcauaucucaagaauauuaggacguugucuuaugaguaaaaaggccaagcugaagcacauccauuacuuaaaacucuucucuggagucccaaccuaguucccuauccacuauauuagaauauuuguccuuuuauuuccauuuuggaagagcuuuauaagugggucacauuaggcucugcauugugcagugauggucucagguuucuccaaaggaugcuaauuaagaugaaagcagcuuacuuuacucauugaauguugauaaucacucaguacagaagacaccauugagcaucaaagaaauguuuaucucauauucuccagagaagcuuguguauuacugaacaugaguauguugagagaacagagcugaucacucuuuugguccucaaaacacauagcuuuuaucucccgugacuaaggaaauuaaaugaagggucccagcaaaauggcuuuguggcuauaggccuuugcugccaagucugacaacccaaauuugaucuccaaaacccauaugauagaaagaguugcccuuggaccuccacaaauacacaccacagcauguucacauucacaaaaauauacaagacacaaaaauauguaaagacaaauguuaaaaauuaauaaaagugaaugauuuacuuagaguuggcacagugauaaggaagaguagauguauuuuaagguaggcuuacaaacauuacugaaacguaguuugauaacacuaguuugucaauuugcaugguuucugguguugucagcuauguguaggcauuguucugaggucugugacaguuuugguuuuucaacacgaguggagaguucuugaccaugucuucuaugagugaucuauuagugcugacacauuagcuguaaguaugguuugugucugguuuggcuuuaguuauaaggcaguucacagcacgguagaacuugauuccacccaugccucuuauguucauuucuuucccuguuguguuugugaaaauaaauaguuuuuccauucaguaauuuuaccaucaacuguuucuaaucuaguuaaaugcucagaaaguuuaaguuaaauauacauaaaagcaacauucagucuuaaugaaauaaauugaguacuuuaaguacauuuuuuuucuuuuuguauugacacaccuguucaccucugaaauaaccacuaugaucaaaaugaacaugugcaccacucuaggaaguuuugguaccuccuuucccuugcuucccaccaucucuggucgauaauugaucuauuuuuccuugaaauuauaaauuacuuuccuguuccagcauaauuuguugaguagacuauuuuuccacaagugaaucacugucucaguuacuguucuauugcuguauaugcaauauugcuacaugccaugaccaaggcaauguauagaugaaaguauucaguugggagcuucugaagauucgucauuagcaccacagcagggagugugcaggccggcagguacacaggcaggcaggcagguacacaggcaggcaggcaggcagguacacaggcaggcaggcagguacaccagcgcagauuauccugaucuccaggcagagagaagggaggaagagaggcaaggggagacagagacagagacagagacagacagggccuggcagugggcuuuugcaaccuuaaagccugcuaccagugacacccauacuccaacagggcuucaccuccuaauccuuucuagacaguuccacucccuugugacuagacauuaaauggggauuauucucauucagaucauuuuguccuuuguugaaaaauggguugacucuguguauauuugucuuuuuucugggggugggguggaggggugguucagugguuaagagaccucuaagaacucaagaccucuaagcaaccucuaaguugcacuuaaaggucuugaguucacuucucagcacccacacaguggcucacagccaucuguaaugggaucuguugcccucuucuagugugcaugaagacagagcacuuguguacucaaaauacauaaauaaaucuuuuaaaaaucauuuuaaaggaaaagaaagaaaagaacuuugaccuugaaaucacacccuucccaccccugaccuagggaauggugguuacuccuagcucugguggccagagaggccuuugcuucccagcuguagcagcuguguuaaugaggucuguagacuuugguacucucugaaggucaagacuguuucagcacuccucuccucugauauauucuaacccggagcagcuauacaaugcauuaagacucugguguccucagguaccccaggacuaguccacagccacacuuccucauccugagguacaagccccucaugauguguggagaauguuauuuaaaguuauuaauuugggguggguugggcuuuccuugcugcuauuuugcuccaugagaccuagggaagaauucccaccccauaucauuaacuggcuucagaacaguggugucuuccuuguguccuacuuaggguucccuuuguccuccaguucccgccaguaauuuuugagcugucucaguagcaaccacuugaaguuacauuuaguuuuuguuuuaaaucucauuacuuuucauuguuuagcaccuaaaugacuuugcugacauuacucaaaauugaaaaugcuuguuccuuaauucuaauuuaaauucaacaagccaaauuauucuauacauuagcagugguuacuugaaauuuuauguuuacagcuaguaguaaaucaauucuugauaaguaaaaaaaaaacccccgaccauaauaguaacacuuaaucuccccauuagcuugacuguuuuguaaauaaagcauauuuugaaugaaaaaacuaaaacacuuuuacguuuuuguacaguuuuuaaugauauaacuuacaccauuauauauuacgcuacuauauauauacacauauauauguauuuauguugaagaaacuaucacuguauaaucaagggggggauguuguauauucaguuaaagagaaaaaaacacggcucugucacuuagcaaucuuuuguuuugagacagucuuacguaauucaaguuggccuuaagcuaaccagccaaggauggccuugaacuucugaucuccugccucugccugcagagcuggcauuacaggcaggccuucgcugugcuugguuucacaugaugcugggaaucaaaugcaggguacugugcaugguagguaugcacagcaugguagcugcaucauuucuaccaaaugaacuacauucuucgcccccucauugcuuaaaucccauguuuguuagugagaguucuaaacuugaagaguauuaguuuaaauuugguucuuuaguauauauuuugcuaaagaaugaaaaauuuuguugcuuaggagggagaaaaaaaccaacaaagaguggcuaaugagcuggcucagugaguaaaggcacuugucaccaggccucaggaccugaauuuaaucccugggauccacccauauguagaagugauuguccucuuacuucuacauuguguccccacccccaauaaauguagaaaaaaagcuaaggacuauuuccauguauuaaaaaaaauaacuuaaaaauaacuuugcuugggguuggaaagauggcucagagggccaggguucaguuucuggcacccauuuggcaguucacggccaucuguaaugucucaggcaauccaaccuucuggccucuguggggcauugaguauacauggcgcccaaacuuacauguaggcagaacauucauacguauugugguggucugaguaguuauggucuuuauagacucauguguuucaauacuuagcccauagggaguggcacuauuaggagguguggcuuuguuggaggaauugugucccucuggggcaggcuuugaggucuucugugcucaagccagcaugccuaguguggcacacagccuggguuacagauguagcacuuuaagcuccuucugcaccauguuugccuggacgcugccaugcuucccacaaugaugauaaugaacuagucccaguuaaguguuuuucuuuguaagaguugccuuggucauggugucucuucacagcaagaaaauccuagcuaaggcacauaaaauaaagauaacuauaaaaaucuaaaggguccuaugugauucaguuuuacaucccugagaaguaagcuguuuacaaauauuugggaacauggaacauagauccucaguuuuccuuucagugucaccacagccaacccuuggagacucuaaacucgcauaauuguugauguuuuuaaugcuguuaaauacuguuaugcuugccccuuaaacaagaccuuuucccucauuuauuuauucccuuuacaucccaacugcaggcccucaucccccaaccccauuuacuaccuccucuucagagauuuuuaaauugucuaauauugccuguggguaguauaauguauucugaaguacuuuguguuuuucuaguauuuggcacacuggcuuugcauuagguuuaacuuucuuuuuaauuuguaagaauaauguaggugccuacauuuaauaguuaaaaaugaaauaagacaacaugguuaaaguuguguuuccugacucugaacugaucuggcuaaauaaguagaaauugaguagggaauucacaaaucauagcucauauggaauacaauugagaauuuggcccuuucuguguuauaacuauccuuucugucagcugcuguaguuuuuguagccugccuacuuggaaaggagauaggaagaaugucuaucaguagaaaaaucaguagacugggaagagucuagauguagugguuuaagguuggcucauaucucaguugguuaaagacaguagaaguuauuuaugacucuugagguugaggcaagaggaucauguauuggaggccaacuaggcuauauauugaggccaugucucaauaaauaagugaaauaaaguaaggagguuugaauggccaugguacucauuaauuuacauucugggauauucauaugucguguccccccccccccauaccguucuuuguaucguguuugcauauucugagaggcuugugguguuugcauugaccauacagcaugaauucccaguuacauuuuaugccaauaguuaaauuaccuuugaugguuccaaacuugaaaaguacauuuugaggcaucccaguugacaccccugaaguaccauguggccuuucugacguuugccacugucaccuuuacuuguuguacauaucauucuugccuuacuagaauguagugucaagaguaccaugacaugcccacaugacuuuuauagucacggccugcucugcugucucaacuguguguacaaaacaugucugcuagucgaaggccguugaggcuguccauagcucagcugcugugagaagugcugcggugaagcucaugugcgaguggcugggacggagcgcagaugacgcccagcaguguagcagcaguuggguguggagggcugaccuuuagauuuggaggaaccuguccugaagggucugcgguuuaaacucugcuuugauauucugaguagccaguaggcaacgguauugucagccgugaagcucggccucugaacuguuuucucccuucauuuacuccuuucugcagugggaaaaacagguuuagaccccugucacuuuaaugcagauaucuuuacaucuaaacuucauggaguuaauuuuuuguuuuacuucuaauaaacuugugaugguuaaguauuuucuaauccggauuuugcuagcagcaguugcuucuuuccuguuacaacauuguucuccgugaugugccuuuguucaggucacagagagagcuaggagugaccacaaaaugucugaaagccacacauuucaggcaggacaguuacuuuugagaccgccuaaaccagaauacaacugggaguaaacaaccauuucucuuucagaguagaccauuauaaguacaguccuguucgaaggauugaggauuuaaguuccuuuugaggggaacagucaggcuuucaauacuuugccucuaccacuuauuaaaaauugcugaaucaaaguuuucauuauguaacugucauauccugcuaaguaaaaauguuuucaccuccauuuaaagcaggaucugguguucagucccaaguaugaauaacaggcagcgcuuuucauggucgcuauuucuuugcacaugaucacucagcaauuaagccaccuuucuuugauucuugagucugcuuuaugauugagaugccuuauaaacuaauuggaaauuuccaggaugaaccaaugugaaauuuccuucuggaauuaaaaacaaaguuucugcaaaagcugaucauuuugauugcauagucaggguucugaggaggaauuuacauauauacaggggauuuaguagagugccugacagacuuugguccgacuaguccaacaguggcugucucucuauagaaggucccaagagucauccaguucgugaggcugagugucucaacagaagaugcaugaacuugccagugagacuuguacuugcucuccuugagcaaacccuuccuuuccauguccuuccagugggcugcuacaagaagguuggcccagguggguguucugagccuaccucaaaggauccaguuaaccaagagucccucccaggcgagcccagccucuugcuuuugaagugaauuccagauguauucaaguugacugccaauaauagccuucaggaagauaaaguaacaguaacuugauguuguguugcuauuuuauucuuuaacuuuugagucacuuuagacucaaaauaacauugcuacauucaggaaguaagugauacacagcagccccuccccaccaggauacaccggacuugugcuuagacuccuaguggaugccugaaaccuucgguauuguugcguccuuucucaguacuuuccuguacauauguaugccuagaggagacuguaucuaaguaauuggcacugcagucaaaucugugcguggugucccagaugagcaguagcaucuagcuguaagaacuacucugcuguagcagaagugacuguaagcagcucuaggcuuuccucuccuggacgugcagcagcaugacugcccugggcuacuuuccucuuccuuggaguuucagcgacagacuuguccucccagggaugggaacucaguuuuuuuaaguugagaacuuuugucuucgccuuuaaagaaagcaugcuaugcuaagcugcuuuuugacauguuugaaucacaaacauguaucauuugaccagcaaccagcaucauugugcuuacucuuugagacuauuuauuccuaaguaaaauaggagaucagcccugugaugugcuagcugagaugacugcugagugacuggggguaggcagcacaugcaagugagugcacuggacagagugcuggcugguucaccucguggguggauggagcaggguacucagacuggugcauggugugagccuuacauuucauauuuuagacuaugauuggcugaagacaacugaaaccauggagaccugcagcuggugggaggaugaccgcagaaggucugcagaucuuucugugucuucccaaguauggcuuguuuuaauacugcaagugugaaauugccccagaucuaaggggagaggugugaaugcuaaccuucagacagcuauccauuguagcaaagccauggucuugauggcuuaugcaucacagaaagaauggcuuuauaaacaauaugacucaguacuuaguaauaugaagaucaccuuccaaauuucaaaagaguguaugggcuucaguguagaacuugagaauuacuaguaguggcucaaagccacuacuggauguuuuaaagugcucgcguauggguggggucagaggguauccagaguugcuugucaggagugugcuugagcgcgugagagugcuugugcuuuuggauuccagagaggccccauugaguguuuuccucagucacucuccacugcacguuuugaggcagagccucucacugagccuuuuccucaguuacucuccacugcacguuuugaggcagagccucucacugagcccgggauacucugauuuggcuagacuauggccagcuagucccagggaucuuucuguuccacuucccuagcucugugugacagauggaugcugaggaucagaaccuggcucuucaugcuuauguaacaagcauuucaccagcagagccaccauuucagcccuaaaacucuuauguaagauguaaguuucccucaucuaaauaaaaugcgugagaccuaagugcuuuggcguucagacccaccccaccugaggaguuggaauauuugcauauauauagcaugagauguuuugagguuggaauccaggccucaaugcgagauuuauuuguguuucacauauaccaugguaagcauacagucuaccaaaugagcuacauucuuagcccucucauugguuaaaucccauguauguuaaugagaguucuaaaauggaagaguauuaguuuaaauuugguugcuuaguguauauuucgcuaaagaaugaaaauuuuuauugcuuagggaaaaaaaaaacaagcaguggccaaugagcuggcucaguggguaaagacacaugucaccaggccucaggaccugaauuuaaucccugggaucaacauguagaagugauuguccucuuacuucuacauuguguccccacccccaguaaauguagaaaaaagugauucaguauacacuuaaguguuccccuaucauggugucagagguggcuauguaggugcucagaggauucacuuuccucaccuugaauuucagguuuuugacuaaagaugccuaaccuguucacuguuuaaauaucagauggguaguagcacucccguggucucuggggcucugcucuuacacagcagugguuuaguuggcauuagacacuucccaaaugccauauccauauuuuaucuacugcccacucacuuauaggagggucugaaucuuaaggagucucuguaguuuuuaugaaauaccuuuguuacaugaauuucagugauuggguuuuuaguucuagaaauuugauggaggaucauaauacaggauagaguucuuuuuuguagcauggcugcaagagcuggcguugcacgcauuacugugucuguuaaacuucuggaaacaagccagugugucuauggugaguuucauaugugagcacugagccacuaaaagccuugcacaggguuacaacucuucugagagaggacguguuggagauucagcagcgaagcagcagcagcagcagcagcagcaacaagcagucacagugguaguaaaggcagggcagcuucagcuagcacagcucacagagcgaggcagggaacacgcacacagcucccauacugcuuccuugggaggcaaagcaggaccguccggggcaagcuucuaguuucaugguuaugaugucaagucaugugauaauacuguaccauaaguugccaacuuugcuuuacucuagagaagauccuuugcugcagugcuuuuguuccccuuuuucuuucauuuuucuuuucuugaaagagaaaaaauugugcaauguauguuuaugccuacaccaugccgaggcgacacuuagcaguaaauaaucucuguauccccgagguaagauacuguuugugcuuucccugcacagugcugcugcagcacggagccgauccaaacauccggaacaccgaugggaaaucagcucuggaccuggcagauccuucagcaaaagcuguccucacagguaaggagccagcgcuaggaggcugauuuuauaagauuuucaugcacugaauauuuuuccacuaaugaagcuaagaaaauacuaaaaaucuuauugauuggaugugcaucuuauuaauuguguugagauauauaccuauauauguauauaucauauagauugauauaucuuaauuuuacugcuuauagcacugagaauuacagcauuacaucauaguguuucucauauuuugucaguuuuauggcuuacaucacaguuuuccucuaccuccucuucucggcugguuuuuuaaagcccuucacuguugagcagacaagggcauuuguguuacuguaaaaguaguuuucauugggaagacaaccugcugccuuaucccuggggucaacagcuacacuugggugcucuccucacccacuuuuauauauuucauuauaucuuuguacuuuuuacccugauagccaaguuuuuuagauugggguaauauauugucuuucuacuucuguaaugcagauuuggggcuuauuaauuuuauaaaaguaaaugccaagaaccaucacagaggagacccugaggguagagagcacccuucgucauggucggcaagauuauguuuaacggcuagauuuugagcugcuguucucauugaucuucguucucagugcugcauuggcucuguuugguuuuguucucagcauaccgguccugcugccuuugcccuccuuuacucugugauguggagccuccuagucacugcacugcuaacagugcuguuauagauuguguagaagagagcuuuaacuguguuuaaguuaucaaucugcugugcacucuuaauagagauugugaagugaauagaaggcauuuauguacagaaagcuuuaaaaauauauggaauuuugcuuaauuacucuacguggaacgacaacuucccacugugcuaaaauuaauauaaucacugcuaaaucagaguaaucugauauuucucaauuaauuaaagaugaaaugaguugcuacaugaggagagcauauaccagaggaauaaagcuuuuuaaaucaguggagauaaaguuacugcacaguuuuaaaugaugaaaucgggccuaccugauuugucucugaccugccugguccugaaaccuucagucucuuauuaaacagucaugugcaacagaauagcagccuuccguggucucuggccggaggagaaagacaguauagaaacagcuccucucauagcugcuauaguaugugccaagggcuaagcaagacuguauuucugaguguccucccccugaccuuuccucuucuccggcucucugccugccugucuauuuguuaggugcauuuaaugcgucauugccuguaggacuguuugaaagacauagguuuagauauaagccacuaaccguaagaagcugucuccuaauuuucacugcaggucagagaagaucauuuuaggguacagcuuuggcaugcuugcuugaagaggcuggaguaugguggaggacagauagcauauuugauuugaacacugucuagcauugcacucugcuuagauggaaagauucuaguuuucuguauuuugcuacuaauauuuaacugcugcuugcacuguuuuuucuaaaaauauuuuugaggcaacuuuucuuucaguugugguuuaaggaaaaaaguuuagaauaauaguucccuuggaaauauaaacuguccuccuacugcacauucauucuaugacauacauuaagcaaacacucaggugagcuguuucagagugguuuucugcccguaugugcuuguuacugaggaauucuuucugaugcaguuacgauggaaauauuauuucucaaacuacauuuuagaaaauuaagcauugguuuuacaaagggaagaaggcucagcgcgacccacucuugucuaguaaaugcaaagcucacguucaguccuccucacacuguccugaaggggagggaggcucuugaaggggcgucuuagagguguuaggcucacuccaagucucauucuuacuccagaggaguugcagugcuauuauauaacuugagagugauuuucuuucuuuaauuucucuguggauauuuaggugcugaagaucugauagucuaucauuuauguuacaaauuugcuacaugagccaaacgaugcgcagguauaccuuaaagcaaaugaacaaagaguaaaucucuuuuuauagaacauuaacggugugugugugauugauuuuuuuuuuuaaaauauaaagacugcuguaaaaagcacacagacugucaguaggacaguugaccaucaccacauagccuuugcuuuguauagucccauuagacaucugaaagagaaggcuaauuggaaagacugguucaaauauuugcugaacuauuugagugaaugauaaaguuuauagaagucuaaaagauuuuagcuuuuguuaauuaccuguguucuagguaaucagguggggggcuugggaacaguuuguguguuuucuguguugguuuuuagaacaagaauauaaaaugucaaaguauauguaaauauuauugaacaagauauuuguuguguuauaauuuuggauuuuuaaaaguaacaguuuggacuuuuucuguuuauaaaaaauauguucggaaauagagggagauaagaaaaacacaaaaaagaaagaucauaauuuacccuuagagauggcauugauauacuuuguauagccuuaccuuuucuaccauaauauagcaauauauguuacguaguacugaacgaaauauguacauaggcauuuguuuguguuuugcuaaugauugacauucauacauaauaugcaauauuugauuuaauaguguagauauaugcuucuguggccugggcuuugugcauuauauacaagcacucuauagacccuauuuuuagccuuuauucaucuuugugacucugagaucaucaguuucaccaaaauugugcuucuuuaccguauuugggcuuagcacauagaaauggauguuucuguccuugacuuggauguauuuaaagcuuuguuuguauugcaugagguauaauuaugggaacgccuaaauguguuaaaaaggcauuauuagccaggcaguuguggugcacaccuuuaaucuuagcacucaggaggcagagacaaggcagauuuuugugaguucgagacuagcuacagaguaaguuucaagacagccagggccacacaaacccugucuggaaaaaucauaaaaggaaaagacauuguuucuuaguaggacuaaggaggauuucucccccccccccccauauaaaguaaaaucccuggggcaucauggauaggauagagggugucaaugggcugaaucaggcuaggugaaaacuggcuaagacugagaguuuuagggaaggauagauggcccaagaaaugcugaucuuuggcaagaucaaugauaauuagaauaugaacuauguguguuucuauggucagaaaguuggccuggaaauuggcucuaguaccuuccuacuugauauugagaaacaaaaguaaggaaaaaggauauuuuacacaaaggagcugaaaaacuaaauaaccuuacucacucuuauaaccucagcacuugguagacugaggcaggauacucacugcaaguuggaggucagccgagcuacuuagagaguuccagguuucucuguauuauggaguaaauacucugucuuaaaaaaaucaaaauaacaaagccaaaaccaguaagaaacuuuaacccuagcucauguacuuguaaagaaauccucaucucuggcugcugggcagccucccucuuugggcugcagagugaucagcgauggcucaccaucucagcccgugcugaggaguguggcgagugccuguagaugcuggcuugguaacuaggcaguggaugucuggaguuccacuccacugcuuuccacugcuucgguaagcaguaaggaucugggcucugccugcuuagcuuugagcacuagggguucacucaaggaaagguuucucauucuuuucauaacuuuucauucaccuucuugguauuaggucuacaugcuguucuuucagauuguuguaccuccugguuuugacaaccucaugucuuagccuugggacacaaaucuucauccucuuucuuccuugacaacagucaugaugggccucugaaucucaguucucgucagugcagccagaguaggcuuuauagagcauaaaccagcagccuguucuuuaacacauucccauuacgccuggauaaaauccaaauucuucagcuauggccugucaugaucuugcuuauauuuugcauauuuuagucuuuuauucucugcuccacauuuucacaguuggauguuuguuguuucucacacacacaagcucuuuucuuugaaguaaacaugguucuagaacuuuguuaguuagaugucuauucagauguuucaccaucuuguucccuguuccuuuaacuaaucuugguaucuucaugaauuugucaauaccuaacaucauguuuucugaccuuuauuugcuuguacuaauacaaugaaagauugaacgaaggacuuaacaguuauugagugauuagauuaaaaauguauguucaggauauaacuuuugguaacugagaagauaaucauuaauugacauaucauaaucuuaauuuuuuaaagaguacauguauggaugcuuugccugcaugcgugucuuuguaccauauguguaccugugguguggauggugcuagaguuuauuaauauuuuacuguuguaagcuuccuagcucuuuccuugaaagacugauguugauauugcugcagaucuggguauauauggagccgauagugcaaggagaccccuguucucucuugguguaagugaguucugugaguaugauaacagaccaugagguagcuaaauguauccuagauguguuuguccugauugauuuuucucucuaguuuaauugguuaauaagagugguaguaaaauuuuaacuaaaauuguaaauuuguagcuccuuuaaguucuguccguguuugcuucaaauguacuacauuuuuguugucuggugcaugcauauuuaagauagcaugcuucauggugaacuggucuguuuucauuaugucagggcugucucugaucauuuuccuuacucugaauucuacuuaacugauacuuagucucucaugcuuuguaaaaacacacuuguaagacauuuaucuaccuacuuacucuuaaccugccaauauuauucauuacauuagaauuaauuucuuucacgcaaaauuaauuguucaauauucucuuuuucuaccagguucuguuauuugaauugguguauguagauuucuccaaggccugugauagauuucugacuccuagaacuuuaguguaauuguguuaugguaauuuguuaugguagcaauaagaaaccguagaauauugauugucccuuuuacuucauuuguagugaucuuccuguagcagaugccuuucuauugacacuaugugagaauguaucuuaauuuuccuuugcucuggcgaaagaacugcaagaugucgaggcacugccugcugagcugaggguagguucaucccugcucagccacccaaggcagggugagugggcaucugucuccuccagaugcuguugaccauuuuguggcuggauaguaauuguuucucacuacauuucucuaugugaccgccacugauaucaugguguugggguggcagucccucugcugucggugauucuguacaggaccuccgcugaccucacaccaaugagaagauguuacuguuacuggguggggguggggcucuguaguuguccuuagugugaucccaggagacauuaguggcagacagaaaaauuuaggcuccaggcuuucuaauuaaaggcuagggagaugcacuggaugucacuggcuuuuaguugguguagguaggauaggcuacauauuuggaggguauuuagauauggguaguauuucacuggagaaggcuguuuuuguacaaguugccugucuugauagguucugcuuacuuucucagagaaacccaggguccguuuuaacuauggcgguugauauuuccaaguugccagcccuuuuaguuccuaagguuuaggagauacagaguuaagaagagcuugggaacugaaugcugugccauucuuuauaccaaagccccuaguuggcugaacuucuguccaccucuuaagggucucuuguuuuucuucgaugcauuacauguaaguuuucuagguauacuuacugauaguaauagggaaaauaauguuuacucuauuucccaaagauccuaaaauacuuuaaucuauguauaugaauguuuuguuugcauguauaggugcacaccagaagagggaaucaguucuaaacaguuguaagcuaccaugugggugcugggaauugaacccuggaugucuggaagacauccaguguuuuuguuuguuugguugguuuugguuuuuucaagacaggauuucucuguguagcccuggcuguucuggaacucacucuguagaccaggcuggccucgaacucagagauccgccugccucugccuccugagugcugggauuaaaggcuugugccaccaugccuggccaggcaguguucuuaaccacagacccagcucucuaguccuauaauuuuguuuaaaaaaaaaaucagaacauuugguuuaggaaccaggauggcuuagugguuaggagcacuugcugcucuucccaaagaccuagguuuagguuuuagcacccacgaguauaugagaguucauagccagcuaagaggccaguucuagaguaucugauacucacuucuaguuuuuuacaggcacuuguacaaacauacacacagccagaauucuacagacacuauaaaaauuacuuuugaaucaccuuugacauaguucauauauuugcaucauuuugaaucucaacauguguuuuuugagaguugaggguuuuuuuguuuuuuuuauuuuuugcuuuguguuuuuguuuuuuccaaggcaggguuugucuguguaacaguccuggcuguccuguccuagaacucauuuuguagaccuggcuugccuugaacucacagagaucugccugccucuaccuccugagugcugggauuaaagagaauugagaauuuuuuacaauguauuguaaucauauuuaucuuaauuccuccccagaucuacccaccccuucauacucaccuaaagauuuauucuagaugccaugagcaugccagugcccaggaggaggccaggggaggauggcagaccccuugcauuggugguacaugugauuguagguaccuaacauaggugcugggaaugaaaccugggucuucuaggaaguuugugcucuuaauagcuaagcuaccucucuagucugaaaguauuugaaccagucauuucuacuugcuacucuugauacuaugaggaucuaugagaaugaauagcaugaauuuuugugauaucccugauuuucuaaaucuuccccaauugggauccaaaauauauaggcaauuauaaaauacaaugagauaauacuggaucacugguauuaugauauugacaaacagguaauauagagaauuguugaauauuuuagcuuuuaaaguggaauaaaaguaaaauuaugauuuugcuauuuacucuuucauuuacuaauugugaccaaaaauaaaaauugucaauagccuaacacuuuuaucagucaauaaugggguugagagcacaaucccauagucuucccuuuugucaucuucucccuaugcuguuuauuaauucuauuuauucuuuaaaauuaaggcagaggcaggcggauuucugaguucaaggccagccuggucuacaaagugaguuccaggucagccaggauuacacagagaaacccugucuugaaaaaaaaaaaaacaaaaaaccaaaaaaaaccccccaaaauuagaauagugccuuaguuaggguuuuacugcugugaacagacaccgugaccaaggcaagucuuauaaaaagcaacauuuaauuggggcuggcuuacagguucagagguucaguccauuaccuucaaggugggagcguggcaguauccaggaaggcauggugcaggaggagcugugaguucugugucuucauccaaaggcugcuaguggaagacugacuuccagguaacuggggugagagucuuaagcccacacccacagugacacaccuauuccaaccaggccacaccuccagauggugccacucccuaguccaagaauauacaaaccaucacaaauagcucaacagcuaauauauauuuuuaauuuugaauaacuaaauuuccaagaccuuaaagaguuacugaauauacagcaugaaaauuuuaucguuaaaaaagauucugaugucacugaauaguaaaaugaugggaaagaguacuuagguuugaggcgguacuguuaauuauauaguaagauaauugaauucuuuaauuaaaguaaguagcuugcuguuggagaguuuacuaguggaccuuuacacaauaccaucuuuccugcucuguuucagccuugcuguacacaaugccaguguugcuguauaaucuuauccuaaggcuguacaaucugggggacuauaugauguaaaauguuacguuauccugaaaaccaaaaccguuuucagaucucuacuucugugucuaauauauucaggcauaguuguucuaaaaccuguguaauaaugucucccagcaugcucuagguaccagugaagagaaugcuagcugcuaauagaaggcuaacucaguuacccucauuugcuuagcaagccauugcaucaucagucccugacagucuuagacuaggagaguguauuacuggaaccccaggggacacaguagucuuaacuuaaaccuucugcuaaagagaucuuaucacugacaacacguuuauaucuaaaugagguagagguuaauuggcuagaggguaguuaauuauaaagggaaauuuguguaugcaugccacaguucauuacucuucucaucucccaccuguucccauagucagugauuucauuauugcccuauucgcaucccucauaguauuagagucuugagaagugaaauucucuuugcgcauuguuaugaucucaagccccaaugaaauaccuguaaaaucaaugauuagucaguagauggauaauuauugauagacuagaccagaccuauuauuauuuuuuaugggagagaaggcaugaccaagagcgugaagaggauuggucguaucugugugagucaggaaucagaaagagaugaauacuggcgggcagcccacuuccuccucuucuuccuccuuguuugauagaaccuggaccuaaacccauguacugguacugcccacauucuggaguacaccccugccagguaagucuccauggaaacacucuugccagcauccucagacaugugucucuuagaugauuccaaaucccaugagauugauaggccuacauagugagacccaccuuucucuaaugcaugcagccuuacuguaucauuugagucaguugcagauauguggugcuucauggcucaacacuuucagauauacucacuccuaagaacaaagacacaagccaaaauguagcaaucauaauugggaaaugaaguguuaguauaauacaguucaucuuucuacuguuuuagggaaaugggucuuggcuuaugacuuuuccaguaaugccugauaacugaauuucuuuaaauaguuuuugaacucugaaccuucucauaaacauuuaaaaaguggccuaucauuugcuguaucuuuaccuaguggcuaccucuuuuuuuuacagauucuacuguaacauuugccuugcucaccccacuugccccuuacccccccuccccccccguuuuaaaacuuucggcuguuuguuuaauguuacugcuaucucuaguccuuagauuugcugggaugcaguaacaguuauggacuguguaucacuucuaucaagugcuugaaaaauacgucaugaagcuguuuuaaaugacaggaaaaagacgcaguagcuagaacuuuaccucuucuuuuuaaaggagugccaacgaguacucuccugaaacagcuuuaauauacugggguucaggcuagguuuuauaacacuuuguuuuucagucacuaaauguauaagcaaugcguuaucuauuuguaauuauaaaauauugaagucuacauaaauggcuagugaucaguauuacauaauacucuauguaauacacagaguauuucauauauauaaaagaaguucucugugaacuauugaugggcuauucucaagguagacuuuuaagauguuaguaugaaaagguauuuauuauaugccauucuuucuguaagcaacaauauguaguaguuaacuccuguguuuuuguuuuggcaucuuuauguugucucuuagccccaccauguaccagaguuaugccaugucacugcuguguacuuuugucuuggacacugucuuccucagucucuuggauuauucuacucuagagacaagugcggugcuguauugugagcgaccugcagggcguccaguaagguggcacuggaguagcugcccagucagauaagcugaggccugccagccacaucccgugaaggccgaaguagauuuccagugucaguaaagucuugagaugccacugcagcuuguccuagggcuuggauacagcccugagaugcugagucacaaucauucagcuagccauucccagacgccuagucccacagacuguaugagauaaucuuuguucuuguagguaccaaccauugaggugaacuaauuguuuccgcagaaauagauuccuagugaaguauuuacuugaucauuuuaaacuuuuuccuuuuguaaaaugaaacacaggaauaauaaaccagaaaacauuaaaauugguaauauucaagaaaguugacauuucagaaaggaagccugggaagaguaggacaggaaaacaugagaaguauagcaaagugaugagagcccagagguauuuccuagagaggacugcuguggugucagcuuaaccagaaagucuguccugcuugcuaagaaagucgggguuaaagaggaaaucccagacccugaaugcagacaagucagauaaaucuuguguguaagcaggggugguacuugagaagacaccaagacaauugcugggugucuagggcguggacacugaaguguuaaagauaaacacauacuuguagaaaacagaaaacucacaggcagaguuguacaaaauugguggguguggcaggcaggaaucuccuguauucaguuuccaaauuuucugucuuugaaauuauuuccauuggaaaguguuuaagcauuacuggguaagagagagugguugugcuuagcugagggaucuaaacuacagugagugugcauccuggguucucagcuucccacucgagccuucuuaaacugcuauuuaaucucucucucucucucucucucucucucucucucucucucucucucucucgucucaagaauugauguuucuuuuaaaauaugaaugaaauuuaaacuucccuugucauuuuaggccagaacauuuuaugagcauuaucacaguuacuaauuuuuuauuuuuuaaucuuguuuugaagcuaauuacuggcauuuaguuccuugacuuugggagcaagugcuguuuguaugcuuuugccguaaguuuucuacaaggccgcaguagacucugcuccuaacugagugacagugucacagguguggcaacucccuccugaaggaugguuuacucugcucgaacacuaagcacacugacugguucuuaggaagcuuuguggugcccacaugugccaggcagugcuugcuugaggaauggaccaggcgcacuuagaauagcagcggcuuuagagucucuugauuuuauacauuugaucauaacccucugacagcuucagaauccugcacaucuuuuucuuuuuuuuuaacuguggacauugggagucucuggaauugacagccugacaggcauuggagaggaguacaggagaugauaugcuuucauucccuuugcgagaacguaggaaguguguaauuaucugaagugacugcaucuucuuauauaugaaaaugucucuuaaaggaaguagugcuuauaagccuaauuggauaggaaaucagccccagaugagaggagcuuauacaguggaaagccugucuguccaugccucuguggcucugagggccucacccccuccugucuaagcacauugcucuuauuccuggugagaagggguauucuggcuaccaguucuuaggucugucuucuuucccuugagacuucugucuuucuuuuuuuccuugugagaacaauuuuaucgcccuuuacaauucuaguuauauguacuuggcuucaguguuuggaaaugggccccagguaacugaaaaggagcccuauuugccuauugaugucuagucuuuccauuguuguuuuucuauuacucuacuccccucuauugcacugagagggaaugauagauugcuucugacaggaacaaaaaugacuuguuuuuaagaaguuauuagaaugccaggggcaguaacaggcagauguaggugucuccagaagaccagugcagugcguuugugcacuuguuugcaaaauuagucuucuuuucauuuucaaaaccuaaucacuucuuaccuauaguuuuuacaaaagaaaagugaauaucccaaacagaaacaugaauggugaugauauggaagcaaagacgagcuagggaagaaguccaaaugagaguggacgcgacacgcaauccucuugagugccgucaucucagauuugugugguccugcuugcuggucauaaggcuuuauagaaaauugucagauccucgaaggcauuaacagcucauuccuagucucauaggaaguccugggucccuuucuauucucuuguaguuguuuaaccauggcaccggugccaccgccacccucagguacugugucagggagucaaauaccaugcugacacaauaaugcuguaauuugaauuaacaagauuuggaaccaagaagccuccugaaagaggcaagggccauuagucucaauuuuuuucuugagaucuuuaugugauacuuuuuuagaaaaaaaaaccaaaacuguuaaagcuaaucuaugguuuaaacaaaagugaaaguaaagauauuuuugagcaaauugguucaaaaauaugaaguagaagaauuuaaguauauucaaaaauaaaaaguauauuaagauuuauaaggacaaugacauuguauauaaugaaaaauauaagaaaauuuuaagggauuuacaaaaugccuuaccaaaaaaaauggcuauacccacauagcgaaaaucagcauccagcauauagggaagagaacauucuaugcucuuguauauagcaucuuuuaaauuuuauuuuuauuauuauguuuggggggaugcccacgcacacaaauggaugcaaaugggccacagguaugucacgguacucuugcuggaauuagcagugauugacagcuaaacuggcuaucguaauagcggaggcaagcuaucaugccaaauuuuaagaaauuauguccaaccaauuggcagaaauaagcuuugagaaauaaguagcaucuuuuaaauuucauuuuuauuauuagauguuuauuaagcugguaugugguggugguggggugcccuugcacacuaauggauucaaauguacuauaaguaugccaaggugcucuugacauaggcaagcauuauucuucuccuuucagaccuaaacaauuucauguagcaucagcuucaaguugaggcauuugggggaaaaauuaucaaagacuaaaacaagaaaacaagauaacaacauugcugacacagaggcaagcagaguguguuuaguucacucuaacaucccucucccuuccucggccaguuuguguaugacagcugccuuugaccuacucaugggcgugucccuguuuuguaauugcagccaacuuagaacagaccucuuccucuuuagacucuuuccucagauccucagccagugcccaagugcucaagcugcugucucucacacccucuacuuggauaugggacugcuuacucacaggcaccgcgcgcgcgcacucucacugcaguagucagccugguuuguucaacuucugauacagccucagugcuauuugcuggugggacacuaagagguguuucucaggaugcacauucuuccuuuaguguugaauauuuuguugauuuuguuugugggguuugguagauagguacaaaacaccaguuuuucuucaauucagcaugcuagcacuggagugaguauuagauuggugcagguacaaggauggagagaccugucggugcuguccucuuaaggcguguuuucauguacuaacaaaagcaagucugcucuauucaucagccuccucccuuaguaccagauuauagcaaaagacaugugaguucuggacaguuuauuuuacauggcguguggacuucuacuuaccucaaaagaaagcuacauucuuggaauauauucacaagaacuguagugccuggugugugcccaacacaauagguguggcuuuaagauaccccgcccccuaccccccagaaugcuuuucuuucuuucuuuuucugcuaguuucuuaaaagagagaaacagauaaacuugguuuuguaacucaauuguaaugauuguagcacacgcacuaucccucucuucccuucugguugggacgguagguugugugcccgucccaaaggaacugaguucuguuaguuccaucaucugcccucggauagaccugucuccagaccugauggcuucucacuuuagucuccaucaguagaaacuauagacuuauacaaagcagagaaacacacugaggaugccaaggaaauaauugaauccugaguuuaaaauuuucacucuuucaaacaaaauuuuuacuuaaaucuauuaaagucaucaagaugauaaaacaugaggcugccaaggaucccaaaauagccugccugggguuuuauaccaauuacagagcucuuagguaggcagucuuugucaccauucuuagauaacucuaugcagaagccauuauacaaaugacugcgucuaucaauuggguuacauuuacucaaaugaauggauaauaucuauugcuaacagaaugagagauugggugagaaucauuuucagucucuggcuuagugcauucucuaaaauguauggcuguuuaaaauguaaauuuauuucaaauaguuuucuaucuuugucacauuagauuuccuauauauaucuaauucaaauuuugugucuaaauuuauuuggguuagagacauaugcuuugaaaggguacaagaugaaccagaauauugccccuuauaaauauaaucaaucacgaacuaucuggcuguauaauuugucacugucuaaaagauaaaaagccuaauaccuauauacuagacaugagauggguauagggaaggacuuucuccuaggacucuguucaagaauuaaggccaacaauugacaaggggaaagcuucuacacagcaaaaaacaacaacaaaccucuuuuaaauaguugaagaggaaggccauagaaugugagggagucuuugucagcuauauaugugacaggggcuuaauagccauaauauauaaguaaaaaaauaaagcaucaaaaaaccaaacaacccauuuaaaaaugaacagugaguucacaaaagaguaaaacugucuucaaauuauauaaaaaaaauguucaacauccuuagcaauuaggaaguacuaacuuugaaaugucaucuuacacuugucagaauggcaaagauauacaaaauuacauacaauaaaugcuggagaggaugugggggaaagggucccugcauucacuguugguauaacugaaaacugcugcagccacucuggaaaucaacacaacaccaaucuuugugaccuguguuuaccacuccucugcacauacccacaaggacuuaagauccugcuccauacuuagcuguguucauugcuucuccaaccacaguaacuaggaauggaaauaacccuaaauguccuucaacugaugaauggauaguggaaauacgguauguauacacuugcaagaccauucagcagcaaagaaaaaugaaaucaugaacuuugcagaaaaauggauggaauuagaaaaggucauguugagccaggcagugguggcagcacacaccuuuaaucccagcacucgagaggcagaagcagaugaguugcuguaaauucaaagccaguauguucugcugagcaaguuccaggacagccaaggcuacauggagaaacccugucuugaaaaccaaaacaaaaaaagaaagaggaggagaagggaaagagguggggguucguacugaaugaggaagcccagaccuagaaagacaauuccuucucccaagucugcaggccugaaucuauggccugaaguaacugcauaagucagaaaagggacaguugggugugguagacguggggagcacaggaaggagggcaguugagaggagauuuauaggauacaugugaccgaauggggaaaugggagaaaugugcuguguuaauuaggaagugaagggagauaaauacagaaaaagagaguaaaauccuuaaggaaucauacuauuaacuguguaucuagaaguacccacaauacauguaaguguguauacauacauaucuuagaugagaaauucccuucugggcugguguaguguuuuacccaagagccauagacuaccugacuucugauaccccagcaacaguuauaagaagacuucuuuugaguccuuggucagggucgucuaagagacuuccaaaacauuauaggcuacugcuguugcucuugguugucccucucuucccaggacgcaagguaagcccccauugcugaagacacuauacauauuacagaggacccgaacugaggacuagcuuucuugauaccaaaaggcaccaaauacuuggaauaauguguauaugugugugugugucugugugugugugugugugugugugugugugugugugugugugugugugugcaugaaauuuguguccuguucuuaacugcacucccuauuacccuuuccugguccccccaccucagucuugcuuuaaaaaguaucaucucagcugagcauggugguacgugccuucaguagugaggcugaaauagggucacaagguugagguuggccuaaaaauugaggcugucucaaaaaaccaaaaacuacaaaggucacagcaauaaaauauaaauaaaauguuaaggaguaucucugugggaggacagacugcauugcagcagucagggaagggggggccaacaggacaggacuaggacaaagaauagcaacuucauugacgucuaggacagacagaaggcucaguggcacagucuguguggcuuaauguuaacgugugcuuguaaugcugugaccacgguuccguuuuaauauguacauuuacucuccagcagugaguguggucugcugucacuuucuuugacaggcacuucuguuugaauuaacuuguaaagaaaaaaauuaauagccaucaauaaacuaaucagauaugugacauaugagacccauauucauuuucuguuuucuggaaaaugcugccuaaauauaacugacuuguaaaauggagagacuuuguuuuuagaagauuacaauuacauauucacuaauaggcuaaaaguaaauuauccagaagaaauaagugcugauauuuaaauuauaauaauucaaaauaccaaauaaggaaaacagagacagggcagucaguuacuuuuuuuggggggguugguuuugggauuuuuguuuugcaguuuuuuguuuuggcguaggacccuguuucuuauguagucuucacuguucaggaauggcaaugcuguaccuuccccagcuuccuugugaugggauuaaagcugcauaccaccauccccguccaugguuuguugugaguaaaaugugguagcugaauagaaguugaauggcugcauucagcuagcucaugcuuauaguagaaauacaaaguggggguuguugaaagcuccaggcuagccugggcucuguagugagaccucucaaaaaugcaaagcaaacaaaacaaaacaaaacaaaacaaaaaucccaguugaugauugacacagggucuuuuauuuuaguauaaggauaguaaauaguauagagagugaugaucacuugcaugcugggugugcaugugucuuacuggacgccauuauuaaacacccggagguauagccuuuaguuaucuguguuacccuuguuuguugcuugugaaguugaacagguaccagaggcugggcaguuucuaaagaaagggaacaagugagcucaaaaaugaaugauuagcauucauuuuugccaaaacuugauacuucggacuauauauauuuacuuuggacugagcccaucuccuaaagagucccacugucucucagcguugccauacuagggaccaaacuugaaccaugugaaccuguagaagacccucccuggcaccaucaguuauuuuacaugcugucucaaagcacaguguaucucacaagaguuuugagaguaguuuggggagguuuccuacagggucuagucuaggcuuuaccuguguuucagaagggauaggcccuccaggcauacagcacaugggggcgggggugggagggucacaaguucaagauguaccuggguccuugaguaagauucuuuuucgggaaagaaagaaacaggcuaauauaagugcagagauauuacaagacucaggcugacucuaggaaugaagccagacugacagugucauccuuuagaaagcaaggauuguggucacuuuucuagcuguuuaaugacuguacauaggaagcauuguucucuguguucucaucccaucauuuuggagacagucauuaccaagagggaagauguccauuuccucaauuuuaaaauuaaauuccuauauauuauaaauaaauauuaaauauaaagauaaaaugguaauacuagguucauguuacuuuaaaauuuguuucaagccccagacuuuaacaugccgacuaaugugcauagugaacuuuaaucagguuuuauagacuguugcauaucaggguugguuccuuuugguauagagaaggagagagacugacuuccaucauucuuacuguuaccuccuuugaaagcuuucacuauuuugggggucauuguuuaagacuagucagucuuucucuuuugauuuacuaauagguuuaucaguuuuucuacuuuucuucugcugugauuacaacuuucugggaauacagccucccaaaagaggacaguaauauaaaaugccacccucuuuucacuggaggaaaaaaaaaaggcaaagcaaaacaaaaacucauguuauuauagagaaggauaauggggaguggggaauguguuuucucauauucuguaaguguucuuuuaauugaaaaacuuucaagggguuuaaugagagaagaugaacacugcccuugguuacacagagcaaauaagacccaguuauugguguaaaaagccgggugcuuuaaauugugaaucacguucuucauuguuacuaucuuggauauucucugugggucaagcaguauuggguguuuuauuuguauuaucccugacccucagagcaaccccauaaaguaaguuuucuuuuuuaaaaauugagaaacauggauuuggaggaagguuaaaugacuuggucaaacucacauggccugaauuuguuugaaguguuucagcccuaacagggaagcucuuuguugaaauuccucaagugacuccaaagucuggcaggcccuguccugccccuggagacauguaugugguggaggguuucauucaguucuccacagucauggacacacaccaccacucucagcuuuaugauaaaaaggaaaguagaagcagaguuccagccugcuguaaugagacagguuaaaaagaauugaauagcacauuguauuuuaaguacccaucaaagaauccugauuuauccugacaccgcuuguugguuccgagaauguaggugugauuucagggaugcagagcauugcguuuagccucugucaguaagcaucuuuuccuugcucuuguagcguuuggcugucaguuccuggcauuuucacauucuguuccauaacaucguacugcugucuccuaucuagaaagauagacaucucccuaucaccacaguuuuucuaaguuaagaaacugaagaaucggccaggcagugguggcgcaugucuuuaaucccagcacuugggaaacagaggcaggcccagauuucugaguucgaggacagccuggucuacugagugaguuccaggacagccagggcuacacagagaaacccugucucaaaaaaccaaaaaaaggaaaagaaacugaagaaccuaucaguuacuucuccagagcugaaccacuagaaaagauuugcauuuuuauauauucaaaauuaaaugcauuugauaacaccaagagaagaguaaauauuuugaaauaacaauauauauagccuucuagaagugcuuggccacucguuucaugaacccacagcuuaccuuaccaugauacuguaguggaaguuccuaguauguggccuuggacuaucguggaaaauauagcaucauuuuuucagauaaucccuauugaugcauagauguauaugauacaguucaaaaacggauucugucaaggacaggcgacuuggaaugcuaacguaacaguucacuaaaaauuccaccauccagcugcuguaguccuugaauguuccaagaguuaguauuuaugguacuagccuuuuagcaaggccgguggguaguauuacauaaacacggugaaugcacucaugagagaaaaguacauccaucaaagaauuagacauaucaagauacucaacacugucucguaauguuugcauuauuuuaugugagguauuuuacaaugcuuauuucaaaaaaguguuuuuuugagucaaccuguaggcaaaauugaucucuuucuauaagaagcuguuugaugugcagaaccugcugucucagagcugugagacuguacggaacacacacauugugauuuauaggaaccauauuguuaucuuugaaaggaagauugcuucccugcaguccugccuuuuaucgggaugcuuugcccuuugaacgcaccagccugcaguagcucuagcauuuucugacgcgccuauuugggaacugucagacccuugcuucuugugacaaguuuaacccuaaagaauuacaaacuaauguggaaguccaugggacuaguuuucuaagaacugucuuugacaucauugagcaaugggguagacuaaauuaaaaaugaauguggugggugugauuuagaaauuaaacacauuaaggauuaguuauagaacuauuguaaaaaguuaguaauaacagugagaauggaaaaaaauucaagcagagaggaaaugauaaauguauaaugugcuggcagaacuuguaauuugauguguugguuuaauuucuuagguuuuaaaagaugugggaugaccacuucuuacaaaguuaaauacauauuuaaaaugcgacauggcaaucagcauuacuagauguuugcccaagagaaaugaaaucguauguccauuugaaaugguuucuauagauguuuauaguagcuucauuuauaacugccaaagacuagaacuugggaaaggauaaucaaauuaaauaugucuuauguuaugggguaaugcuuaacaauuaaaaaaccuacucuguuuagugacaaggacagauuucaaaagcauuuacacaagguaaagaaaaaaccuagacucaaaaguuuauguguucaguaauuccauuuagaugacauugugugacuuagaaguguaaggacauugugacaucugggucggagucaguccucagacacgugugcaagucauuggguucaauccccagcaaugggggaauaaaaagaagacaugucaaguaaacagaaacuuagggacagaaauuaaacaguauuggcaugaaaugaggcuuuacaaaggccuggaaaauauuagggugcacuaaaaauauuguguguuaguagugucuaacgaugauucacgugcuuaaggacauucgcugcucuugcaaaggaccgcaguuagauucccagcacccgugcuggagacugauagcugccuguaacucuagcaccagaaacaucucaaccccccuuccuggcuuccaccagcacauucuuacacaugugugagcacucguguguguacacacauacacaaaaacacacacaguaaaaauuuuuaauauuuugcaaaugcaaauauacuagucaugauaguauacacuuuuaaaucucagcauucaggagacagaaacaaguuggaucacuguggccuacauagugagguguccucccucugggaaaaaaauacgaauguaacuguaaaauauacaugaguacauaguauggaaagacucuugugucauauuacagaacaucccugguaguguaaacauauccccuauagcaguuauuguucuuagugaaacuuggcaguuauguguacccauuucagucuuggaguuaagggaguucauugguagguaggucuuagaaaaaauaucuacauauacagcaugauggcacaggccuuuaaucccagcauccgggaagcaagaggcaaguggaucuuguuacuguagacuaccugcucuauuaagggaguuccaggucagccagggcuuugcagugagacucuguucccaagaaacaaaaacacccccaccaaaaaggcacuguguccccaccugcuggggugcaccuguaaauccauuguugggagucaggcuggggaucaucagcacaaauucaaguccagccugugucaacauacugagcuccagggaggcaaagggaagaacgaaaggagaauggaaagaaagaacaaaagaccaucaucagaauagcguaaacuauugccaagaggaucaacuaugcaguucacuuuucuaaacuacuuccuuuuuuucagagcaaacaugauacuuggauuuuuuuauuuaauugcagagugcuucacuugccauuggaucaguauuggaugacuuguaaauaguggccauucugagcucuaaggucacagaccuuuguagguuuuuccuuguuuuggaaauagucauagaagauuuuagaaugaaaacaguaggcuaauugcccccccccccagacccuuguuucuauguaauagaguagcuuuggaagauuggugugcaggaggaucuagcuuuagugguuugagaguagauuguuuccuggucauguggcuaaguucuuucuacaaccagguaacuaguucagagacuucaaaccaaaacacaaugaaauacaucaccuaaacuaauaucuucuucccccaaauaggcuguggguuuggcugagagaaucgauuucuuguguaugaugguaccucaaugcaaagcuuucuguauugucuuaucauaaguucagggcacucuucagcacucuccaggaauaucaauagucaguucuagucaguucgugguacugcuguacgcuuagcaaugggaaguccccgcauuaacuugguaguggagguucuugacugaggucuguacaaagcucuuccuugagacaccuuauaaguccaggaacuaaagcaagcuauggaggugugaaacacaucggucacuugaauagacccagaacuuccuuuauuccucuucccgugcccagguguccauguuuauaugcucggugcuucagaguaguucugauaggaaaauuuugguucauuauaucauuuaaagcuacuaauucuuugcuuuauaaaauguucuuauacuucacaauuuaguuucuuucuucuagcguacauauaucuugucuuccuaggcucaaauuuagugauucuuagucuaggcauuagcuuaguuauggagccugauagaugaguaugaaacuagacacucaugugacugcuucaggaucaguuuauuaacuaaugaauaugacagccacugggcauggugguauaugucuguaauuccaggacuugggagacugagguccaggccagccuaagcugcguagcaaggagcaggcuaggcaggccagagagacgggugaaguggagacaggugacuuuucagugacauuucuuucaguucauguagaaugugagcugucacugcugggcacacacagugugcuguaaaaacagaggucagaguuucuuuucagucucucacuacuuuuaacaccugugacuuccauguucauaaacuucucacguuauuccaucucugaaaaacaaaauggcucaguuuuacaaaauggucugcuuugauccugcgaguuguuggauguaaagacccucacagugucaacacugggguaaaucaguaagcauggcuucuauauguagguuuccaagagaaaaguuucccugcagccuaagagaaagagaggcuauuucugacugcaucagagaaauaggaaggggagguugauuuuugaccugacaacauuuuaaaaacauuaauuuguguaucuuugugggcacccauccuuuugcauguaucaauauuugguauuaaugacuauucaaaaaaacccaaacauugucccuaccuguuuucacuccccuguguuauauaaugacacugggaugugaagccagcucuucucacuccagccugcucuuugucugcuucggcacaccucuuaucaccccucagugagagagagagagacagagagagagagagagagagagagagagagagagagagagagagagagagagagagagagaguguguguguguguguguuagaaaaggccaguguccauagagcaccaugcucucccugccaaagugaaacagaccuggugguguggcugcuguaagcagcucggcuuugcugucaguguacaaaggacucuaaauucauuauguaccaguuccugggaggcagagugugagaaauggcuucggcuguugacugauugugguccuugggcaccagauaguggaugcuggaauguauugcagaaaagcugauuaaagcccuggaucucuaacaggaagaguaacgucaucuguaaugcacacuuacaaguuucuugccuuauuaucagccuaugcagaaauaauauuuuugcaaaaaugugcauuuggcaaaauugcaugcugcgcaugauuaggaccuuuguccauaggcugauugggacuuugaggcgccugaguccuuugcuguuuuguaacuuagcuuauuggaauucuauuucaccaugacuuggacaucaggaguaggcacuuggaguucaaguguauguauacauaguacaggaugucagcugucagagccugcuaucucauccccaugcccugggugcugcagugaagcauaagugggaauaguuauguagucaguaagcuggaagaugcuuaaauacagugauuuugcaacccuccuuuaaaaaacauccaauguuuucucagcacguucaaacuuaguccuuucaugcagucugucucauuguccugcaggugucacugggcuguccagaaagagccagcacuucuugucuucccucaggccuuuccuucucucucucaguccuuaccugaaagcuucuuucuucuuuaaaacgucuuuaaaaacugcuuuagucucucucucccagaaaggcuuccuuagccccaguuagccuguuaguaaucccauuuagacuagccaauaagcacauaauaguauuucauaggauuuccucacaaucuacuguaaucauuugcuuacuucuuuuucugcuuuaauaggauaaucuuccuugaagucagaggugacaguguugucuuugaacauggcaugcauauacauauauauauguguauacacacacacacacacacacacacacacacacacacacacacaccuuuugaauacaugaguggcuuuauagauguauuccauaauuugcauuauuuagauuguaauuauucgggcuuuuuaaguuuuaauuuugacuuuauaaaaugacauuccuaguauguuuaauuuccauaccgcuguuagaaaauguuuaauaaagguaaguuuuuaacucuuaaccauuuuuugcccugaagauacaauuugauuuuugugcaguuauuuauuaaacaauugaacuacaauuuauaggaaauugaaaagacuaauuuugugauucugaaauuguucagauuacuauauggaauuggggguacauagaacugacuuuauuaguauaagauucccuuaauaacuucuacauuugaaaacaugugaugauagcuucuagauuuuagccuaguuccaauucaagacacaagcgauauaauauucauuaauaguagauuauaggaguuaagcagcugcuccuugguaucuuuguagaguuuguguugaaauagcucaauuuuacaucaaaauacaaagaaagauauaacugcaaaucuuaaaguuuuuuuaaaaguauuuuaaaguaauuuacaguaacuuuuauuugaucuaaagucuucuuuuucuaauauauaccugcuauuuuucacagaaggccauauuaagacaauuuguauaaucauuucuuuaaugauauuaccagcacaguuauugcauuaaagcaaucacaaucacaguccuggcuguuguuuuuguuuaucgaaggagcaaacacaguguuguuaucauuaaggcuccucauccuucauuugcgcuagcgaaagaaacuugggugcucuaaggaaucuguuaugggagacuucuaaguucuguucucacugauauguuuugaaaaauccauuguggaaaaaaagaagagaauaaaauuccccaugccguaacaauuaguuacuuguuuauuuccagagacccuacuuacuaagguuuacuguugguaaaggguaguacaccaagcagaaaggguaacagcgcaggcuagguuagguuaucgcugcccguuaagacuaugcucucggcuuugguuuuggagcacugccuccaagaggcgccuagcauuugguacguaguucacguauuucuagucuacagaccuucccuaucaaggcaaauagcauccgugguuucauauuuacugugugguuuuuuuuuuuccugcuauaaagcucaauggugguaauuaauuaaaaaaaacuuucuguggcauuacaaauaaaacagguuuuuuugaaggcuaguaauuuguaccguuaaagagccacguuauuuugcuuuugucucagaauguauuaugcuucacaaguauacugugacagccugaauacaaaccggggggaagggacauugucuugagcuggcgugccguuaucagagggaauguguuccuggacucgagguuuagcauucauuggcugucugaagaaagcuauuucaucugaggauuggacaagaagcugcgucaauuuacugcccgucuccaaggcacuggugaugcugccuucacuagcuggcuaacgucacggcuccaucacccagcgggguguggacucucuuuucuguucuucucuguuuaauucucuauuugcugccuacugcauuucuuaaucugucuucugccaaaugcuaacagcaugauauuuugcaaucaucuaggugaauacaaaaaagacgaacuccuagaagcugcuagguaagugauuccauucauuuuaaguaaguauaaugcauuuagggagaaacgggugugugugugggggggggcagguagaagaguguaaagauuuauaauguguucuuuucuugcuuggguuuuaagagauaguguggguaagaucuauuaagucuuuguguacuucauuuuacauuguuaguggacguaaugacagaauccuucacuauacugagcacuguaaagcuaauuuuauuuuguaacguaucuugagguacuaccugcaaaccuuucaaaagauauucuuauucuuggaguguuuauaugccuauaucuguauuuugcuuugacgauuuucuuuuccuagccacgcuugaaggagagacauaaaguaaaugcuaaaauucauucucagcuauuuuguuguuguuuguggugguaguaguaauggucauuuauaaucuaauugauuaccucuuuauagaauuuguauuuuuaaauucuaacauuuuagaucauuucuaagugaaguuuguaauuaaaaugacuauguagauacauuuuuaaauguggaaugcuacauuacucaugauaccauaccaccacauaauuaacaggaauuauguuaacugaaaugaauauuauagacaugcauugugauccacauuuaaacucuaaagcaaaagccuuguuguuuuccacuauaaaagaacuauaaauauuuauaagaagcucuauagcuuuacagaaauuaacuugcugccuuuuuauaggagugguaaugaagaaaaacuaauggcuuuacugacuccucuaaaugugaauugccaugcaagugauggacgaaagguaaguuauuuaaaaugccaccucuucuaguaauuucuucuugcuuuaccaugaaauuuugcuugguauggucuguguacauguguauacuuagauauuuguagcuguuuuuccuggcaucuuugcacuguagagugaacugcucuucccucuuccugguggcugugaagauucauggagcuagggaagccuggguccuaagugagcgcuccuccgcugucagacacucgaaggggcuuguuacaggaacugcauacacuuuucagugaagaaaauuagcagcaugcguucugugugccaugaugcaaauaugugucuguuaggacauacacauucuacauuuauuugguaaauuuuaucugcuagauaucagcacuuugucuauuaaagguaggaaacuguuaauguuuuuuuuuuuuagaucucuauaacaguucuccuuuuuucaaaaacuuaauuguggcauauuuguaagaaaauagauuaaaagagaaauagucugcaugaggauacacugucauaacuguaagggaauauauaaauugcgcagccucacugccugcucuguauuugugcugaauguagacugaaauguaauguguuuuagacugugguaauugacugcaaaguuuugcaaugacuuaccuagaauccugaaagaacucuagaacauccucuacugugcccagcuggcaaaucacugaguacucuuccucacucuggggaagugauuuuaaaggguagcugcucauuuuuccuggaguuuugaaguugccaaagggucuuuaacccccacgaguccuuugagcuccaaguuuuauuuggaucaucucagcaggguagaguuccuucucucacuaugugguaagcggcagucucaucuguagugaguacagcugugcauuguagaagugucuagagcccagcaucgucaaguucucuguaagcacuucaguaccgggaagcugaugggcagccacuguagcaggagauggaguuccaccuugcuucaccgcagcccucagccccguucuucucucccuuccuucuagcggaacucacguccuuaccuagauaacauggcucuguuucugcaucaaccacauggcuuuugccagagcuuuccuuccacugcauuuauguucauguguuugucuucuacuguucucugaggcuuuuguauuuggcacaggaucaagcaucuagagcguaguguggcucacugacaaacaugauucuauucccugagugagaaaaaccaucucugcuagucuuuuaccauuuggaaaaauaaaucuguaguguaugaaugagagauuguaucuuuucuguuauccuaacuuuguauucugagcucguuucucgauaguuauaaugugagaaagaacuguauuauuuucaugugggagaccucugugguaacauaccugagaaaccacacugagggauuucugcuaaaaugauauaaugauauucgaaauauacacuuaaauacuuacacauuaucaggcuuuuuuuuuuuucaaauuaaaucaagcaacaacagaaaauuaaagaggcgcuuauuagguuuauugcagugcauaaggaaucauucacagcugucaucugcaugcaaaacacaaauaaaauugcaugcauuaauguugguaauauuuaggacacggggugguccuuuuuaacaugcaccgauuguauaaagccacagcgguguucuuggugccgguggagacugguguucaagccucugguuaugacaguguuugcuuucuugguguagguaucaggaauacaugugagcuaauccaagcugaucaguugcaaguuucucaacuauuugauacauauuuuuuaggacuuucucauguguuuacuagaauuaagguaacugcuuuuacauuauaaaaaaauaaauguauguucgugugugcaggaaguuagugaaguauuuaacacuuuacuucuuggcuuuuauauuagaacaggucauacaaucaaauccuguuuauagaggcucuucaaaaaaaauugcuaaugcugaacucauuuuuguccuuagucuuacuacaguucuugguuuguaaauuucaaagacccaugaaaauguaaauucaugcauaguuuuauaaagaaauguuucuuauacggugacuaguggguagaaaauugcuuagagauguguagggugagauugguauucuuacuguugugugugggauuauauaugagcauaaguuuucauugguuuguauuuaucacugugacuugauggucuaguuagguaauguguaagugguuaauauuuugauuuccuacagaugucuguuuuuuuagaauccuaaaacucgggaugcuucaguaagacagccugcuuuaucuugauguauuuuugcuuuuauuuucaucaaaaggcaaaaaucaccacaaauuuaguuuaaaguuguaugaugguauauaccuguauuccagcaacuuggggagccugaggcaggaggaucaaaaauuugcagagccagccuggucuauguaaugaaaaccuauccuaaaaagaaagaaagaaaauuuuaaguauucugcugagcugagcugagcaaggaagauggcauuggggauggaaagagcaaggggaauaguaagagaacagcggcugacugcagcucagagcuccuccugccucugccucucugaugaugggggaaaggugugugccaccagacuucccacccccgacaaaaugagcuuccuugucaggcugugcugagcugcccuuucauguccauucuaucugucccaaguucagcauaagucagaaagcaacuucauuuccuuagaaaaggaagacaauuuuuaaaauaauauuuuauucuaaaaugcucucuucauucaauuacuauacacggucuuaagaauaauuacaauagaaauauauacaccuaaguaaagucauguaauucuuccgucucugcccauugugauuacauuguguuacucagcuucugauuguggagaagcugggccaggauuuuuccuuucuggaugaccuuauccccaagcuuuuaacauacaaacuuaauuuguauguuuguaugugcuggugggugcccuugcucacuacccauaccugcaguucaaaagcaucugaugcccuccgcucuccaacacacucacacacacacacacacacacacacacacacacacacacacacacacacacaggaccuggguuugguuccuagcacccacaugguggcucacaagcaccuguaacucgaguucuagggaaaccgaugcccucuuuuggucuccacaaauaccaccuagauguuauguacauaugcucauacagcuaacaugacacaaauacaaaugaaauaaaucuuuaaaaaauuauuuuauauguagaucaaugagaaacaauguagaauuuuaaaauuuuauuuuuguuuuauguacauugauguuuaccugcauguguguuugugugaugguaccagauccccuggaacagacaguugucagcuacagcgugggugcugggaauugaacccagguccucuggaagaggagccagugcucuuaaccacugagcccccaauguggaauuuaauauuaugucuugaaaacaccaugaagaaaacauaugauaaacuugaaagagggaauagacuauaagacuggagagauugguuuauguccuuggaucuucauuuccacagugugacuggaguuucccacuuauucauaauguuauuuguuuccugugcacaagacauuagagaggguuaggugaaauaauguggaucaaguacaugggacaguuugagcacacacuguaaccacagcacaucaaaucucuacuccuuugauacauuucugaggucuuugaauauacuuggacauuaaaaauuaauauauggcuggaaauaaugccauuauguuaauguugauuugaauuccauaaacuguguucaguaaagcgcagagggaagaaagaauuaguguaauuacuuuuuuaaaaaucugauuuaaguuugggguuggaugcauuuguccugcuguacauagaauuucgaauucucccucaccagucucuucccucccucauauagcaggauuucaccacauuuagcaggauuucaugcacucacucauugcuugucggaguaugacuuugaagcccaccagugaccuaugucucuuaccuaggccuuucuguuucccuccugcauugacuuugauuuuagcuggggacuacuuugaucgauacauuagagaggaacuggggucuauucuagaaaagcccuggucuagccuggcuaccgguuuuuggaauugucucucuuuguauucagcugccaugaggaaugguaacagucacaagaagagauccaaggcuuaauacuugaguucccagacaagccuggaagcagcugaaacugacuaggccucacagauguuacugucccaucuccagguaacaucccaucccaguguccuuucuugugcugcagagcacagagcuaccugaguaacccugcuguuggccacuccauuucaaaggaguagaucuggaaucccuaacuggaagaaggcugugcugguggugguuguuguuguuguuguuguuguuguuguuguuguuguuguuguuguucuucuucuucuucuucuucuucuucuucuucuucuucuucuucuucuucuucuucuucuucuucuucuucuucuucuccucuucucccccccacccccccuccccccccccuccuccuccuccuccuccuccuccuccuccuccuucuccucuauuuaggcaaagcuucuuucacauggcugcugagaauuaccuguucauagccaccuggaagacuugaggauuuaaaauaccacccagauauauucacuucuuaagauacauucaucuguuuugaauuugugucuuagaguauuuuccccucuuggcaaaaauaccaaaaaaccccagcuucauucauguacauuuuugaggugaugguauuaugaggaaaaguaaggacuuaaagcuaagugaccagaugcuguuaucaguuacauggucauaucaaguuuuaauauauuaccagaaugccuagguuaguggguccugguucuauaagaaauuaggcuggacaagcagugggaagcaagccagcuugcagcaccacuccauggccucugcaucagcuccugccccagauuccagcccugcuugaguuccuguccugacuuuuuccaaugaugaacagcaauguggaaaugccagccaaauaaacccuuuccuccugacuugccuuuuggucaugguguuuucauugcagcaauagaaacccuaagacaaauggauacuaguguagugggguauugcugugacagaccugaccauguuuuggggaggauuguaaaaggacuuuugaacuuugagcuagaagagccauugaguguuaagagcuuuguggaauguucucugguaucuuggaagauaagauuguuaagagcaaugcagaugauggaggucuggcuugugaaauuucagaggaaguuuaaaggcugucaggguccuuuguuauuuugaauuaaaauucuguggaucugguuagcuagggcugaagaaucagcugugauuaacaagauaccagaacuacuaacacaagacuuagcuuugcuggucagcuggagcuaagaaauuagcagugauuagaaaaaaagacuucacuucaucacugagguaaauaaagucuuugugggagguguuucagaguguaaguguuucuucaccaacuugcuuuuuggucauggcaacuaaacaacaugguuucuggaaacaguuaugucagcccucuuccacugucugaaggugucagcauugucuaggaacaugaacauggcuucucuggccuuuacugcccucuguugucauccucauucucaccacauuuugguagauaaagaucauaccauuuuccaaaucucuaguucuguggcucaugguugagauguuauuugggaucacagaaggucagaauucauuaagucugcaucagggaacucuucaaguccugaauguuaauugugaaucuaaucaaagcacuucuguagggcagcucuugcugagcuguguacccccaccauaaugcagaaaucccuuagagcaauuuuucuuacauguuucuguugggauucaguauauacaaucuuuaugcuuguguauauucauuucaguaacaauaaggacuugaaaaugcuuuuuugauuuucuuuagagaauuacuuuuacugaaacgaucucuuuugucaaaugcaauguuucugugguguuauuaguaacugugucagccaugcaaguuuucucacuaagaaaauaguuuguaguggaaggggacggaauguuggagauagcugguaaggccgaacucagcuuccugcuguguccacagccauccacaucccuggagugaugagaggggagugagugcuaagucacuugcccgugugauucauuuucacaguuuauuuagaaguugugcuccaaagugcugcuucaacagcuguccuccagauuguuagaaucuaaguugaaggguuuuucucuccugccuguacaaaucauucaacaguacaugaugaagauagucugaagcaccccucaaccauuaugccuuggcacaagucuggcuugaacagaaugggcaguuagugacacauucuacauucugcagacauuucuuccaggaugaaccugugucuaauagaaauguguugagaagcaauaagaacacaaugaagagcuaagaugaauguaagaauugugaauguaugugaggcugugugugcauguuugugcauguguacuaugugcacucauggacacuagaggaugguggguacuguuugcucucucuuuauuccugagaccgggucucggugacccuggagccuguugcucuguuagacggccuacuuguuuucacuuuccugccccuacaagcuccaggaugaaguagcuuuuacuuuaauaguuuaaaauguuguuguuagguguauggauggguguuuuaccuacaugcauaucuguguacccacagagacaagaagaggaaauuuaauccccuggaaccagaauuacagauggugugagcuuccaaaugggugcuaagaauugaacuuggguuaauuaagucaguucuuucuaaacuguugugcuccuacccuuuauuuuagagacagggacuuaacuguacaacccuggcugaccuagacuuggcuauguagaccaggcuucccccaacucacagaaauccuccuuucuccaccuacuagugcuugaauuaaaggugcuugccgccacaucuggcugagcuagcauucuuaagcaguugccuggccaggcacaauguaagcuacugauuucucaguccagcauuauaccacuucccaggugucuucuucacauuugacugucguggcauugauagcauagcauagaaggaccaaacauuucuuucucacaguuugagaggcuaucaagugcaaggucaaggugccacuguguuugauugcugaugaguguauuuugggugcuuucuuaccaggugcucauaggcuagacugagggcaagggcuugucucucuuuagggcacacauuccuucacaggaguccgugaagccuuauuuguggacuucagcguaugaguuuaaggggguuugcagguagucagcauaucaucugggccuauuuuacucaaagauuuaaguuuuggaaaagccuucugcugguuuuugcaugaauagucauaauuucaaugauucaauuaaauugaaauuauaaugccaguuucugaaaguauagaaaaugucuauaaugcaccuuuuaaaggaauauuuucaguaacuagcuaaaaauguguuucuguuuuaagaaugacauugguagcaagacugaaaacuauauauagcauguauaaacaguuaaaaugcuugauucaauaugcagacuagaaaguuuagaagcgcuaaaucuaucauuuaccuuuuguacuucugacuuaauuuuuauauugcaauacaaaucacuacucuugcauaucauaaaaccaccagagaaccuaaacugcuuuauagguaguucaguaccuguuggcacugggcaugaaggcuggaagugaggauggcuggagaccucuuccucugacacccugaaacuacagccuucaugucagagcucaggauagcaaggaugucgagacugagggaaccuugagcuugucuccacugugcuagugcucuaggucuucacaccuucacagcagcucacagacgugcccaguguccuggaccuacguaccacaacuaccugcauuccauaguguccucacaggucaccagucaugacuucuacacagcugucucucuguguccgcagaucaccaguaauugcaaguuaaacuugccuuuuuaaaagcaaguugucuauuguaaauucaacguuucaaacuuuuauaagauuuacuuugagucucauguauguguauacuuuugccaugugugugaaggcacccuuggaggccagaagagggcaauggauccccaggagcuggaguuagaggaagcucugagccaccugagauggugcuaggaacugagcucugggguucuggaagaagagcaagcacucuucacugcugagaauacgcacaugcgugcgcgcaugcacacacaauugcuuagaacuuugauccuuaaggugugaacaccuaagauugcaaauauuacucacaggaagaaaugcacggccaaggcuauggcucauuggugcagcacuugguuagcaugugcaacaccaugaguuugguuccuaguaccacaugggaagggaaaaaggucaaccuaacacaacaacuaucuauuaaaaacaugaagaguaaaaagggaguuaugugaguuugggaggcagaggcaggcagauuucugaguucgaggacagccagggcuacacagagaaacccugucucgaaaaaugcgggggugggggguggggggggacagaaaagaaaacugagaaaaacucaaacugauggcuucuuagucuccuugggauuuccauaggaugauguuaaguuaaaguagcauuaagucggcauuuagagcuccauugucucacaaguuacccugcgaguucucauucuucucuacucuuuuguuucaucuucauaauucauacguguaaaauaguuuuuauaucuucacuucaaacuucuuuuaagauuaccuuuccagcacuacuagaggucaagucuagggccuucuccaugcuaagcaggugcuucaccucagagauaauauccccagccuucauuuuauuuugagauggaggucuugcuaaguuacaugggcuggccuugaacuugcaggccucaugcauccagaacccacuuugaaucuaagguaguugaaauguagaauacacguuuuauaaagcauggcauaguucuauaacuuugaauucagacauuugcauucuuuccuaaagaugaggcugugucacuuuggaagauugugcucucugaggcuguaaacuaccaguuaaccugcccuguagcccaucugaguucacagacgcucacuaggcagaggccuuaagugacagcuggucuagucugucagugcaguugggaccuucucaaggaauaaaaccaacagguuguguuuaaauuaauucuuugaaaagagcucuuccuggcugaaaacucaguuugaucuggauguagcaucuguuugguuaucuaagaagagauacuaaccaacaaaggaauagccaccucuuguucuguaaauaguugacacaauuggaggagcuugcuucaagaagagagcaagugucuaucuuucugaggguucuggagaaaauucuucuaugggaagaaaguagaauaaagcuugcuuuccauauguaguccauuccuuguccuguaucuccaggcagcuucugauacuaagaagaccaucaguucugggugcucauugcagugguguggccccacuguggcuguacuucauugcagugaccugagagucugagcaugccuugccacagauacuaacuuacuugccacucagucauagcuguccauuucggaagguccauugugagucugagcugcugucaguggaaggaaaggaauacagagcgagaguggugucaccucuccuauucccuguucccuggcuucuucauuuguccuguggugguaaucauaguuucaaaccuagauacuuacuguguuagccuguuaauacacacacacuuuguaauauucuuggugguugucuguaagcauuaagaaacuucauagaugcugaucuucauaauuacacgaccuaaaaggcagggcucagcaaggagaugcacuuauuuccagggaugcgugcccauauugauuuucuggcuuuuaauuuguuuggauucucaucuaaauaucagugucucaaagagcuucuuagagcuuuccaucauagcagauuaaucaugucucuguugauaggaauuuaaucaaguucugauucuguuuguugucuuugccuaggaauuuugauuuaauggcugauguagucuuuuauuuguaucagaaaaaacacugaucugguuuuuuuuuuuuuuaccaaguaauagauccaaaugagauaugcuuuaguaaaauagagcaagaauugaaauacuuaaauacucauuuauaggcagugaguaaauaaucauggaacagccacacaguagacauacuguacauauauaaaaagaggaagauagacuucuguaauagcagaggaggaggaagaacaucaagucacaggagaguagaacacaguccuauuggugugacaaaacauacuugaggaaacgcaagcacucucauagacagagucuccacgggucuuugagcagcugucagugugauuugccucugggaaagaggcuugcugcagaauaauacaacuguuuguuuuguuuucugcacugcuugaauuuucggacagaauauauuaaucuguauguuuaaagggguucuauucuggagaggaugguuaguauaaagaaauugguaauuugagaccagcuaaaauugaggaaauacauaugugaauguuuuuuaaggcagaccuuaaaggcuagauauuauuuauaggccaaaaaaguuggauuuucaggcuguguauuuguuuacauguauauauauuuccuaagacagaguuuaaagguaagauaauuucuacauucacucauagauugauagaaguauucuugcaaacugauagcaaaugcugugcuuuucuuaagaagaagcugggcuucuauaaacuguguaggaaucggugagagaguuaaaaagguuuuuuugaaggaggaaagguaaguuccaguuuaucagcaacacugauguagccccaagcugcauuagcaaggagacaggccuuuucuucacuagggcaggguuuuaacaacagcagaaaucagggugcauaaaaacuguuuuucauuugagaaauuuacaauacacaguaaccaauuauauuaaucuugauucuugcaaacuaauuuuacauaaacaaccauaaaauaugaauauugacaucaacauuagauuaugagauucauuuuguuugauaacuuggaagucugagaggaaaacgcuguaagguuuaggggcgucuguggagugugugaaggggaacuuucaguccccuaaaaguuuuuggagauuacuuugggggucuagggggucaaaauugaugacagaagcucaugggacaaugacucaucaguuaggugauuauucaaaugugggaaacaaaugcauggguauuuuauaguucuuuaaacuuguuuuuagugaagcaaagauuucauauuuguauguugaaaaauuaugaagcuauuuuacaaaauaauuuuguaguugaaacuauagagaaagaaucuggaguaaaauucaaaguaaacaguaucuuauauuguugaauguauggagcuaagaaagacugcuuuagucuuuggaagaaauaacacaguagaugacaaaauuggcagcuuucauuaucuugaacuaagucuuaauaaguaguguccuuaguguacuaaaguaauagaucuuauuuggaacacaagugcauuuaaggauacacacaagcauguacacacacacacacacacacacacacacacacauacacauuguagcuuuggguucuuaaccuuagucaugcagccauuuaacaugauuuucaugcugugacccccaaccauaaaauuauuauuguuacuacuucauaacuguaauuuugcuguugcugugaagcauaauguaaauaucuguuauacaggauaugcaacccccaagaaagggucauuugauaccccccacccauccacccccaguugaaaaccacugcucucuagacacuaagaaguuugaccaguguuaaaucugccugguacccugauaaccacagugaguuuccuggagcugggaaaguccuggacagcaaacaagcuggucaucagcgcuuggacaauuccagaggguuugauguaggccacacuaaaucuuccucuuaacgacagaaaagaaaagcacuauaugcguacuauaaacagcucucugaugacuuacaugauaacuuugcaguggaaguuuucccugggaaauacaucaaauaccacacauuccuguuaagaaaugucaguuuaaaccuuuacacaaaguuauaggcagauucaccaucuuaguuucacuucucaucgcugugauaagacagauacaacagaagugagaaagggcuuaauuuagcuuucaguuccagaguacaguccaucguucugaagcagcugguccgucacuuccacaguuuagacagagugaauguaugcaugcccgugcucgcucgcucuuugcaucuaucaguccaggccccagcugaugaaaaugaugccgucuauauucaaggagugucaugaaauggcaccaugacacgugugcgcccuuuacguugauucucuuagccucagucaauaucauggcucuacuuccugcugacaccauugcaucuuccacugucugcuggagcaccauuacccgugcucccaagcuucucacaauccuuaacuccaucuuuuucacaggcaguuuauuucaggcacccucucauuucuaaccugaucagucacagaacauccuuauuuaucugagaaauaugcauauuuuagcaguucauaaacucagcauguugccacguugaagcauuauaaauaauuuuacucaaagaauucuuaaaaaucugaaaaguaggaaguuggucuuucuuacauuugacugcuuacguuauuguauguauuaucauucauuuugagauuuggucauuuuugcaaguacaaaguacugaaucaauucugaauaguugggcauuauaaaaaaggaaagucuuuuuuugcucauagccaauuaaauuaccaccauuuccacaaaauauuaaugccaugucagguuuuccagguagcagcuuaguagucuacugaccugugugugcuaguucugugucuggggagcuucccuauucagaaacgcuacacaauagggcauucaguggaguacuguaguuuugccuuacugcuagaagcccuaaggaauggauaaaguguguugucuuuuugguuccacuaaagcaucuucaaauaguucuucaaggaugcuuucagucuucuccauuaaaguuugaaaguugggucauuauguuuccugauacuggguauggauggcucuuacaugauuuuaaguuagcauaccaagaaugguuugugcuggaaaggaagagaaaagcaacacaaggcucaauuguugaaggccgugaagaccaauaagggacccagaugaggucuguuagcuuauucuaagcugcuauaaacugaugcugagaaaagugugcuugguuuauaauucuguggcuugaggcuagcaucuggcaaggaacccuggcugcaucacagcagagaagaccaggaggaaagaucacuuggggagaggagcaagagaguaagcgaaagcagaucugcuuuguagaauucccauuugcgauaucaacucagugcuuccagagcccuaacucucuucuuggagaaaagcaggcccugauaccuggacauuguuacauaggagacaugaguuuuguuuggacaagccauugcagugacacuggagauagauugucccuugucccuuguguaguuauaagcugaguagagaccaaaggcuauuucuuuuuuaacccgaagaggugaugagcuuuccuuugucuuuccagucuacuccguuacaccuggcagcaggcuacaacagaguucggauaguucagcugcuucuacagcauggugcugauguccacgcgaaagacaaaggguauguagugccaccaucccaugggcagagaauuaugcuguugucaucauuugauagccugagguuuuagcuccaaagaagcucauauuacccauucauuaagaauguucucgaggggcuggagagguggcucagugguuagagcacuggcuuggcuuccaggagacugggguuugauuccuggcagcacacauggcagcgcacagggaucucuaacucucauuucacaggauucagcgcccucuucuggccuccgugggcacaaguacauaaacaugcaauacagacauacauguaagcauaacacccacacacacaaaauagcaauaguaaauuauaaaauaaaguugucagguuugagcucagaucuuacuuuaugaaccuacuauagacuucucacaaucaucugcugcaccaauuuaauuuuauuguaauucuauuugaaauuauuuuuccaguuagaaucauuuucaucucuuaaaucgcauuuuaaaaagauuuaaaaauacugaaaaauuugauaaucuaguauaguggcuauuaagagaaucuccucauauuaauaaacuauauuaauuuauaaaugauuuuuaauuuaguuuuuuuaaauccacuuaagcuaauucaaucuagaugaucuuuaugaagauugauauaggaaacaaaaagugggucauuaugaauaaauauuaaaagcuuaccaauuuuuuuucuaguuuccaaugaucuguggauauuuguucacaguccuauaugaaaagcuaacauugcucguuaucuggccuuaagaucccaaggauaauugacccuacccaggugaggcagauuauguagacuucuaugauugacagcauaaaggagcgacgccccggagggagaguuuucauuccgcucacauucaugccaggaagcaggaaaaugaacucuguacuugagacaguuauaagaaagagaauccgucuguuucggaucugccccuuucccaugcugccugucuugccugucaagugucuccugugaauggugcguccugaucacaugaggcacaggugcccagugucccuguccaccugcuuccucaucauaucccaaaccagaugacuguacaguggcagucaucaagagacgcacagcagaaaagggcggcuucgaaccucgcuuaggaaggggcucugaucgggaaguuauaguaauuuuagauauuuaauucuuacacuuagaguauugugaaaguggauuaaaauaguacuguuucgcucccugccaguuagcgugccuguuacauaucgauaaguuguuuauuaguguguuagucuuucucuuaauucuucugacugauaguauuuuauuauuuuuauggauccuauuuaaagaccacaagauaaaugcuaaauguguggauauaagcuguguuuugaguucuucccauaaauucuuaaaaugcguuuaaaaaacagaacuuaacagaauuuuuuuaaaaagcaauucacagccagauggcuguguuugaaauuucaguguuuuaauuuucucuuuuuguucaguggacuuguaccucuucauaaugcaugcucauacggacacuaugaggucacagaacugcugcuaaagguaagagaaauccaaguguugaauaguaacauucaacuuaaacugcuuccuuucuuuuucccuuuucccuuuucccuuuccccuuuccccuuuuccuuuuuccguucucuuuucgagacaggguuucucuguauagcccuggcugucccagaacucacucuguaaaccaggcuggccucgaacucagaaauccaccugccucugccucccaagugcugggauuaagagcgugcgccaccaccgccgggcuuuaaacugcuuucuaaaagcugaauuuaaaacaauuccaaaaguuauggcugaaauuuucagugaacuccauuuucagaguuugcuuucccuccuggacagacacacuuacucaugucagccauuuucucuaauccagcauggagcuugugucaacgcuauggaucuguggcaguucacaccgcugcaugaagcugcuucaaagaaccggguagaagucuguucucuguuacuuagucacggugccgauccaaccuuggucaauugccauggcaaaagugcugucgacauggcuccaacuccugagcuccgggaaagacugacauguaagcauuuguauucugagcccaguguggcuagcuguuagggaaaacauuucgggcugcuucauuacccaggcuguuuccuaacuagaccauggccuucauucuuaaugugugcuaauuuaucauacucaugucuaaucaugcuugcuucauguguuccacaagagccuuuaccacauacgugugccauacauacauacauuuguacaaaugucacauacaucauacauacuacuuacauauauacaugcauacacacacauacuuuuuaagugcaauucuaauucauuugucaagacuacugguguuuuguuuuguuuucugguuuuguuucugugugguuugguuucuuuuccuauguugucguucguuucgugacagcuaagggcaaggcccaucaacaaccauuuacugaguauuuuccugugugucgaacaguagaaauauagccauauacaaaucaaaacaagagugucugggccccucgagcuucuguucuugucccccugguaaugaaggugugucugagcgucagcuguggggcuccaaaacauugacagugugguuuuauuuacacaugaguguuaggccccaaauuuaagugaggugauuugauggacauaacuucauuaguacauauuauuacaugcauauauguguguauauacauauacuuaaggaaacugcaaguagguuuagauccacagaaaguuuauauagcuaauacagcauucucaucugcagcauaucuugguuccuguauuacugacauuuuacacuaguacuacacaguuaccacaguuaacccaguagugacacauuccugacggaaggcuagguuuccuugguuugggccagaagucucuuuucuguuugguucucaggcauuauguguauagauaaugugcaugugguucugacaugcaugcaguucuccaugugggcacuguagauuaccugaccuguagucugccuucagccuuauaugagagagucuaagaaugagaaagcuuuauaaguaauuucucaaggaaaagacugcucaaaugcucaucaagugugagcccagauguaacggggacaccguuguucuacugucuugguagaaccuccucccauguaucuuguguuggauuauauaguuuauuuucuauggauucaagcuccuuagagaccuguauguuuguaggaugauggcgaccuaugcuaucccugggaucuuagaggccucugcaucaugucuccaucuaacgccaaccuagugcugugcuuaugugagcugcguguccagcagcuucagaaguacaguacuguuucgcauguccuuucuuuaguuuauaguggcucacucauguguaucucaggucaucacugucccuguccugcucucaaccgucuuaaaaaucagucguaucggaagccuuaacacuguuuuaucagguugucuuagucucucagaggccuuaagguuuacauaaauguguguagcucuacacagggagcaguuccucaguugcuguuaccuucucaaugggggcuuuuuaaacaucagcuucugcccagcgucccaaggaaggauuuaaagcuccucucuagcugcagcuuucaguguccugauugcugcuuuguagcugguauucaauuucaccaguuuuuugaagaaaauuauauaggaggcuugagaaaugguucagugguuaagagggcuugcugugcauucacaaggaacugaauuuugaucccagcccucacgugaccagccaugcauguucuuuaugugccuguaaugcccaggcugggagagaaggagacaggacagucucugcagcuugcuggcugcuggccuagaggugggaagggcuucagggaggaucccuaccucagagggucaggacacuucaucugaccuccauacaugcauagguacacucucucacacacucacacacucacacacucacacacacacacacacacacacacacacacacacacacacacacacacacuacaggaaacaaaaauaaugcuacacugugcuguuauuacaucauucugcauacuuauccccuuacuugauuuuauuuauuauuuuauaaagccaaauaaugaaguugucugaauuucauucuuuuuuaagacacuuuuagaaaagcacaccuuuagauguuuuauaaauaugaaauuaucagguuuuaggguugugucauuuguaguuuuaacaacuuuuaaacuauacagugucuuugagggucugaaaacaaacccauaggccuggggagguggucuagcaguuauugcuucuggcuuaugcagacugccugguuccuaacacccaugugcuacuguucacaacggcgggcuuuguuuaccuucagcuuaaaugucucccaguuguucucuccagcaaagcccuguaguuuacuugcucccacgucugaauacaucugccccuuuguaguugucaggauccugcuuugugugugugccugccuguaauucccugacuugauuagccccugcguguagcauuaaaucaaaacaucacauguugucauugguguuuacuguuugccucaccgucuguuaccccuguguuuuguuccagaaguuuuaauaucucauauugaaaaauugaacagcuaaaaaaguaagcagaaauugggguauaagguagcccagccaguuaaagcacucaccacgcagaccugauggagugagucugcguccucagacacuacugugcacagaggacaccaucucugaccucuacacauauccugaggugcacacacauguguagucacacauuaccuacacacacuuugcaaaauguuaaauaaaagucauuagaaauaguucauuuccuaaacuaaucacaacuuaguauacagauauugaguuuaaaacaaguauuuaugaagaaccuacucugugucucugggaccguguauguguauagagaucuguguggugugagagugcagagugcuccagugugugugauuagcugcuuugcuuuugauaagcuguuucaaaaacuguuuuauaugugacuugcuaucaacugugagaguauggacaucuuauuucagaguacuuauauuuuaaaacuuucucauaaccuauacauggauucuuuguuaucacuauuuuauauuacuauuuuaacucaaauaaauauguacgcaaaauuauaauuuccacuuaaguuuuuuuucuguauuuguguacguauugguuuuuuuuuuuuuuuuuuuuugaacagucuuauacaagccagucucaggcucucuuuguaggucagucuagccucuacucuguuagcacccugccucagccuuccaggcacuggggcuucaagaguguacagcacaccuucagaguugguuauaacuuucaaaacuacaugucaaccauuguuucuucggcagaugaauuuaaaggccauucuuuacuccaagccgccagagaagcagaccuggccaaaguuaaaaaaacgcuugcuuuggaaaucauuaacuucaagcagccacagucucaugaaacugcauugguaagaugauuauccauacgucccuuuggcccauaauaguggagcaagauuaaauaauucuuuucauuuccaaagccuuggagcagcgcugcucucugaaaugccagcaauuugcauuuuaauacugguugcacugggcuuuaacuugcauucagucaugguucucugugggugagggacuagauauuugcucagccgugaguuagacuuguuuugucuuuguguucacccaagcuuauugugacaaauuauuuuugugcucagugcuuuuauuauaaugcaaagugugaucugauagaaucuuaucuuugagcugugcuuacuagauaaauauugcaucuguuuucuguagaaaguaugauuucauagauauuugcguuauucuuuggaguaauuguauucagauaacagauuaugcucaugugaggaaauguugaaacugaacuuucuguccccgacuguauaaaugaccuuuacagcuguccuucccuccuccuccucucaggaagaucacugacuuuggucauuaagcacauuaaggcacaaacaugagcugguuagugccugccccuaacgcuagaacuuaagcuaugugcgccuuauguuacagacuguaugcuucccuaacucucguaagccugcgugccucagaaaggucacuuagcccauucugcugaaaacacuauuaaaagauaaaaccaaacugaaacgggccaagugaaauuucuuucuuucuuuuuuuuuuuuuuuaagauuuauuuauuaauauauguaaguacacuguagcugucuucagacacuccagaagaggaucuugauguggaugguugugagccaccaugugguugcugggauuugaacucuggaccuucggaagagaagucgggugcucuuacccacugagccaucucaccagcccccaagugaaauuucaaaccaccaagcccaguucaaauaacuucagucuccacagagcuaggccaggagucccccgucacagaguguaauccaggagucccccgucacagaguguaauccaggagucccccgucacagaguguaauccaggagucccccgucacagaguguaauccaggagucccccgucacagaguguaauccaggagucccccgucacagaguguaauccaggagucccccgucacagaguguaauccccagcacuguaagaaacuugacccucugcuuugggguauuuccuuuauuuaguugugaguaauuuuauuuuucaacuguuaaugcagccauugauauaaaauggagcaaaacacaaaaguuacauaaacaggaggacaaaauguaagguuucuaagcauaucgguuccuuuacaucacuucaggguugcguguuuucaccacugccuagcaagccugcuuauccuugugaguuuggugccucugucagugaaguaacggaaaaacacuggcagauagaccagugaagguuugaguaaugaagucucugcaugccuaauugagaauauaauuucacuugccuugcacuuccaguguguguaagaagaguauugacuccagaguacaaugcuucaucauguccugaugcacuuugagaugacaguagcuaauagcuacaggggccguuucauuugggaguucauguuuagguagaaguuugucuuaaacgggauuguguuugauuuacagcacugugcuguggccuccuugcaucccaaacgaaagcagguggcagagcuguuacugaggaagggagccaacgucaacgaaaagaacaaggaguaaguacagcugcgaaagcuggcccuuccuccucuugccucugucccuuacauguaagucacacaacccagcauugccgacccacgcccacaccgugaaccccuuacuccaacaagccccauccugguuuccugucuucuuguugccauguuugcuucgucuuggugguccgugccuugugguuaaguggccuggaugaacguguacaguacaugaccgccccacaccaccccacuaaagaaaaggagccuuccuccugucagcagccagcagccaccgagaguuguugcaguaaaagucacaacauucucucucccuuuuuuccuuccauaguuucaugaccccucugcauguugcagcugaaagagcucauaaugaugucauggaaguucugcauaagcacggagcaaagguaagccgucacucagcacagggcaaccagcugcccucaguacuggguccccaagaacucaucuuggucagaaagggcaguuacugugugguuuuguguuuaaagucauagguuguccuucgaaguucauuuaacuuuuuuuuccccuaguaaaauugucucuuuguccuuucuuuuuaacagagguuccuuuaucuuagauaacaguaguuuuuagguuaacaaacaaacaaaaaaagacuaaccagcuucauaauuuauaaacacuaaaacacaauccacuaaccugcuuauagaaaacuccugcuuuguguuuagguaguguuugcaggaacauaguaaagaugaaauuugaguaucagauuuucaguaaaccacauuaaaaguaaaaauacagccaggcagugguggcgcaugccauuauucccagcacgcgggaggcagaggcaggcggauuucugaguucgaggccagccuggucuacagagugaguuccaggacagacagggcuauagagagaaacccugacucggaaaaaaggaaaaaaaaaaaaaaaguaaaacuacuacuguuuguuaaacauaguuaguuaauaauauguuucuuugauaggcuccacaugaaucuccuuaacugauaauagcuguugaaccagguguuacaaccaagcagugaccucaaauaacucuuguaagacuggagauuggaggcuggagggaugguuucucuucugcagugcauccgaguccaugguuagcaccuguguugagcagcucccagcugucugaaacuccagcuccgagagggagcuggccuccaggggagcuugcaccuuugcacaccacacauucccacacagaaagaaacucggaacauacacuuaguuaggaauaaaaucuuuaaaacaaugagacuguucucuaauagagcugaaugguaucuuccagcaugccuuuccuuccugacccuugcauuccccuuacaugagcaucagauugcugugugguguuuuagugguguuugcacuacuugauuauacuuuacagguaaacaagauuauguauauuaaaugcuuuagaaggacauuuggcauucuuaaucgaaaucaaguaaguuaaaauaaagagagcagucguacagguuuaucaccuacuuuguagcuacaacuauagcauuguuauaagcaacauguuguaucagaaauaguaagcuaagggggcuuucugcuacacuugugugaauuauuguugcccuaggcuugacuuugcaagucacuuuugacaauuacauuauaauacucauacaaaccauaauguucuuaauucuuaaaaauguguauuauuaccuacaaggcauuuuuucagaaaaguuaauugaaaaauaagcuuuuuguuauagccucucucaguggcauugcguagaugcgaggcucucaguccuuccuggugcuccacgugcgugauguguuauuauuagcaucuuaggucagcaguggacuucugcaacugaaaacagucugcuagugacgcgaaugacuucuaguguagcauguccuuccuggucuuccacuacagcacacaaguuacugauuccuuuaaauacaaagacaauauauaaguugucaucaguagaucucaaaugccuucaauccuagcacucaagaggcagagguagguagaucucugcugaguccaaccuagucuacauaauaaucuauaggcaagcuaaagccaaauaaggagaggaagaaggaaaaaaggaaggaacuggaagggagggaggaaaggaucgugggcaguggcagcagcggcugcuauaucaacucccuaucacucauuccuggaucccaaggcagugugccagucccacaggguugcugccuccauucuucauacauuaguaaaaacuuuucuugacuccuaaugggucauguuuuccuugcuuaguauuuucuuucugugauucuauuggacuuuuaaguggcccauaguuaacauuugagucuaacagcacuuucugaacauguucacaugaucaaaucccuaacaagccacaaaagggaggaaaaguguaauuugcucaugguucagagguugagucuauaguggaaggagaguaugcugaaguaaccacaccgagccaaauaggcagcagagaggagcacuaacagaaagacacagacagaggacauaccccuagugacccgcuucuccagauacuacgauggauacucuggauggaacuauggccauccgcaguucugucuccuaguagccugcacauucugacucugucaguggauuagcacauucauuuaaacugaacccuuagagucuggucaucucuagaaaagcccucagacauacccacaaguuugcuuuucuaauuauuaauuacuuaguccaaucaaguucauaaucacaguuguccaucaugaccucuaaauguauagcuuaagagugucuuaacuaugguuagcauguugaguauguaacauaaaaucaagcuuuuucuuuuuuuaguggcaguuucacauuuuaauaaaaauaaucuguuuagcauugaauguuaaguauuuguaguggaccaggggguuaagacuuacgacuuggucucaaagcauuuuaggggggcucuggggcuucaggggaagaaggaaggcaguggcaggacugcucgcuuugucuggugggaguuuuguuguucauuucuuugugggguagagucuccuauguaguccuagcaagcuuagaaacugccgugcaaacaaggcagagcucagacuucccugagagguuugugacagugcuuucuaguaaagaacagguccuuccucaccggucccuguagcaagccuguuuacuauuccugucuguuacacauuuagugcucuaagugagcucuauagacagacuaccaacaaacacuuauaagcucuucuauuuaucuccacugagugagugcuuuucucaucaguaacuuuauuuacuucaaccugguugcuugauaaaguacuccauaaucuuuaguagauguuacuuagacuuugagggaaggauuauaaucuccauucauaauuuaaaaauauauaucuguuaaaugaaaugauuuuguauuacauuaguaauacacuuacacuuauacuuuacagauaugaacauucuuaagauacagaaagacaacuuaaaggaaugaguaaauaucucauaugcauagaauguuuaauauaaaauuucauuauguggccaacuuaccaauuucuguuauaagucauugcucaucaaauggaacuuuuaaaacuaaaucuuaauucuuuuuacaaacuuauuccaagaaccauugaaacauuauaaauuuuuauucauuguuaaaauacgaauuuccccugaguaaguaauggggaugcaauugggccauuuuccacagcacucaguucuaccauacuuacuuacggaagguacaguguguuugucuuaguuaguuuuacugcugugaacagacaccaugaccagugcaacucuuauaaaggaaaacauuuacuuggggcuggcuugcagggucagugguuuaguccuuuaucaucauggcaggaagcaugguggcacucaggcagacauggugcuacagaaggagcuaagaggucugcaucuugaugugaagccagcagaaggagguaauguguuguacugggugugacuugaguauaugggaccucaaagccugccuccacagugauacacuucuuccaacaaggucacacccacuccaacaaggccacaccuccuaauagugccauuccccaccaagcauucaaagauaugggucuauggggaccacuccuauucagaccacuauaguguucugcacaucugcuucaacacuagaggugaagcaguccucaguaaacagaaaaccuuuacaauccucuuugccuguuacauuugcuugcuaaagggcugagcuuuauuuaaaauacuagagacauccauuugaaaucuuaaguugguaagaucaguauuuuagaagaauaacucgcaaaccauauuuacaugauuuaacaaacuaaaucggaauucguuguuacgauuucauuuuuacagcuguauaauugagugugucucaucuaauuuccagagaagugugaauaguuaggguguuugcagcucuggguagucuucuaaaaugaaguaacagucauacaaaaacuaguuugccaucuuguguuuuccauugagaaauaaauacuaaacagugcuugucuguuagguacaaagucauuuuuuuuucugcuggaaaaugugaucaaauuaaauggugaugccuuucauggugaguuuugugaaggccaauaauaauuuaagugaagccuuuucugaacaagcaacacagcuuucccaguaagaaaggacuggaaagagaccaguucucuucacuucuggccucucauuggugugggauuguacuaucauucccuuauuaggaccuuucaaaauggcacuccguauucucaccauuaauuggacuugaugaaaaguuauugccacaauguaggaagugguuaagugcugagucagcgcgcaugcucaggagggggaguuguuguugaggccuccagagaugagggagggaggauuuaacaggguuuccaugaaagcagcauguacacucugaucccuguggaguagcagguguuugcgggaccagucuaaaauccuaggcuaguuagauucgaccaaauuaugaaccuugacccagaagcggaacauuuauucaaaauaauuaacuaaauuacuguuuaccauauacauucuucaagguuuggaaauggcuccuugaauguacaagggauuucccagucaaauguauuuauaguuaaggcauccauuacagauguguauccaugaccugaaauaggaacguuguaaugcuucaaacccaaaaccuuugaaucaucaacaucauacagacagaaaauuguacaccugaacucauguaauaccacacagucacagucacagaaagauagggucacuucagcuuaugaguacaguggacauauggaacaaguugguguguagaccugaguccucuuuccaaggcguuucauuauuuaguacaaguauuccgauagagaaaagaauuugaaaucagaaacacuccugaugagggaucgucauucagauuauuauuauaaggcacuuccuaaaaugcaagugugaugaaccacuacacugauagccugcgugccuguucuguugucugaguguggugagagcuauucguucccagguauuuagugagcaucuccagugagaaggcacugagcaccagcugagaauccugcccucugaugacguuuuuuccuuuucuuuuuuugaguggaauacagcacgcuggucagucagggaaaucaaggccauuuugugauuccccacccccacccccaaggcucucacuguuucuauagcacuagugagcaaaagcuaaucaaugauguuuuccaaaaaaguuucacaguugacucuuauucugagcguauuugcuacaauguaaaagaaugcccaguuucacauggacauccaaugaauuuucagaugaaugcacuggauagucuuggucagacugcuuugcacagagcugccuuagcgggccaccugcagaccugccgccuccugcugaguuauggcucugauccuuccaucaucucccugcaaggcuucacggcagcgcagauggggaaugaagcagugcaacagauucugagcggugagucacguggccuaccuucccucuccucacgcccccucccacgagaacagacccugccuccuguucugaguagcuucaugggugaucuucuuggucggaaugcuucuucuucacacauuuccuuuccuacauagucaccccaacuccaauuugugguaggaugaggagcuaucaggaggagaucugcaccauuuuuaaguuagguggcucguuggaauugaacacaagcuagaaggaauugaacacaagcuagaauuacgggagcuguccaaccugucaaacugagaaauguuagguuucuagaguaaugaccucuaauuguucuugccuguauaguacucuggcauacuugucauucuuaacuauucugaaauuaucuuauauuuuccugguuuaauugucaacuuuuggugagugucacagugaaugcccacuauaguguacgauacuuacuuuguugacagagaucgggcagaaaacugauaguacacuagacacugacauucuaacucccaaguuagaaguaacagccuuguaaaaacuuuggaauuagacaugaaagaauaucaauauaauuacucuucuuucucaccccucagccuuugucugaacagccuuugucuggguuccauuacuauggaaacugaaagaguaacauagagacaccuauagacucgugguuagaaaccuggcuacucuuugcucccuguaaacuguaugcccauaguuuucccauuuacagcugauaucuuaugaugcccucuacccagaaauaaaauucuuaagauuaccugauacauaacuauucaaaaaucuacauaagaaguuccuaaacaucuauauuaaacaauuguggugugauagcuuggagaugacaaaccuagaaaaccacaauugacccuacaaauuuugggggcugucagaaaugcaucguguuuagaagcacagaaucucucaaaguccaugguaguuacaggugugccagggcuguguaaggggcgcagucccaagaaaucauuucauacccuggguauagcacuggguagggauugcuuucccuccucagcucauucuugcaugccagucauccugcuucagucuauguuuguugacagaugaggaaugaaacugauagaaaauaagcacugacuccccagcucccaaauuagaauaacagccuucugaaaccucaggaaccagcugugaaagaacugcagugcaguuauuguagaaaugaguguaaucccggcccggggguucuacccugccuuugguuacugaaguuccaggaugaaagacacacucacaaccuuuauauuuacaaugagcccuaacuaccacaauagcugggcagcugccuacccuccuugcuguuagagucuauuuucuacugauaaccccaaguuauuacuuacuauuuacuauguuucgucuggccugcucuuagcuccaguucccucagggaucucucuugauccuuaacacauggcuguuucuccuuccuccucuccugcaccuucuucuacagagacaacuacuuccuccaguaguuucaguaguuacucuucuuucucacucucggcuuuuccuccaguuuuuacucucagaaugaggcuaggguguuaagcuggacuauuaaacccuggccuugaacagagugguggagcaucugcuucaggaagauaagauacugcucccccacuagaaaauagcucuuucaagaaauugcaaucauuuuguaaauugagauuuuuauaaaauauucuuuuguccuuuuuuuacuggaaaugauucacuacugaauuuuauuucugaguuauaaccauaaauaagcauacagcuacugcaucagucucucacaauacuaugcauaaauuuaacagugguuaacaaaauggggaugagguaucaaauaaauugaacagcuuggauccauuuaguaccuuaaagaugccuucuaguaaacgcaucucagguccaugacuucugggaaugagauugaauauugaaucauaaguaaaaauucaguuauuuuuauaauucuacucuaaaauugauuuugugaugcauauaguaguuaauuauaaaugcuuaauuuagcaaaugguaggaaucaguuugccauauucauuguugaucuagaaagagaauacaaauaauagagcuaccugagauacagagccuuuaaaaaaacauagaaaauaguuuuauuggaauuacuccaugguuggaagaggauacugaguguucuuuuauacauauuucuacauucucauuuuacuuuuuaaucuugaggcagagucugaccaauugccuaaguuagucuugaacucuucuguaaccuagacaggccuuagaucuguaauauuucugccucaucuacuuugguaccuaggauuugccuaucaaguccugcuauauuauuucuaaaauuaacuuuguucuaaacccauuuuagauuuauacauaugcagaacucuauaauugcuaucauaauaaaucagcauguuuaacuuuuacacuuugacauuuccuguauguaguucuuaguagcacucugcuauguacacuagauauuuugcuugacuagaaaaugacuaaagagucuuccugaguuuucucuguugcuggacucucucauggagacaugguagaguguguugcagaacagccucaccuauaggugcaguaggacacaugcaccauuagacuggagaccagugaccagaaagucagcgagugcaggcgucagagaguuagggcucagcacauugacucugaugugaagcagcccaaagccaacucggcaaauacuuggauuauuguuuugugaaaaggaaauguaaacaggagcaaggauuccagcacccagccacuccacuaacaagugcaguagaauacuuucuuuaaagagaaagaauuuuaaaauggacuucauguucgagacaaucuuuuuuccuuuuuaguuuugguauuuuaucugauuuaaucuuaguguuuuaucugcuaagaauuauuaauaugaucaaacaguuugccuucuacagaagaguucuuaaaccugucuauaaaagucaacccuuccgaacaaagcacuguagaaaaauaaaguauuucuuuuaaaaucuaaagccuuuuauggcaucacuugauccuucccacuuggacugugaacucagugucucugaucauaguguaauguaauguaaucuuaaaccugaaagagacuuugaggaaaaccaggucucacucuuggaaggccucaggcugguaagauggcucagugguuaaaggugcuuuugccaagcaagccugacaaccugcggucagcccccagggccauggugccuggcuccaucugcacgccauggcacgugugauaauaaauacaaacagcaaaaaucugagguauucuccaaaguccacauggggcccaagccugugguccugauagucugccacacucucuuguacugcuauaagucccuucugaaagccacauuuaaugugagcauauugaaucucuuuucuuuaaaagaucaauuuugaauaaaguuuuguuauauauccauauuugauuaaucaaaaugccugacauguaagcauguagcuguaguaacccaacuuacuaugucacaguucaccuguugucuucucccauacacaggcauugcaaaggcugggccuacuuuuggucuccugguuccagcuuuccuuacucuccuaggaaacagucuaaccugagcgugugaugacuagagugguaggguaugaaguguucucuauguuaugauauauuuaaauuugacuuagaugagauauacauugaaguaaaaaguaaaaaaguauuucuuauguaagauggaggaaggagccauuauaucacaguaauguccgacccauaaucucuuuucccucauuaagcagucuuccuugcauaacuuucuccaacaguagucuuucccuccuuugauacagagaguacuccuaugcgcacuucggacguggacuaucgucucuuagaggcaucgaaagcuggugacuuggaaacugugaagguaagucagcgccuucaccaaggcuguuggacucgcgcugcccaccucacuuaaauggaucuaaacgaagggacucauaguagaacaaugggcaggguacaucuacacaaagaagaguacuaccaagauuucuccuaguauguccuuauagcaccuaaaccauaaaauaaaauaagauagacacauacauuuuuauuacauauaauagcaugaacuuuacucuauaugugcaugcaugagcaugugugcacaugugccauggugcauauguaaagucaaaggaaucaguuaucuccuuccaccacgggcaaccugugaauugaauucaagcugccgggcuuggccgaacguaccuuuacucccaugagccaucuuacuggccagaacacaaauuuuaauuucauauauuugugugcaaguaggcaaaaugugcuuucaaguugcuaaacaaugcauucacauuaagagaaaauuuuauuuuugacaguggaguguaagugucuaaagaaggcauacaaauugagaauuaggucugguauguuuuuucucaaaagcuaagaaauagaaguuagcuggguguguuagcucaugccuuucaucccuucggaaagccgagccaugaggauccuugugcauucugggauagccuguacuauaagaguggugcucucuccuccccuuccucucugcuucucuguuuaaaguauuuuaaaauuugaaaaacaggauauaaaauuguucugacauucaucaaagaaugacuagaaucacaaaauugugggacuuagagagcacgugucucuugacccacacucaaggagacgggaacucucuuuagguucuuugguuccauguagucagcucagguuggucugauuugagcagagaccaaacuaagcauaccacaggaugcaucugugaggagucucagggagggagggagauggacauggaugagacgggaggcuuccuuggcugcccuuggauaucgguuagguuagggacuggacuagggucuccaacaaauacuaaauuccucuguacacucagcucugcugucacaguaaugccaaacauaaugcagauucuccuuuggggcuuucugaaacaucauguggcccagacugcccucagacucacugcguaacccgcacuggccccaaauuggaggucauucucugucaccuucuccagcucagggacuuuuagguaugccucaccaugucuggcuauggugcugauuuuuauacaucucaucuguagagaauauuuacuaucucauuauaguauuuuaaaaugcugcccaguuuagagcaaagucuaugaacgauuguuaaugguguugucucugacucugugucuguguguacaccacaaaagcaacucugcagcccgcagaaugugaacugcagagaccuggagggccggcacucuacacccuuacacuucgcugcaggcuauaaccgugugucugucguugaguaccuucuacaucauggagcugauguccaugccaaagacaaaggguaugugaaugugcaaauccauucauacuuagauaaaguacauaaaauuaaauaaaaucgcauacuuuuuaucuacagaauauagcuguuuucuuuggaacaaaaaauuuacaaaugacauacugcuuuuuuaaauauugcuguuuuuagugucguagaugcuuuucuuauuaaaauauauacaugauucauuuaaauuacuacuuaaauagacauacauauugaaauugaagauugagucaucggucacccuaaaguuagaacaugaacaguuugccuauuacagucggccagcucuguccugagcuguguccagcagcuggcagucacuuggacugugaccaugucucuuggcucggugccugggugaggaugccuuuccagucugcucuggucaucaccuguucuugcacugugucuuccaauuuggugcauccuuucaugccuguguauaggauuuuauuuccuuuacgaauauuuucauguaaucuguaauuuacuguuuauccuuucauuauuuuuuuugcuauuaaaaaauucuucuaagaauuuaauccaucccacaauuauaauagaaauauaauuucgauucugcucauuuaaguuauugacauuuuuauauuagaugaauuacuugauacaccagguaaaacuuuuaaaguggcuacuuauaaaucuaagaauaguaaccaaaaucaauuucuguauccugagucaguuuaauagcugcucagaugagggggccccauuuugugcacuuacucagcauugcgccauaaguaaaaagauguagcucaggcuuugaguaacuguuaaguguuuuaucuuucucaagccaugcaccaugcaugacgauucagaaccccucacugguuguuucaaaguacugcaaugcguuggagagcagccaguguugcuucuaugacuuaguuuaguacuggcaugugucaucaucaagccuuuguuguagaugacacuaaucucuaaagagucacugcauaacugauuguuuuuacauguccuacguccacguacgcugccuucagugcacggcucuugagagggugucuuuuuuugugcugccuuuuagaaugucaccugcuuucuuugaaggagcuuacucagaagaugagagguuuagauucucuuagcugaguagaauuuauaauugaauuuuauuuuccuugaugauauucuucuuuuuuagauggaguuuguuugagacaaagguuuucuguaucucuggcuggccugaaacuugcuauguagaccaggguggcuacaaauucagagagaucuuccugccucugccuccuuaauucuaggauuaaaggcaugcacuacuauggccagugugaauucucuucugaaaucacuuugaguuuccauugcuuuguaccucaauauuuaagucaugcagagaaaccgcucucgaaucauuaugaacuuaaaaauaacuaaaacaaauggugaaagauacaaacugaauaaguagaauguauuguguuuauguguuauauauuacauuauuuuauauuguguaucaugaguaagcuggcaauuuucauuaguaaaauacaaaucaaagaaaaucugagagaugauaaaaaguagauugguuaauuaugugugcuaauacuuuguaguauacaggacuuuauauugcuaggguacaaguaagaauugaaaggauuguguuacgcagaccuggggucccagccauuugggaggcugaggcaguaggauuugaacuuggugccugcuuggcuuauggaaugaguauaggaaaaccuauauuuaaacugagaggucuggguguguauagcucagugguagagugccacuagcaugcgggagacccugacucuuaauccuagugcuaccagaaauaaaguauuuuuuaaaauucuaugagugauauacacacacacacacacacacacaaacacacacacaaaugugaauagaugaguagauagagcgauaagaauaaaucaguauauauuguauuucaagauuaacgauugcugugauagaaggcuuuauauugaaaaguuguuuguuuuuaaauuaugaguguuugaauuagugagggggcuuagcagguaaggacacuugcugugugagcugcuguccugaguuugaucccuagaccaugcauaaaguguaaggagagaccugacuugacagggugguccucccuccacacgugcauugugacgcacguaugugugcacacaauaauaacuaguaaaaaguauuagucccugcuuagaaauggggcccauguuagggaccaaagaggaaguauuucuguguaagcggguucucaguacuuagcugcagacagugugacuaggagggagguuuggggcagagucucacauaggcugugcuggcugggaacgccucuccagcugggguugaucugaccuccugccuuuaccucccagcuacugagacuguacacagguaccaccauuaugcaaauuaguuuagcugaaauauuugucuugugacuauuuuccuuuuguuuaguggcuugguuccccuucacaaugccugcuccuauggacacuaugaggucgccgagcucuuggugaggcacggggcuucagucaauguggccgaccuguggaaauucaccccucuccaugaagcggcagccaagggaaaauacgaaaucugcaaacuccuucuaaaaguauguagacaugaagcagcugcuuuugaaaaguaaucuauuguaaucuacaagugcuaagagggcuaucucugguuaguuccugauaggucuuuuggaauugacuaaguggggacauuucacccaagaagguuuugggaacguugguuuaauuuacaugguuuaucuaauguaguguuaguauuagagaaaaguggccguaggaacuuuuccaucaggcaugcucuuugaggcacaauuauauugcugcuguuguaacuaauaguauuguuaacucauuucuuacuaaauaucacauacucaugucacauguaugucuugcaauacaucuguguggauucucaucuuuucuuaaccagagaaaaaauacuguuguuacauguaaguccacuuuauauuuaauacuguaauagcauaaauauauauauagcaaguauuaccacuagaccacuagauacuuuuuuaaaaauuaccuauaggacauuaugcauccauugucuaauuugaacauugugcuuuguuuauuuguuucuucauucauuuuuuaagagaaagucuuacuguugcucugacuguccuggaacucacagagaucugccugacucugccccagaaaugccgggguuaaagguguaugccaccauaccuggcuaacuuauucuuaauuuuuacagugggugaacagcuuucuguaucaggucuauauuaaaacuucuuggcuuauagguacagcuuuuuuuuaaaccaagguaguuuuuuaaaguacauuuauacaucaugaaauacacuuuuaagcuaucaaacuuuuuuuuucauugaugacauuuagaauucaguuuuuuuucuuccuguguauauuccuuuauuucuuucugaugaugcugccuaaauaucuuugucccauuugaguuggaaccauaauucaaugguggagugauagugaccaagugugagacccuaguuucaucauuaaaacucucucucucucucucucucucucucucucucucucucucucucucucuguguguguguguguguguguguguguguguguaaguguguguguguguguaaguguguguguguguguguaaguguguagugcaacugaagucuggccaaaauucacaucuaggccauuauaagaaauaagauauuuucaaagacaauuucaagucuuggggaaaguuugucauagaaaagcaaaaguuccccaguauccucuguuuuauaaaauaaaacagaauuuaggucccuauuuucaaagugaauauaggauagguuuccuuccagcugaauguaguaccaagaguaaaugaagugaguucuauaugugcuaccuacccacgugcaaacacacgugcaccauuugguuuugucuuuacagcauggagcagauccaacuaagaagaacagagauggaaauacaccccuagaucuggucaaagaaggagacacggauauucaggaccugcugaggggcgaugcugcccuguuggaugcugccaagaagggcugccuagccagagugcagaagcuuuguacuccagagaauaucaacugccgagacacccagggcagaaauucaaccccucuccaccuggcagguaagugucacugugucaucucacugucccuucagcuagauaacaauauacugugugccaggcacuuagccacugggcgugaacggugaaugagguuggugagauagcccaccaggugacaguacuugccaacaaucuucacagcccgaguucaagucccacaacucacauggucagccaagagggucagcuccuguagacuguccuaggaccuucccacucccacgcggugccugugagugaaaccagcacaugguguacacuuacauaaagacugaauuaugugaaguuaguauuagcuuuugaagaaaaggaauuaaaaucuucaauuucccuggucuuugcuuguauaugugugagucuuaucucuuucugcugaccugacucgccccuuucccgcuaauagcaggcuacaauaaccuggaaguagcugaguaccuucuagagcacggggcugaugucaaugcccaggacaaaggagggcuaaucccacuucacaacgcugcgucuuaugggguaagugugccacagugaacgucuagaagccuucccuggcuuuaaugcuuuauuaauuauggguugcauguuaaggaacagauggccaaccugcagcagaguugagugcagcucaaucaucuauacaagcuuugucauaccgucccuaucguuacuuucugaugagcuuugaaagcucucugugacuuugcacauaaucuaacacaguaaucaugguauagugggucauauauaaaucuugccucuaccucagauagguuguagaaacuauuaaggccaggaggcuccuaaguggguguggaauuuagcugccuacaguuaucucuacaaucucagaaggcuccugccacaaguuugagcuuaaaguuuaaaguuucaugagaauuuucuuuauggcaaugagcuuuauucugcuuaguauccuuuguauuguaguauguuuaguuaucuauacauacaaaggacaguuaauuucugugauauuaauacauuuuaaaaaguacugauauuccuuaccaaaagcaugugauuuuauaagaauaaaucaucuggcagauugauuuucuuucuccacuuucucauuuugcagcguuuucccuaaaacauagauucugucugaugguuucuugccaucacaguaguagacgguauauacaaugaaauggguuggcuggagcccacauucucuucucuugcccaccuuuuuaacauugagucccugucuuuagucagcgcuuagugccuuucuccaggacagucgagcuggcuccuggucuuggccuucucacucaguccucugguccugcccaggugacgaaagcuaagcugcagcucgcuugugcaucugaguuacugugguuugcuccagaaguguagcuacuuaaaaagaaggaaaagcuuaagaauuguguuugacucuauuucaguaauauuccuuccucuucauuggucuuguagacauuugccagccaauuuagcaagcuuguaauugguuucacuaaagacacuguaaauucaauauaaguaaguuuaacaaugcauacugaacacacagcucauuuauacgcccacauuuauacaaacuguaacucuuuuuggacuaauuuuggaagucuaugcaaauuagucuaccaaauuguguuccucuuaauaaaaugcaggaaacagcuuaaguaacuugugauaucaucugagggauaguuugaaguuaugccacgcuuucggacuaacucaguagaaguugcuuuuugaaaacauccuuugaguaaagaagauaaauugggguuuuuuuguuuguuugguugguuguuuuuggaagugauucugauagaaucauacauagcuuucauguuagaaguuuaaacauaaacugcaaaguuaguuuaauauucucauaaucccaaagaaucuucaagcauuuagauaaacuagccuguucucagcagaauccuagugguucugugcagaccuccucccgucuucauuaucauguuaucagggauaccaugucugucuuaggaauucaugaucucuucuuuggaaauaaguaguuagaggccagccuagagaggcaaaagaauagcugaguaggagacaaguccaaagcacaggagaagacuguuuuugauuguuuguuuuuaagaaguuucuauuaaggaugaggccuaggaggauggugaaaucguagcaaggauacuugacaaauucugcuggguggcuuucuucuucaguguccguguucucuugauuuucucagcauguugacauagcagcguuacugauaaaauacaacacguguguaaacgcaacggauaagugggccuuuacuccccuucacgaagcugcccagaaaggaaggacgcaguuaugugcccugcuccuagcacauggcgcagacccaaccaugaagaaccaggaaggucagacaccuuuagaucuggcgacgguaaguccuuguugcaggguggugguuguacauuaggauuccaggcaugaccuuaccuuccagggcucaacuggcacuuccuguggcggaguuggcauucuuccuggaaaucuccauagccaaaaccacauggccucucacuuccuucugugcuucagugauaucucauguagagucggccuccuucacuuugacuuucacuaaccuugucugacucuuacagccaaaaucacugucacuguccuugccugauguccgugucuuuacauuugguacuuggugaaaaucuuagcauuaauaaugguuuuuguguuuucuuuaaucauuuuuuaggcugaugacauccgggcucugcugauagaugccaugcccccugaggccuuaccuaccuguuuuaaaccucaggcaacuguaguuagugccucucugaucucaccagcguccacccccuccugccucucugcugccagcagcauagauaaccucacuggcccguuaacggaucuggcuguaggaggggccuccaaugcaggggauggcgcugcgggugcagaaaggaaggaaggagaagguagguguaccccugggaacccuuguuuguacacuuuagcggaccaguuacuuuuuccuuuuuauuauugaaagcuuaaagauagccccucucuaaacuuuugaguucaaagucauccaggacuacauggugaggcccuaagucaaagacaggauuggaggaugugagggggaaggggaaagaaaaaggauuccugggacuugcuaagugagcuccagguuuaguaagaugcucucucucaaagguggguggguggguggguggguggauggauggauggauggauggauggauggauagauaguagauagauagauagauagauagauagauagauagauagauagauaggaagauauucaacauugaccucugaccuccacauacacauagaaauaaauaaaaauaauucuuaaaaagaauaaaucaaacugggcggugguggcgcacgccuuuaaucccagcacucgggaggcagaggcaggcggauuucugaguucgaggccagccuggucuacagagugaguuccaggacagucagggcuacacagagaaacccugucuuguaaaacccaaaaauaaauaaauaaauaaauaaauaaauaaauaaauaaauaaauaaauaaauaaauaaauaaauaaaauaaaaagaagaagaagaagaggaagaagaauaaaucaaaauaguaacugauaccuucuucuuuucuuuuaagucauugaaaguacuaauucuaucaacuauggucuugagccuagguacugcucuuguagaggaccugguuuaguuuccaccacccacacuguuuagcucacaacccucuucaccccagcuucagggaacccaguguacucagcuggcucccagggaaacacuucgcgugcagauacgcaagcauaaaaacacacaaagcuaaaaauaaaugucuuagacauaaaaauaaggugguaggaauuauauucccuguagaguuaauauauacaucuauauuuuaguucucuauucuauguguauuagaauuaauguaaguacuguugcuaugccaaagagaaaauucagcauaacuuggaagugccugauuuaaauugacauauuugguauugguuuuugucaugugaaaucaucuguacaggcaagugucaaaaaauaggguuaugcauaaaugcugaccuugcguagaauuaggaaauucuaagagauuuuacuguuuguuuuaguugcgggucuugacaugaacaucagccaguuccuuaagagccuuggccuugagcaccugagggacauuuuugaaacagagcagguaagcgcucacgugcucuuucagcuuuucaucuucugaguuauugacuucauaaacuucgcagcuguuuauuuucuguguuauguauucucuuuauuuugugacuuauaguguucugcaguuugccucguguuuaaucuauguguauguuuuuaccuugcuuguuagcugccugaaauacauguagagaagccagggagcccagcacuuugcgcucaucuccgacgcugacaguucagagagccguccuuccucuguggccaguuuuguucagugcagucugugucagguuagacgugagaaggaaggguucagcuugcugagagagcacuuggugaacuuagagcaagaaacuaucucaagaauauucucaguuuuucugguuuuuguuguuguuguuuccaaaagaaacuggcauuuaugagcucaucuucuuguguuacuagagagagcucuucuguuugccagacuguugucaaaggucaugaguucuuacucccaugcuccaugguaaacacugaagaugaaacugaguuuaauauuacugguggacauggaacuuuaggauggagagucacucagacccagugccccauuucccagguggagguaccuccauaugcccaugucagccuuucuggcagggaggauagcuugugcaggagaauauagcuguugaugucuuuuuaaagucuagucagcuuuagggcccacuucacaucuuuauuuugugacuuauguucgacagucuaccccauguucaaucuguuuguuucagguuuguuguuaccuuguucugcacaagucuguuauuuagucaguauaugcacugaguuuggugagcuacauaacaaaugaccauggacuugguagccuaacagauguuuuucucucagaagacugaaaucagaugggcagggugcacucccuguagcaguucuagaagagucugcucccugcccuuccagccuccuugacuuaggccacgcauaggccaccuuacuccagucucugcugcuguuggcacgaugccuugucccaugucugccuucucacgugccucuuacugggacacuuccuuuaaacuugggcccuccuggugacuaucagaacuuccucucccugucguccaaucaucuucuggacuagaaauguccugugagaauccuguaaacugggucuuugucacuguuugaacacacaugcucuucauucugacucaugucugcaggaauugugaaacuucacacacacaccuuggucuaauaagccaaaaaccuccaguucaaacaagggacccaccucuuguugagagccguuguuucugagcuuucaugcgcuuguucuuacuuccuguugcaugcucucugucaggaacugaccuccugugcguguuucucauguuauugacuugguaguuuaaugacucagucuucagucagcuuauucuuuuuaucaguuuuguuguucuuuuuacugcaguuuucuucugaguaaaucgaugucccauugauuuucuuuuguccaaaaucauuucuauagccuuuucagagucaagacguuaauuguugcacuuaaugcauauuaccuuguguaggcccucuccucuagguaguggugugcuuuucuauguaucgaaacugucuuuugggccacugggcagacaauuaaguuuguguuuauuauuucaagugcagauguuaucugucuagucuucagguauaaaauauuaagucuacuuaauucuuccgcggcauaccuuuagaauuuucuuuucugucauaaauauuguguagcagucugguaauguguaucaacaagcaugugacccuucauuguguccccuuaucccuucugugacuguguuugcugagacacuuuguauaguguauuccgcuguucucguccugccugagaauaccccucucccucuccugaggcgcgagguaguucuuuuaguuuguguccuagaaguucuuacacuccaccuucacaguuccuucucagaagucucugcgcugucuuauuccauaaacacuuuagaaauaaucaucaaaauuccuucuaguuaacuauagcauuauguaacaucuucucacacuuagacuauagcuuccuaccuaaaauguuuuguuuaugggaaaggaaaauuuaauuuacacuauaauuucuggagcucaacugcuacgaccuggauuuucacagaaacugaccaucuacauucuauaaaaggucggacucauugaauucuauguaaauaugauuauaacaucaccacccucaagggaaaaaaggucuuuucauuuauaaucguuaauuuucucaucacaucccagguaaacaagcgaaucuuuggagcaggcagcaacccuauagacauagcauuuacuuuauaugcagggccauuuuaucuuaugaaugaguaacuuuaguauaaggaucuuauaucgauguaugcuagauaugcacaacccccuucuccccaagacaagaacuugaggagcaaacuugugguuucuuccaaauaccaaacauauucucuuaacuguucccaccagauaagucacuggaggcuuagaaguaauaaauaacauaauuaaauauagaggggaaaguacuauccugucauuucuacuguaucauauuaauaacuagucaguaaguauagcucauacccaaggggaagggaguugaagucagagcaccaaugcuggagacaggaucuucagcagcuguguaagaggcggcuuuccguacagggaggagccuggcuccucagccccgcucuguaaaccagaguggaguaacuccagguuccucucuggugcagcgggcuugggcaaggauuuuuauauucauuuugugauuggaagucuguguguuacgcuuuauuuccucucuagagcaugauuggaaauaucccuugggguguugucuucuagccugacuuugacacccuucagcuaugcacuauugaauggcaguuaagaagauguugaugucuguaaccuaaaguuaccucauauauaucaggcuguguuuuuauugucaaccauaucuaaacugaaagaucaaaucucuagaagaacaugguaccaguugcauggcucacaaagugcauuagaaucaggucagccuuaggauguagagacucccguuguguaaacuguucuguuucaaaggugcuugucucccuuuugcugucuucugaaagcucuguuguaaacuuccuuugcgugauuagaagugaauggcagauuuuguaccaugaaacaauuauuucuucaauggccacuuaaugugcuaaauuacuuuagagaauaagcccagaugaucccacucgcuguaaaggaguucauuuucacaguaaaaaucaaaccuuggggucuaauuuguuauguuagugugaggguuaaggaagugauauauauauauauauauauauauuaaccuuaaaugaguuagaaaaaagaaugucuauaaaaggauauuucaguucuccaaagaaagaaaagaaaagaaaaagaaggaaagaaaaagaaagagacuugggcaauguguuuauccucuggacauguggcagaaggugauucagaacuuugccacuggguggaagcagagucacaauuacugugguccacaaaggccugagaaagucagcuagcugagacugucaggucgccgagacucaaaggcugcuauuguguacagacaucgaaugccuggccuguuagucagcaagcauugcuaaccugacaguuuaugaacuuaaacaccaucucucuccuguucucuaaauugggauuucugaugucucuuauauaauggccacacuuuaaaucagccuaccuucuaaggccucugacuccuggcuugcugguuuccuggcacugggaacuuucucaucuaaagccagcuugcuuuugccacacugugacaaacuaaaauguucccguccccucugccguucauuucuccuacccacaagauacagaauuucagacugcugaucugucugucuggagacaaacaaaagauggcagaauugcagacagaaagacaugguggugaucacccgucuucccaucacaguaggucuccugccucaaucuccauaucugcuucaagcaaaugagggaggcuuuccccugagcuaggagauugcaggccuucuuaggcagcuugaaggucacgcccgguuuauaaaaggaaaccuguaauguuauuuuuuuauguaauuuucagauuacgcuagauguguuggcugauaugggucaugaagaauugaaagaaauaggcaucaaugcauauggacaccgccacaaguugaucaaggguguugaaagacuuuuagguggacaacaagguaagcuacuugggaaaauuauuuucagaacuuaguacagaacuaucaggcugguuuuggggcuuggguagucuggccccagagcacaugcagguaacuggcacagcauucccugccuuccucaggucuagccagacaagcccgagcucuucccucuccucuacuucucacgccuuuguacugcauccucagcccugcuuuuaccuaacucaagccaccagucccucccucuccugggccuccgucacugugcagccccuucccagucuguaccuucaccucccucacugacuucuccacagcgaccaagggucuccagcacaagccugucaaccucuccucaugccuuuaaccccucacaggcccuggagcguucuggauaaaaucagacacuuaccccaugguuuuucacagccuggccuaucuggccuucccuugggcucuucugcugcccucaggaccacaguucaaccauucccaucauccuuugcugccacaggccuccucucuuacuucuguauuuucuguguaucucuuuguuagacacacuuuccauagaggagagaagcaaagagaaggaccauguaucuauggagcugauaaaaguacaggcagccaaaauggagaggguuugaauuugacuuuuuuuuuaaacauuuauuuuagucagccuuauaaauuaacagaucaguuaugucggugaccauuucaagccauuccugaaaguuuuagaggguaguucuuguaucguagaacucauuuuauuguaguucagcauuguuucucuucugcguaggcaucacuauguucaugguggaguucaguucaguagguccugagcccugcuguguagaaaggguucaugggaggggagaagccccuuaccacuuucuuucuucuugugccuuugguauaucugcuuacagacuguauauugggguggagauugaaaauaguguagauugcucugagcugucagcuauuuauagccaaguuucccauaaauguguggaagccaagugauauggacaugugcuuuguauucuuguuuuucucuucuacaggaaccaauccauauuugacuuuucacugugugaaucagggaacuauuuugcuagaucuugcuccagaagauaaagaauaucaaucaguagaagaagagguaacagacaucagaacuuuuuucuuugcccaaguucuguuaagacuggucuuuccaggggaaagaacucaucuuacuuuguuuacagggucacguggccugcuacucagccggaggcagcagccagccuuuaaaugugacuguagacuaaaaccauacacauugcauuuacgucacaagccuaugugcgaauagcuccauauuuuuguucuauagauuuugucaguuuuaagucauguaaguaagaaccuuuuuaaagcauuuucauacaguaaaaugcaccuaagauugauauggggcaagaaucuugcuucauagacagaaaacacuuucuaggguuuuuguuguuuguuuguuuguuuuggggguuguuuguuuauguaauuaguguuuuuuaguaaugugccugauugucacauuuuucucauguugauuacaugauaaaagaagagucuaucucaguuaauuuccauaaucagaauuauucuaagcauuauauaauaagacuacuuugaaccuccuuguagaaagaugacauagacauucuuccugugagagcaggcgggagagauggcucagcagucugcucuuccagagguccugaguucaauuccuagcaaccucaugguagcucacaaccaucuguaaugggagaggaugcccucuucuggugugucugaggacagcgacaguguacucacauaaaucuuuuuuaaaaaaggaagaaauuucccuugugcugauggcuuauauuucuugccccuaaugcaaugucuaacuccauuauugugauuaagcucccucauuccauuauuauacaaacaccaagcagacauggguuugccugcaguuaaggauuucuuuuguuuguuuuguuuauuuuuuuuaacuagugcccauaucaucuccauucaaugcuaggaagucacauuugggagcacaggaugguuucaguuugcguuagguuaucagaaagauguuaugacuucuagggccuuauggucugguugucuccauaguaaguucuggucguguaagauacaggcuacacauccuugcagauggagccauggguagagagcucaggugucagaaauuuggggcauuuuugugaugcugccuagaaaccuaaggucucacacaugcuuagcagauguucugcccauagcccaagacacuaaagguuuuuccauaauaauuauuaaaguuugagagugggagaguuuguagugcucagaagguuauucuguucauugugaaguuuacucagcuucccuugccugaguugcuguaucaagauuccaaagacuacugagauaaaaugaaacaaaaauauuuuuaaaauauuuauuuuuagcauuuaucuaaugugguaucaauugaauaucauuuuaguuugauuuauucaauuucuuuucauucuuaauuacaaaguaauuauacauuuuuaaagugcuauuauuuuucaguuucccuguuaugucuauaaaaaauaucuuucaaaauuuguaucagaaaaugcuuucauuaguauuuaugacuauauucucaguacaaaugcucauuaaauuuguuaaaauaaguuuguagugagcuccugauugagacucagacucaccagggaaacagauggaagaacuaucuagagaccgcagaaggaaugcuuucuucuggcucugauggaguuaauuguuucccuuugcccuacagaugcagagcacuauucgagagcacagagacggugggaacgcuggcggcaucuucaacagauacaacgucauucgaguaagccugcugguuguucugggggaaucggacugcaaaacuaacacaguuaaaugaauucuaggaauuugggaagaaaaauucagauugugaaagacacuuauucauuguccuaaaaucaaaugcuguucucuucacuacaaccucuaacaucaagaccauccuggcuagaaaccacagcacagugagacagcaaagccccgaaggucucauaaaggccgcuggggucagcaccacagcagccccgccuguuaucuccucagauuuggacccucaacagcaguaacuucauuuuaaaucacuugaaaacugcauuuuuaaagaucuggauugucaaucuauuuguuauugaugagaucagaaugcauuuaucucuuaaaucacaggaaaaaaaaacuauguugccauuaucugcuuuuucagagguuaucuugaagguuaauuacaucugcuaaaaacugguuuaguccuuucuuaauugacuuacaauaacccaugagcgguugguugguugguugguugguugguuuggcuuagugauaaaaugcaugcuacacaaacucuagggagcugaguuggagcccccagcacucagguacagccuaggcacaguggugugcaccauugucucaacgcugggagauggaggugggagacccuaaagcuccacuggucaguuagucuagccagcagcaagccuaggcuccgugagggacccaucucacauaaggugcagaguaagagcaagacucucaguguugguucuggcuucacauucaugggcacacagaaagcagcaaggagacaccacauaacugugucacuagcauauuaacugaauuccacugauagggugacuuagauaaugugucagucaaaaacccaaaauugauaccaccaaaggaaaaacuacauguccuuucaaaucaaaauguacauuuaauuaagaacaauauuuuuuguccuuuaugaagauucagaaaguugugaauaagaagcugagggagcgauucugccacagacaaaaggaggugucugaggagaaccacaaccaucacaaugagcgcaugcuguuccacggugagcgcugccugcaucgggcugucagcagugggggaagacugggguccguuguugaccuuauguuggaaugacuuguuugcacuuuuuugguugaaauaaugccuaauuuccuaaugcucugcauguuagcacaggcuucccaaaaccugugccaugccggugacugucugaauuugcugcuaaacuccaguuccaaguugagccaccugcaguuuucugguuuuuguuuuucuuugugaacauuacuagauuucagugaaaauaguaaauggcuaaguguugaaaaacuaauguuuccaccuuuauauuuuuagguucuccuuucauuaaugcaauuauucauaaaggguuugaugagcgacaugcguacauuggagggauguuuggagcuggaauuuacuuugcugaaaacuccucaaaaagcaaucaguauguuuauggaauuggaggaggaacaggcugucccacacacaaagacagaucauguuauauaugucacaggugagcguccugccuugacugcaaugguugucacccucaacuaaccuuugacuauagcgcugggugcagugguccagacuagauacauaugcgcucucuagguggcaguggaacugcauuucagucuccgucaggugcagagaccucuuagugcucacaguagacggagcccuucuagccacugucauacaugaacauacagggucaagguaggagacuagacucaagucucauugccgaugcggcuagugguguguuugauuuaagggccauaauaauuccccuuggaaagcccagccucagaauaucagcuugggaauugguagcaaacagaugaauaucagcuuuuuaaaguaggacuuuguaaucucgaagcuggaaaagaugaucauggcagcgcgugagaaggcgguguuucucuucucacuggagagcaagaagaucgggauuuagugugguuugcagucauacacaugcauacuguauccaacccugagcccccuauacuuaccccuaaucccgccaaugcuuuccccucccccuucauguccuugugaguuuuggagagucucucauuugagcugcuggaaugugcaugagugugggugacuuuccauaccuguaccccuaaagaaaaauaaacuuccucuccugacagcccucacucaccaggagcuccuccgcuuaggggugcagccuuaugcucccgaccaugcuggaguacggaugggcuugaucuagugcaggugaccauagcugcugugacuucaugacucugguggccaugcuauccuaaggccacaugucacagcuccacccuaucugcuugcucuucucuucuuuccaccccguccuccacaaugcuccuugagccuuggagaagguugauggcaaaugucccauucagagcugagcacacacaguugcuucuucucaggacucugaccaguucuauacugccucgacugcugccuccuacaaauagcuucucuaagauggagagcagugcuguagacagguauacucguaaauagcuccauggcaguuuuguaccauggucauuuaccaaagcaacaauaauauaucaccuccccugagggggagcaggcagcccuuaccgaccaugaguauuugacaaguuuuagugccauacauugcuguuuaagccacucaauuguauguuuucauaaguuaugugaauaagguaucuuaugauucagcuaauaacuuaaaauguaaucuuaaaaucccuuauaacgaaugccuuuacauuuaucugcaguugcauuauucuuuaucuggucaucccaguucuaagauggaugccauacggucagaaggaaacuguucuccacuuagaucgcugugguuagaaauuccuaaggauagcgaugccccagcaugccucccauggagacaaaguaaaccuaaaaugaacaacaaagugaacuuagcugaggauuaaugggcgcucaguaaaauuagacacaaguuuauguccuagccagggucuccuagaaauggagccugagcaaacgccugcagcuggcacgccauuggcaaggguugucccugggaagcaggaaggaggcagagcgcacucagcggugagcccggggagcacgcuguccauggcugcauuaucaagugcaugagaugccuucagagacgcuauagaaacugcugugucagagcagcaaugcuccaggggaggaaggaguagauuucuguggcuccuccuugugugggccaacauuugcuccccaggugcucaucccuguguuucuuaguuguugcaucuacaaaauaccacaagcaggaagcaaggcagcaucugcaccugcucgcucgcucgcuucuucuugugcugacuggagaccaaggccugucaggucaaguauuguauaacagauggacagugacaaaaucuacuuacugacagcagacugcugccaugacaguaaaggugggccugaggaagccuccuuugggggcugcagagguggcucugcagguaagagcacuguugcucuugcagucagucuggggucaguucccgcauucucaugguggcaaacguccaucuguaacuccagguacacgugucagggaaugccacugucccuccuggccuuucuggguacuaagcacauacauacauacauacauacauguaggcagaacagucauacaauagaaaauaaaauaaauaaaggcuauucauaauguagagugagaccuaucuuuucccuacaagaaaauacacuagauagcaagccuuuaucccaaagggucaccagugacacccagcuaaaaaagccagcgaggcaggacucaguaauaacacaaagcucauacuccauuacuacaaacuguuuauauuuaacagugugacucauuguacuaaauagcuaaaauguguaguguuucaggguugacuuuuuuuaaaggaauggauaauaauuaccuuggacuuugcagccauguauccuugucagagacuucugccuuuagagugcagaagcaacuguggaaaugaaugcauggcuuuaaucaggaaaauuauauuuagaaaaccaggugccagcugggcaugguggcauacaccuuuaauuccagcacucagaaggcagaggcagggggaucucugugagucugaggccagguuggucuacagagugaauuccagaacagccagaauuacacagaaaaccuucucuugaaaaaccaaaaccagaaaaauaaaagaaaaaacagguaccaaguauuuuuaaacugguggcuauaguuuauaauuuccaucuugccaguuuuucuuauccuguacaacauuuaacaucugcugcaauuucaguuagguauuagauuuucagucauauauuuaagcuacauauuuuuguuccugguucacuuuucguauuacucugccaucccaguuuuuacuauuuacccaugaugagucaagccuagucuuaucuggagagauggcuuaggguaaaaacuuuugccacacaagcaugauggccuaaguuugaguccccauaaucuauauaaacgccaggugcauagcaugagugguuugugagccuuaaacuugcccagagucccugcaaagcucucgggccgaccagucugguuauacacgggcaggaucaucaaagaagcucugucucuaacaagguagaaggcacagccagcaugugagacuguccuccuccccuugagcaugccacacuugcgcacacacacacacacauacacacacacacacacacacacacacacacacacacauacacauacacauagcuuccucccucugagcaugccacacacacacagcucacagugucaaucucaggcucuguugcuaucaccucccuuuaugcuuguguguccguguaaaagcucagcucucagcagggucuguuuguacuuggcacaguucacaccagguauuuucuaugacagaguuccaggcuacuccaaaacugccuuaaacuguugaucuaacuugauauugaauugcuaaauaguaaaccaguauaucacauuuaauuccauuacuacacacagacuugaaaguagcauuucaauuaacuugcauucuaugaaauuuucuauaaaaagcuaauaaaccuaacaguuacauuuuaagauuuaaaguguugggaggaauucugggaggggggaccuggagagggucagcauuugugguguauauaaauaaauaacaauuuuuaaaaauaagauuuaaagcauuuucauuuguuuuuguucucccuuuagacaaaugcuuuucuguagagugacccuuggaaaguccuuccugcaauucagcaccaugaaaauggcccaugcacccccaggccaucacucagucaucgguagaccaagugucaaugggcuggcauaugcugaauaugucaucuacagaggggaacagguauguugacagcacgaacaagucacuaagcacauacaagagcgagagccauacugaagacuauccgcaguuguugcaggcacagcauaccucugaauagaccugcuugauauaggcugguuacauaaauggaauccuuauuauucugaucagaguccuacauccuugagagucagagggcuacaguauaguuaauucuaucaccuucuuggauauccaaaaugaaauuggcaggacaaacaauaguaauggaaauguguauacagagaaacaguucccagcacuacgaagguuuugucugcuuuacugaaaugaucuguacaaugcugguuuacuuaagguggaaaagaaaauacuguagaaugguuuguaaacgucguuuuuccaaguauccagaaucucauucgagaaagcuugauuucucucggacaggaaaauggagcuuuagcgauuuagucuuagcauuagaaauguggguucuugaaaccgaguaacccgaagugaguuguuacuuuuaggaguuuagaacagaugucucuccucugugaucuuguaaguaguaugguuuaaaagggccugguggguaauaagacuuuuugguucauucuagccuuucuaauccugcagcuaaaugauuuucucgcuuuaaagucuucuaggcuuugugugauugaucaguaaacuguaugcagcagcaauccugucuccuaaucauggcccuggagcccucagcggaggaacuuacaguaauucaugcugcaagaaucucagagucuaucugacuaaaauggacaugugucaggagucuuuuacaugcuaccaaaaauccagguuucuggcccugacuccugcugaaguaacuuuguaagcaaaaacaaggcguuacaccaagugcggagagaggccguuucacuggggcaaagggcagcagcagcuuacccucggagcuuuaguguguagcgugugccacuguggacagucuuacauuguucuugucugguguagauccccagacagauggucugcacccugaagcaagggcucugcaucacaccauaguguaucacacauggugaggccuuaaaccuauacugcuaaauacauaauuccccuaacaauuaaaccaucuaagcagggucucccuuuguccacuauaaaggagaaguaucugccgcagcuugucuugauaacaagaauuaacguucugccuuaaagccauucagcugagcagugugacuuaaagagagccacagagaacaguuacugcgccuucagauucaagaguccagagagauuguugacucugauuaucccaguuugagcaguuacugauggaaaccauugguggcuuagauucagaccagagugcacuggacuuugaagggcuagugugauaaugcugcuuacaugucuauagacaggacuuuuuuaaaaaagcauauuuauauguuuuguuuuucaagucuugagacaucuuaugaggcaccagucuaaugaauaauaaugacaauaauguuaauaguacccaacacacacucuauuguuacuauauccacccuguuccaagaccuuuguacuuaauucucaccaaacaagcaaacaaaaacaaaugccaguauugcuguucccacuuauaaccaagaagacccaagacauagaugugugcugauuuacaaagaaaaauucaauaaaccuacuacuuguauuuuuauuuauuuuaaaucucaaaaaccucuauuauuguuguuauuauuauuauuacuacuauuaauaccuuuaguaaucucuauaucugaugcaaauagugcauaaauucuuuggggcuccaaccccuuugcccaauuaagaaauauucuucuucagucauggccacucugaaaugcuggguuugguuuugucgcucuuuaggguugaagaauucaugugaagugcacacucucugcuuuuaagaucagcuuucucugguagcagcuuccuuuuaaagaagucuucccaugccggaaccaaucugucucacuagcuucugucacuguagacagugacaaaagcuggcggcaaaugcaagccuaaauccacaccauuaucccuccaguagaggugcuugcugguuggcacgaucaucccuagccaggugugguggcuuucagcucucggaaggcagggcgggaaaacaagcccuagcuauggagcaaauuugagaacaaauuagccuacaugagacccugucaccaagaaacauccuguugagucaucccuacauugcccuguggauugugguaccuuagaccguccucauuauaguuacugggguguggggcuacaacauuuccugauuaaucugagcucucgacagcagaauuauuacuugaguuaauaggcuucuugacuacuuacuauauaaggugaagaggaaagaugcuggaguuuuccuguuaauggugcauagcuucacaguaaaggaugagcagagguaccuagccuacaguguugagagaacugugaggcuggggcuuuacagugcugcugcuagauagagugcuuaguucaugugagcaaggugcuagcuuccaauccucaacacuacagaggguaaacuaaaaguagaaguacugugcaggcaauuguauggauggugggguuugccugacuguuguaaguaaggcuuaagugcugcaucuucaagggaaugaguuguuugccuucuugaccguuccaggcauauccagaauaucucaucaccuaccagaucaugaagccagaagccccuucacagaccgcaacggcagcagagcagaagaccuagugaccaccccugguaaaggccagagugauucaaaccugcaacuggaguacaguggauugcuuccaacaaaaaaucaauauucucuaaaucccaacagccaagaaauaagcugucuuuuauaaagcauugcuagagugacagugcagagugggucccaagcacacucaccugcccuggucccuuugaggaaauggcugccgggcggucuugaacaugucucaggccauuuucauugcaguuacccauuucugaagcaagaugcuuugcucgagauguagagaugggaaagagaaugugcuggcucacacguucuugguucauacacuacauuuucuugguuauguuuggcacaugaauaacagacacauguggugugcucauuuuuuaauuuugccaagcauauuuguugaugcuucuuguugucguuguuacuuugaaaaugagccagucuuccuggaauauuuugcacagagucacacugacuaaaaucauuagcaaugcagccgagcaagacacuguucccaugucccuguuguuugauuuuguaucucugcuucuugugaacauaaaggaaaaucagcaauauuuaguuuccuuuuauaaacugcccuaucuuuccaucuuaaaaggaagggcacaaacgucucuuugaccuaaagagccagagccggguggaccauuugcucucugcuguccucagggcucuugggaccaugcugcagaugucaaaagugucagggaaagguuuaauggaggugguuagaaauuugcuucccugguggaauggcuagagagccgggagggaggagcccagggcucuggcugcagccagcgaacccaggaugucucagccaacgcuucccucucugcaccuccagaauuguuuccuggcauuaucuguaauuccagagucagggucccagcauucuccucuccucuccucuccucuccuuguagauuagaaagccaggauucaagccguacugauaaauaugcacaauugcaaggacguuuuguuuacuccugaucuggccuuuauuuugaguaguauucaucaaauacuuuagaaagaucccuucucucuguuuuugaaccauuucuucaaaguucuuaauauaguuagacaaagaaaacagaaguugaaaccaaaggcaguuugaccuauuuuuuuagacgccacugauagagaaacauuucuuugugaaagugcugcuuguaauggcauucgccaagugcacgccaccgagcagagccaccccacuuugcagagccacgcuuccuucuguccccuguggaccuuaacugaguacugaauuaaaugcauugcucuguauagguucugcucagcucugaagcagaagucacauaaacagagggaagcuaugugacacacuuaaucauuucaauuggaaggcugaaaacaguucuuuugacuuuuuuuuuaaugcaagcauauuaaaacugugacugucuuuguuucucugguucuugaaauacacauuucucucuuuauuuauuaaauuuuuguuagcuugagcccagugcuaggacuaggcauccagucuagugugaaugaauauuauaguuauaucuugaaugaguuccucaaaaugaagucaagaauuagccucaguuuucacuuuuguugaaguuucaauggccugagcugggugcuuguggauuuggcugcguguuuaauagcaacucgacuaccauacagagcuucagaaugggauguuggcucgagagcucuuccccuucccucucuuuuccuuucuguuaacaaaggguugaagaaaugggcaucuguauaguuuuaguagcuauaauauuuggcccaacugaaauuaguuuaacaugcuaaacacggcugugauuuuaauuuaguaacgagcuacugugguauaguaaaacaaacugaaccgugaaccuccaucccacagcuggauuaaccuggcccuuaccuugaggagucuaccuugguucccucaaccaccagggcuguggcucauguucugagcugaguagagacaauguguaaggaagccugcuguagugcuaguggucucguggugacccaccuaugacaaaaugcacaugaacgagcuguuuaaaaagaacaaguccuggaaaaaaaauuaaaaauaaaugguccauagagcuaauagauauuuucagaacuugaaaaccaaagguaucaggaguguauucaaguuggcaaaaaggugguugcuuaggauuuccuuguacagcagcauagacuguagaagagcccucuggacuagacaagccuggcauucggcugacagcuguuuaccuucuuguaugugcauuauguagaacuccuggcagguguggaaccaacuccugcuucccaacagagcugcagagagaaggcagguggcuccaagcucuucuucaaggccuuucccagagaccccacagugccacuuuacugguuuggccagcuuggauacuuaacucaggcauaaacuauaauuacucugggcacgucugccuguaccuuugcuucuccccagauugcaaagcuagucuuggaagugcuccugugcuugccccauucaccuuuuuccuuuucuucaucacgagucuuauauaggaauccaggugucccuuauuuuccuaucagaauggaucaggguuuaguccucauguaguuucugcucagaagucugccaguuugcuaacagauggcagcauggaacccaguguuucuaugcaaaaacacaauggcaguacagucuggguucuaacccugcuuucccucccucacagagcucugagcagccuaaguagaguaacagcacuaacaucgccuccugaaggcagcaggcuccucugagcuccacacuucugacugcacucauuucucuuggcuguuggaauagugaagggcauuuggaauguauagagaaauacuugaauauggcaagcaaauaagcauacauuaacaucuuauuauccuagauauuauuacaaacagauauuaacauuugucuagugcagaaaacagcauuagaauguaguaaaugucccaauuuucuucuacugcaauauauucccaguugcaugaagggugcuuaggcauuguucccucuccccuuuuaaacagucgucaucugaauuccuguaaauggccuuguaaaucaauguccguauuuguaagcauaucuggcugucugucccuucacccaugcacccagaccucacaugugugccagccuucauccuguguuucuguugggcagaucaucuugcacagaguuacagacuauagaaucacucagcaaauauucagaaaugauguaagaauuuucauggaucagaaaguugaaggcuggccucugauguuaaggcagugacacagaaaugagggugauugugacaguaauauucaaacaaccgcugacuacauccagugcaugaaaaagaucacuuaaaaaauaccgcccuaaaaaacugaagcuguuucagccaacucaagcaaucugcaguuaauagacaacuaugguuuuccuguuugaaaaagccuuaucuauggcagaaacuuuuuaaccuuuucuaaucuagcagugaaauaugaauccacuucuuaauauuugaaaugugucagugagugggcgugucuguucauuucauaccugguaaguguguuuuaugggguauauuuuauaaguaauauugucacauuuaguggaguugauguagccagucaguuccaauuucucucaugcaaaguucuucagccuccuggucaccugguuuggaguaacacuggugggauugccgaacuugugugggggauucauaguauguaauacuguguagcauuugagugguguggaaguuguuuuuaaaucauuuuaaaguauauacuaugacagaugaaacuuaaaacuugucggaagcugaagauuuuauuucugugagauucaguguggucagguuguguggccaauuuuauacuucuaccagaauucugcaaaauugaggugacgcucaccccauaaagacacucacccuauagagguaguugucacacacacacacacacacacacacacacuguucacuuccuagcuccuuuccccuccaccuuucuuucagaguuuguucucauuuuucagaauucuucugcuauccuucucaaguggcccugaaugcccuuuguuagcucaauuuggugaugaguuaucccugaaccucucccagugugcaggaagaaaaacuagaaaacgccacaguaaaaggaaggaaggaacugagguuuuuaaagcuuguagcauagaccgagaaggugaccaugcgguauaguaaauguauucacuacacagaacacugagacucgucauguguguguaaugccugcuucugcucccucccaguguuuuaaacucaucuuaucuuugugguaguaauauuuguccuuaauaaccuacaaaacuaaaaagguacuuugauugacaaggucccucaagaacuuacacagccagcuuugaggaaaucuagacuguucugacaacagcaucuggaguuguaauuguuguaauuuucuuccuguacugucucagucuguguaaauaaccaguguaguggcccuuugauuuguuguugguguucuuuuuguuuccggucucugugugacccaccaguggcagggguuccagcuccaccuuuuuuuuuuuugcuugcaguuguccaucuguaggcuugucagacaaaguacaagaugcccaguuagaguugaauuucaggcacuuuucuagcucaaguauauuucauauuugacauaucugugcaauuuuuaaaacguucauuaacuuaucugaaauucagauuuugacugaauauccuagauuuuuguuuucuauguaguuuuuuaaaccugauaguccuagcaauugaucacaaaaggaggcucacagcauguaaauucucuggucuuuauagcguucaccuggaauggacgacccuuuuuuuuuuccuuugccuucuacuuauuucuaaaagagggcaucaaggaacuuaaccagccuacauggugggguucuauuuaaaacaucucugugauuauauuuaaccuguaauugugcuuuggcuuaaugucuacaguacuuguaacggauuaauauucaauaaaaacauuuuaaaguacac

SEQ ID NO: 4399 - RNA, 12442 nt, Mus musculus
uaagguggucuuggauagcacccuuaguggggagagguggcuggaaaguuaaagugagccacagauugcuggagcuggaauccagagugcugcaauccagugagcaggugagagggcugcuguugcguggaccaagccgagugccugccccacuuuugccgucgugguugcugucacugucacccagcucagaugguggggcgggcugaagggucuccccuccguacucaagagugguaccggguacguaccuccucaagccucuaguucaagguccagagccaggaaaucugcggugaggggcacgcgggggaguucuccgacacuuaccauuugucccacuaacacugacucccagguaguagaauccccuagcugggcucggguggcuugucgcuucagcgugcagaaacaucucaggcaccggagcugggauggagccuagaggggacccccgagaucccuaagcgaguuagccugcgaaacguguccugaacagaaaggaugucucgaguccuaacguggcacauccccaaccugagaugugacacuuuggaagauaauucuaguuuuuuguggcagaaucuggaguccaaauacaagcucccggggcuucaguuucccguuacgaaauagacgcgagaaacccgugucccagcccugacuccaucaaguagugcggaccagucccuacuacuccccacuuagguucagaucuccuuuugcugcacacaggcaagaggcacacgcugugucgucucgggucucggaaggcaaugggcucgaggcgagcuccacccgggaacggggcagcccgcgugggggugcucgcgaggcgcugcccccaucugggcugucccgccgccaggucccgcccugaugugauaacuugggcuccuccuccuuguucgucuccgggaacuaagcccaggcccuacccccgggacaccccgacgcucacguaguucaguggcagcaaucaacccugacacuucucucaggcucucccaugaggccagcgagcagcggccccggcugcggcgccgccgggagagguaggugcagacccagucuaagcuggggcgagggcgggugcaggcacacccugugucuggugggauggggacucgcugaccuucccccagggacuuguucacagcuaccguuuugaacccagaggagaggcucugaaccggacggcagcuucagaacaggggauggcaggcccacggggaaacagagaaaguugaaaaagacuugagugggggaacuugcagaguugcuggaauguggcccugucucagcuugcggguccaggagaaagaaaggcuucuucagccuaggcagggaaggaacuggucccuuuggcaagaacguccaggagccagggagaaaguagagacagcugaaguaaacuagggccauuuaggggaaaguuaguagaaagagaagcaucggggcccuauuagcaaccuugaaggucaaagcugcaagugaccucagaagaaacccuuaaacccggagaguucuucguuuguuaaagcucagcugggcagaggccuucuuaggccugagcuucuugcugucuuuggcccuuauuagcuggugugggcugccucauucaaagcuaccugacugcucauuaugcggcccuauucaaaaacauuucucuucaaggauugagggguguauacauuaaaacuguaauaauuagggucuguauacaaaagggggccaaugucaacuucauacauauaaaaguaucagcuagacauuuggggagagaaccgagauuugcugaaagggggggggaggaguggaugguggugucuugaauugguugaggauauuuaucuaauguaguguugcgguggguuauuguuaacuugguuuugacaucagcgaggaagaguugcagaaagaaggucucagucagaaacucagucgcucaacugccugaagcuaggcagguuguggguuuugguuuuuuuuguuuuguuuuguuuuguuuuguuuuuuguuuuuuuugguuuuugguuuuuuuuuuuuuuuuugguuuuuuguuuuuguuuuucuguucagacuugucaagcuuaaaagaaauauuacuggccuucuaaggcuggcagcaucuugaaagaccacauuauuucaguaggacacagaagguauuucugcaagcgucccaaaccuggcccaagcucucuucagaggcaguugacuucugaggcacccacgugaaagcagggugugugauuguucuugggaaacagcuccuuaggcuccugggauccuguccugcaacuguguccagguccugugucgcuuuaccggcucaaaugugcaucgguggucucugcuacugccuguuuccucgguagaaggaaagccuggggcaguguuggagacagaauaaggacuucaguacauacacgaguguguggcugugaagauguuuccucaagcaccuguccagcugccuuccuuuaggggacuuaacuauugguggacugucucgguuucuggaaaguacuucuaaguggccaucaucacugucacaguccuguugagacauccauagcugagagucaggaaagcuaaacucacacaagcacuuuacuacaccaguucuuggaugagcaugagguuaauaaaagcuggaauguucugugaggacaacccacugccacaucgcacccuugauagaggccacaaggguaaauguccuuaaccuguaaugaugaugauacccagagggaaaaaaagaaggguuuccaagccaggacugcuuacgcaauuccgcagggcaggagucccagugguaacuccugggcuaucagaagaaccucacucacauuugccucucauggaagaaucuugcaaaaaaaaaguucuugaaaauguuauugggacugucuccugagcucaggcucugaauagaaacuugucucuccaccgucaauucagcucguucuuacaguuuaauaauaaagggagcugccauggugaguuuacaugcuaggcuccaauaguacaacuucaccaauggccucagcucccgagccugcgggacuagaacacaagagugugcucuccugggugguaagugggcagcagagucuuuagcaugcuuugguauuccgccuccacuugagaauuucccaccauuuucuaccaagcugcuucagagaaaccuuucagcauuugcuaggcaugccugaggcuggucccagagcuuggaggaccugcagagggacucuaauccuugugcugacucaagucaggaggaaguaagugccuagcaggggugaacaccucucccccauucacucccagcuuuucaagggugggcaguggggaagucgggaauguggaccacaugccauuaugcaacugguguucaguuuuaaugcauauuuaaacagaauaagaaauaccuaccuuaaaguugaaaagggaagaauauuucuaacaacauuuugcaguggauaugaauaacucaauuuguuaaguuaugaauccuuuaaaaaaaauugaguuggucagcccauugaucguguguaaagcuaguucaguuagaguuucccucucuaggaaccgccuugugugugcacagcccugagaccagaccagaccagacccagcaaauucucucuggagcuuuuucucuggcuuacuuccuucacuggaagggaaguagugagauaugggcuuugcggguacaagcagaccuuagccauggccacuugggaaagugcacagauucagaggcaaaacaagauaaccaggcuucuuauacccauaagaccaaugcaucuuuaaaaaaggaaaggaaaagaaaggaaaggagaggagaggggaggggugggggaggggagaggggaggggaggggugggggaggggagaggggaggggaggagaggggaggggaggagaggagaggagaggaggagagagggaggcuuguucucuccccccuuuucucguuuuuuauuguuuuguguuuguuuguuuguuugguuuuuuuuuuuuuuuuuuuuugguuuuguuuguuuuucgagauaggguuucucuguauagcccugacuuuccuggaacucacuuuuguagaccaggcuggccucgaacucagaaaucugccugccucugccuccuaagugcugggguuaaaagcgagcgccacccggccagauuugagauuugaauccagguuugaucaucacuagcuucuucagcugagaccacuguuaaguguccuguaaaucugccuuuguaaggagaauaaaaaagcagacagcuuuagugaggugucagagcgguuuggaaaguuuucuuaagcuucguuuuuuucuuccugaucauagaagcaguauuguuuuagaagacauaaggaaacacaaagcaggaaacacuuuaaggaagcauguuauaugcaucgguugacauuuuuaaccuuagaaauggucccugcuaccuacccacaacacauacguaacaagguuccaggcagccacaagccccgaguacucugaauuuccuuucugcaguaucccccccacccccacccccacacagcuccagaggucaucucccuguuaaaugcccaagugccucauuuacauagccgcucuugugcuuuugggucauaaaauaaagugagcaaccuugagacugcaacugucugauacccgagauggcugaaaaagucccugaugggcugguggcaaauggauacaucauggcuauguuggcuaaggggcaauuggcuccugaagaaaggagugggcuggccucauguagcucagaaugaauggcgcacaauuuaaacucauuaguugcuuacucaugaaauucucaucuuaauauuuuugaaccacaauugacuaccaagagcugauuccaugggaaacaaaaccaagagcagacugugucucuacacaauuucuauauccauaaucuuuucucucauaucugguauuuguguacaacucugucugcucuuuuucacauuaacaauacaagaaaaaaaaaauagcuaggcacaguggcccaugccucuaaucccagcacucaggaagcagaggcagagggaauggcaggcagaucucugaauuuggggcuggcuugguguacauaucuaguucuagguuaaccagaguuauuuagugagcccucucucaaaaccaaaaauacaggcuggagagauggcucagagguuaagagcacugaccgcucuuccagaggcccugaguucaauucucagcaaccacaugguggcucacaaccaucuguaauggguucugauacccucuucugguguaucugaagaugacaguauacuuacauauauaaaauaaauaaacuuuuuuuuuaaagcaaaaguccaaaacauaaauaagaauguccaugccauuuaaauacuuuuacaaaaaaugaaauuagugguauaaaauuaaaugauauggauauggaaagauugauuuuuacgagguauccuuaguaggcauucucauuauuuuccuuucuguuaguuucauuuauauuuuaauuauuuauuuaugguauaugauguuucaugugcuauuggagugaaaaugauaagaacauuuagauuaugccaauuuugauaagaaaaaaaaucuuuugcauuauaauucuuuccuaauccauuagguaaaggcaggcauuucuaauauaaauuuucccuauguuugaauuuaacuaauuuacuguaaauaguuucccuauacaguccaggcaagcguugaccuugcaggcuuccucacucagccuuugggguagcuuggguuacaggcgaggaccaucucauccaacuuccagcgaauuuccuacauuacccuuaagacuggguaguuugcauaucugugagccacuuauaauuguuuuauccuaacaucugcuaaggcucuuuuucuuugcucuuucuccugugugaacuauuugacuuuguuccugcuuuguaagaacucuguauuugaaguuaauaacaccuaauugucauguuuuuugaaaaauaauuucccaguuuguaaucuuuugggguuuauauuuucacuuauagaaaaauaugguuuaaauuaacuuaaugucuagugugauuacaucugcuuuuuauuucuuucuuucuuauuuaucuuuguuguuuguuuguuucugaggcaguuucucuguguaguccagacuggaacucgcucuguagaccaggcuggccucaaacucagagauucgccuguuucugcuuccccagugcugccuuggccaccaccaccucuggacugcuuuuaauucuucugacaacuguuauuaccuguagacaaggcaaacaucugccuguaugucacgguaugaagcaaugaacgcucauccuuucucuaaagaaaggucugccagagcacucagaccucccguaaguuuggugacaguaacucuguguccacucugaccaacaggucucaguguauaauagcauagugcuugguaaacaccaagucaauauuuguguaacaaguuugacgcuuuuguacuggauuaagucaguauuuauuauucaggccacuaagagaucauacguuauaccuauuaggaugguuaucuuucaaaaagauaacgcagccacuacagaaaauaccaugguguuucuuuaaaaaaaaauuaaaaauaaagugacuagggcuggagagauggcucagugguuaagggcacugacugcucugccagagguccugaguucaauucccagcaaccacauggugguucacaaccaucuuguaaugggauccgauguccucucuucuggugugucugaagagagcaacaguauauuuacauacauuaaauaaauaaauaaauaaauaaauaaauaaauaaauaaauaaauaaaucuuuuuaaaaagaugacuacaugauccaccgacuuuagggugugcauucaagggauaggcaaucaggauguugaggugacauuuauagucccguauucauguagcaauacucagagcccagauaugaaaccuagcuaagugucucucaggggaugaaugcacaaagaccauguggugugcauagacaguggagugcuugauguucaaucacagacaagaaugaaguggcgucauuguugaggcauggagaggaaccuggcgggcaccgcgcuaagugcaguaagcuggcuacagagagucaaggagaccaauucauguagaaccugaagaggaugagcucacugaauauguaauagaacagcgacugcaaggugcagcaccccgagaaacuggggaacuaucuauccaaagauaugaaucuuuaauuccaaaggagcacauucaagagacccauugcaucaucacggaggccaucauuaauaacaguguguaucugaaaauugcuuaggguagauuuuuaaauauucucaccacaccucccaaguacgugaggaaaugcauguuaagugugucagccaucccacaauguguccauacgucaaaacagcaucucuauugcauuuauuuauuuauuuaguauggguucuugugcuccacgcagcguguguaaaagucagaggacaacuuguggguacugguuuccucuaucaacaaugugggucucagggauuucucugagcuaucucaccagucuggaaauauagaaguuuuacuugucaaauaauagucuacaguguauagcaaaaacuauucucagaucaauuguucguugggucuauacuccaaaaggggguggguaucuuuuggucaaauaaguaaaucugcaagcaauaggaaaccauauucuuuuguuuucaagaaaggaucucucuguguagcccugaaacucaaucuguagaccaggccggccucgaauucagaauccacccgacucugcuucccaagugcuaggaugaagggcgggcucccucauggaccugacagaaaacucugauucuuaaugccuuucauucuucucugugguguauuagcauccuggcagaaaagccaauggauuagccuucaaacuguugaaucccauagucuugucuuuguugguuuuacccuuagcuucuuuuuccauccccucccccagccucuccccccuccccccagguuaugcucccuuccacacagucuuugcagaaaccuggguccugugagaccacaggggagcagagagcccagaugaaaggcaacauuguuugccugucccugccagaaugcggguuuaagcaucuaucugaccucuuugcuguuuucucucaucuccccuuucccagacugcuagccggcucgccuagcgugauggcuguggacauccaauacagcuacagcaguauggccccuucuuuacgcagagagcgcuucaccuucaagaucucccccaaacugagcaagccccugaggccuuguauccagcugggcagcaaggaugaagccaguggaaugguggcccccgcagugcaggagaagaaggugaagaagcggguguccuucgccgacaaccaggggcuggcccugacaauggugaaaguguucucggaauucgaugacccacuagauauucccuuuaacaucaccgagcuccuagacaacaucgugagucugacgacagcagagagcgagagcuuuguuuuggauuuuccgcagccuuccgcagauuacuuagacuucagaaaucgccuucagaccaaccacgucugccuagaaaacugugugcugaaggauaaggccaucgcgggcaccgugaagguccagaaccuggccuucgagaagguugugaagaucaggaugacauuugacaccuggaaaagcuucacagauuucccuugucaguaugugaaggacacuuacgcugguucagacagggacacauucuccuuugacaucagcuuacccgagaaaauucagucuuacgaaagaauggaguuugccgugugcuacgaguguaacggccaggcguacugggacagcaacaaaggcaaaaacuacaggaucacccgggcugaacuccgauccucuccgggaaagauugagccguacaauggaccagauuuuggaaucucuuuugaccaguuugggagcccucgguguuccuuuggccuguuuccagaguggccuaguuaucugggauaugaaaagcuggggcccuacuacuagugacugcaggugacaguccguggcucagaucaagauggaggcgagagaacggaaggccagaggaaaguugaacugccacuaggcgugguuuuugaaaagacaggcuccuguucaccuuuuucuuaaaccagcaaguccagcguguuuccaucacacccgguuucuugcucagaggaguggagcggugcugauccucuguggcauccggguuggccacaagggaaugcgcaggauggugccagaagggucuggagaggagccaagcuggcaaggacagaggaagcuggccucucuuccacacuuggacucugaaagucacccagaaaccaaucuccagccuuaccauugaccucgagguccuguccccgcucauggcuuuccaugcgucuccuucauuccacgaguacuccgaagggagccaccucaguucugggacacacuggccugauugauacccagcagccucagaagagggccgggggcgggcgcuuucugugcgagcucuuucacuacacuuccucccgcuacagucuauccagugaucuggacaagagagacaaagcaaauaaguagcucgugucugggauaggcauucccuccccccucucuccuccugaccccuccuuuauauuccagaagagagcaacauauuaguuacuagaaagucauugguucccauguggggucacaggguacagcacugggacaaggugggacagucugaacuuuuagcuuuuccucuuggauguugggggagcuuuugaagcaccguuucacccggaguuaccagaagaggacucaaugacaagaugcauuuccacuugccuggccggugugugugaacuguuuguguuugaagagagucauagcucucaugucuccuggagccuccacuucagugccuugucugaggcuuucaaauagcaagacuggcaucuccucgaguccuccagacugugcuuagauauauauucauauucaggaugcuuuaugaacccccaaggacauugaucggguguuuuuauuuaugguguguauuauaaaaagauaggggagaaaaaccucacguuuuucuauguuauuuuaaauguuugucaacucugagguaucagaugaaguuuucuuaaccauauuggagugcaaugcgcuuucauacgcuagcgugagacuccuggaguucuuacccuugggugaacccccaaacccugugauuuuucucuagggcaaauuagaauuauaggggagauuuuuuuaaaugcgaguuuguagaauuagggguguuguuuuguuuuggaaguuugauaaaagaugccuguuucauuuccuuacugaagugauguuucccugagacaagacagaaaggagcagagucucaugguuucggaggugggggccacuggacguagcccugugcccucuggcuuuauaaguuagcaucaggcagacaucaaauguuuuuaauccuagcaugugugguuuauuuuuuaucuuaacuuuuucacuuuugaagauucaaauguuuugacuuuuuaaauguuauuuucuaugauuucuuauuccuaaaacugguacuagucuguaaucugugcuuuguauauugugccucucccagauggguggcgaucugggauugcaugcugauuaucugugaggaaaucaucuuugugccaugaggcugaagcuggggccaggaguuuguguuuuaucuaagcaggccauguaucuccuagauggguguacuuuaaauguuccggauuuguugaccagagcagcuagguugaaauuggauagaaagcaaaacugcucucuaugggucaugcauuguguguuaagaaggaaggcagccaagggcacuguuucuuacauagaugcagacuaaagaucauaaaauggcugggggcgggggcgagguacggaauggaaucuguucagugguauggaugaucuucagacauuccgagucaaaauauaaaauaugguaauuccauguuauaugucccuccuaaagcagacauacccucacccccuuuugcccagauuugccccagcuuucuugcucacgagcacugcuugaaagccccccagccagcacaccuggggugcacacccacugcucagcuccaggggcauguugugccuuugccugcucaccaggacccuucccuugaagcaguccgugggcugugcuugacuuccuuaucaaggcugucacucagagacagaagagucuuccuucugcuuucugccuccaauacagcccuccuucuuuugacccagucugucccaugacucugagauagccucgggagcugcauuuagaaacucuaugcauuguucagaguucaccacuguagacaaauuuacgcagcucagaagacgacaggccccuugcuugaagaucccacggcaaguuugaccuggaggucugucuucaugcaguucuuggcuaggaugauggauggauccuaauccccagacauugugauccaggaagggaaggcaaccccauucuuuguuccauauuuauuuccccaaauucccuggggugcuuuggcaaaauggguacaauaaauaagcuagaccauaagacauguuucuuguaagaagccguuugaguguuguaagaauauuuucucuagaaagcuaggaaggcauaauggaagucuguaguucugcagaaacuaaagcaacuugagucaauggugggaguuauuuuaucccugagauguaagcuugguggcuccugauucugggaaaucugcacucagccgcaucuccuggcaugaucacagaaacugcagauaagauguucccgaaauucugggaucuuaccucuaacgggaucguccagagucacucaaagacauuucucuugcugagguucugugagaugccuccagcuccaucagcaaagcugugaguguuuccacgguuuugcugcaguucccagaggccccuggggcacguggacuucuagagugcacacgugaugauguuacacuuuugcuuuaaugugaacauucaacugacgggcuugucgucauuguaugccuacaugugccuuguucagaaacuucugcauguuuguaagacauauuuuuguauacauugguagaggggaaaugcacuuuaaaaaaaaucacaagaauggaugugugugugugugugugugugugugugugugugugugugugugugugugugugugugguggaagagaaugauuucuuuguaucucaaaagcaaaaacguaauaaauauagaaagaaaagaaaau

SEQ ID NO: 4400 - RNA, 1868 nt, Mus musculus
accggacucggagcugguuucgauuagggacagcggcugggcgagagggcggagcgguugggacgcgagagaggaggggacuuggugugagaggcucaguggggacaguuccgcgcgagagacaaagagcgcccagagagcgcagcgagcaucgcugcuacccagcccggcaaccucgcagauucgaggacagggugcgcagcggagcagccacagcugcuagggacccaagaggcuacgcaggaugcggacgccgguggugaugacgcugggcauggugcucacgcccugcggguugcugcuuaaucuugucaguacacuggccccgggcuggcggcuggugaagggcuuucuggaccagccaguggacguggugcuguaccaggggcugugggacauaugucgcgagcagagcagucgcgaacgcgagugcggccagcccgacgaguggaacuacuuccagacccagccugugcagguggcccggggacucaugaucacgucacuggccacuaccgcccuagggcugcugcuggcuucccucggugugcgcuguuggcaagaugagccccacuacgggcuagcgggccucucuggcgugguguuuuucgucgcuggccucuucagccucaucccggucuccugguauaaccacuucuugucagaucccgacguccuggccgccccgagcucgccggucacggugcaggucagcuacagccuggugcugggcuaccuaggcagcugccugcugcuucugggcggcuucucucuggcgcucagcuuugcgcccuggugugaagagcguugucgccgcugucgcaaggcgcccccagcaggcccgcgccgcagcagcaucagcaccgucuacguggacuggccggaaccagcgcucacaccugccaucaaguacuacagcgacggacagcaucggccuccucccaccgcagagcacagggacaccagcaagcucaagguuggauucccgaugccacgaccgccacccaaguccuacaccaacccgauggaugugcuugagggagaagaaaagaagacagccaccucccaaggugguuccuccucucgcagcacucggcccugccaaaauucgcugcccugugacuccgaccuguagacaggguucaccugagcucugccuggagucugagggugacuugaacuucugccaguacaucugcaacuagaacccuggucgccuuccucuaacuggagggcaagccuuccuuuucuagggccaaacuccucuccaaauacuagguuggguucauuuaucuuuuaaggaguuuuacuuuucucuccagagggaccaggucuucuuaugcagugacaagagugcguaguguuuucuuugcauacuguucaucgcaguagcaacaaaauugcaaucagccaacaggcuuuaaaacgucccugaacguacaguauucuaaguuaccgugagccuucacaaacaucauucucgagguuuuuugcuuuucucccugcuucagucuccagagaacauaaauggccaaaaauguuaagucuggcuauauuugaagguuaugacauaaagccagcagcuuuaauggcuuuuaugaagugaagugacuuguuuaacuccuauuuauauuucucugugcauauauaguauuuaucuuuucuaaucacuuguuucuguguaggagguugagcuugucuuccaaaagccaaggcgaugcuacacuguccuguucccgagauaccucgcccugaacagagauauauuuuguacaaaaugaacuguuaaguugccuuuggcuaacauccauauguauauaucuuauuuauaaauaaaaauuguaaaugucaguuucgguaucccuaca

SEQ ID NO: 4401 - RNA, 2285 nt, Mus musculus
aguaaauaguuuuaauuacagcaaauuauauaaaaaauacauuuccauuguaagaaauauauagaacagagaaaaauauguuaagaaagcauuuuucaaggaaaagcaugacucucgcccaauauaaagugaauauguucuaaauauguaaagguauuuaaggagaaugugaacagcucauaccuagaccaacaggaauguuaagaugaguuugacaggcagugccaaaguaggugguauucaaugagcaaaacauauuacguuauuguggguaauuauacgcucauuauaaaaaccuuuuaaaaaagaaaccuaagcacguggauuguaaacauuguauucugucaaauuggcuaauuaaaggcugcacacuaaaccagugacaucagggaucacuggcuccugccuuugccgaugcagauuuucaagcugucguuuuuaaccaaucaaggugaauaucgugcuccuucuaauuauauuucauugguuacaaauuugcccuuuuccaugaaaauaaaaaaagcuaauugacauucuuuggauaauaaccaauuauauuccauccucgcagaaccucuggguuucuccaauacaucauaggcccgccaaguucugaacgggaaaaucgagucagccucuuauccacuugaaaaaaaaacgguuuguuauuaauuuuuaaauguauucacuuuacaucccaaacagcuccccuucuccucccaguacccccauuuaguuccuucccucauucuccucugagaagggugccacccccaccccccaacacacacacauaagucacugcaggacuuuacaagacugaagagaaaacucuuucgcaacucuucaacccagaaauacucucccuuucauaugaguuaaacuucaggcagagcguggagacuuuauuaagcaagucuagcaaaguuuccauaaugcaacuguuuggauacacccugagccuggaaaccguggugcacacaggucccgugcauccugagcgcaccacugugcccuacguggcugcagauggcagcgcaaaacuuucgagggaugcuggucaccagcugggagugaaaagagacuuguguuggcagggcccacgggcagaguuggggagaauuggaggcaguguagggacgcuuugcuuucugaccggaccugagaaggaaagggaagaggggaagguguagcuaggcgacaggugagacgacacuagcggcccgcccccuuugucccgccuacaagcgcgcaggcagugcgagagagcgagggcggggcgaccuuugcucgagcccuaaaccauccgggcgggcugggaggaguggccgggcuaggaggagcggcugggcuagggugggguguccggguccucagaguccgaggucgccuccuugccaaguggcccuggcgcucccgccccucccacccgguaggguuuggccuugggggccgcaccugggcgcgcgguuucggucugaccggacucggagcugguuucgauuagggacagcggcugggcgagagggcggagcgguugggacgcgagagaggaggggacuuggugugagaggcucaguggggacaguuccgcgcgagagacaaagagcgcccagagagcgcagcgagcaucgcugcuacccagcccggcaaccucgcagauucgaggacagggugcgcagcggagcagccacagcugcuagggacccaagaggcuacgcaggaugcggacgccgguggugaugacgcugggcauggugcucacgcccugcggguugcugcuuaaucuugucaguacacuggccccgggcuggcggcuggugaagggcuuucuggaccagccaguggacguggugcuguaccaggggcugugggacauaugucgcgagcagagcagucgcgaacgcgagugcggccagcccgacgaguggaacuacuuccagacccagccugugcagguggcccggggacucaugaucacgucacuggccacuaccgcccuagggcugcugcuggcuucccucggugugcgcuguuggcaagaugagccccacuacgggcuagcgggccucucuggcgugguguuuuucgucgcuggccucuucagccucaucccggucuccugguauaaccacuucuugucagaucccgacguccuggccgccccgagcucgccggucacggugcaggucagcuacagccuggugcugggcuaccuaggcagcugccugcugcuucugggcggcuucucucuggcgcucagcuuugcgcccuggugugaagag

SEQ ID NO: 4402 - RNA, 501 nt, Mus musculus
cuuuuuccccugccgcugccgacuugcacggaggcggaagcucgggugcguucaagauucggcgucacccgugauucaccgccauggccgaggaaggcauagcugcuggagguguaauggacgucaacacugcucuacaagaggugcugaagaccgcccucauccacgauggccuagcacguggcauacgcgaagcugccaaagccuuagacaagcgccaagcccaucucugugugcucgcauccaacugugaugagcccauguaugccaagcugguggagcaccaaaucaaccugauaaagguugaugacaacaagaaacuaggugaauggguaggccucuguaaaauugaucgagaggagaaaccauggaaggugguugguugcaguugcguagugguuaaggacuauggcaaagaaucucaggccaaggaugucaucgaggaauacuucaagugcaagaaauaaauaaauuuuggcggaaaaaaaaaaaaaaaagaag

SEQ ID NO: 4403 - RNA, 1242 nt, Mus musculus
uuuggugcauugaacuuuauugaugguauucaagagaguagggagggcucccuaggccccuccuguuauuaugaggaucugggguggaaauugugagggagaugcucaguguugggggccgaguuaggauagggacuccucagcaaccgagggucucucucuugcucucaguguccuugcuggggugggugguccaggguuucuuacuccuuggaggccauguaggcgaugagguccaccacccuguugcuguagccguauucauugucauaccaggaaaugagcuugacaaaguugucauugagagcaaugccagccccgggcaucgaaggaagaggaaguggaagagugggaguugcuguugaagucgcaggagacaaccugguccucaguguagacaagaugcccuucagugggcccucagaugccugcuucaccaccuucuugaugucaucauccuuggcagguuucuccagguggcacaucagauccacaacggacacauuggggguaggaacauggaaggccaugccagugagcuuugaaggccaugccagugagcuucccguucaguucugggaugaccuugcccacagccuugguagcaucaguggaugcaggaaugauguucugggcagccucauggccaucaugccacagcuuuccagaggggcuauccacagucuucuggguggcagugauggcauggaccauggucaugagcccuuccaagaugccaaaguugucauggaugaccuuggccaggggagcuaagcaguugguggugcaggaugcauugcugacaaucuugagugaguugucauauuucucgugguucacacccaucacaaacaugggggcaucggcagaaggggcauagaugaugacccuuuuggcuccacccuucaagugggcccaggccuucuccaugguggugaagacaccaguagacucacgacauacucagcaccggccucaccccauuugauguuagcguggucucgcuccuggaagauggugaugggcuucccguugaugacaaguuucccauucucagccuugacugugccauugaauuugcuguggguggagucauacuggaacauguagaccauguaauugaggucaauuaaggggucauugauggcaacaaucuccauuuugccauguggagagcagauggcagcccuggugaccaggcacccaauauggccagauccauucacaccgaccuucaccauu

SEQ ID NO: 4404 - RNA, 1876 nt, Mus musculus
cuggccucaaacucagaaauccaccugccucugccucccaagugcugggauuaaaggugugcgccaccaccgcucggcuuuuuuuuuuuuuuuuuaacuuuuuuuuuuuuuuaaucugaauuucaagcuagcacgguacacauaaagguuuuagaccagucauaaugacagugaaacccuauggauaaaugcauccuguagaccaggaagaaggaagacacccaggaacgacggaaacaugaccaucgcuccaaaauuccacuggguaaaaagcaagcuacccuccagugcaguccaguuauugauguugauuucuggguuucacaguaaaaagcacacacaguaucacaagugugcuuccucugggucaccaaggggcagaagccauuaucccaacaggauuaucaucaucaucaucaucaucaccaccaucaucaccaucauuaucaccaucaccaucaucuacccaauuccccugagcucugaagaggaaacgcuaccgccggguaggccuggugaggguggggaguuauagcuaacuaguuaugcccuuguucccgaggugagagauugacuucaacauuuucuaacucauaaucacugguuuuacacaaugacacagaauuccuaauuccuaaggcaucccuuuuuuagggauaacauuuacagcagcuuuucaaaaacaacugggaacgcuaucucagcauuaguauuuucuuccggaggcaaggguuagauuacucuuacccugaugaauaauauaugcugacccagcacacaguuucagcucagugacuaacaaagaugugcauggaccaugguauuccaagcuuauacuucuucaucgguagacagagggaugaccacacagugaagacuaaccaugaauaugaaugcgaauuacuaaacagaacccagaccacauagcccagccuuugggggacucagaguuuacuaaacaauaagcccaaaucagagaauguaucuguaggaaauauauaauaugaaacuuagaaaugugaaugcaaaguauuauuucugucuguuacgccuacguggaaaagcaaccaagcuauuuuagucaguucuaacuuccuuuaaggucacuuuucugauccaaaugaacaguucugucuucuaaaaacauccagugauggcuuggaggaggaauccaagaacucaauuuucucuuauuugcucgaagguuuucugaaggaacugguucuuaaaagacgauaguuuugcugacgacagaaguacagucugaacccaacuuccggguuggguuuagaggcaggaaguacaaauauccagguuccaaauggaccugugggcugcuacccuccgaauguaugcguauggcuuguuaaccuggcacgggcaggacgaggugggaaaugacugccuagaucucagcagggcgcacuucagagucagcuuaugcuuuaguugacgugggcagguccccagguaccaaaccgggagaauggaguaagaaaggggcuggaaauuggauuuaccaaaaccaacaggcacaagaaggugccacccaguagcacaucagcaccccaaacggacauaacuguaggaaauggaguucuuaaagaggaaaacaaaagcccaccgcugcaaauccaauuagcuuuaucucuaggagagcuguaaauuagaaaagucacaaguccuguugcagcuuccaucuccaacgcccuuuuagcaggucaggaguucugucugaaggcaagaaacuccaccacauuaaggagaguguuaaacaucaaauaaugggaugaugagaaauuucagauaggcugugaaauugagggacaguaagcuacuccaggaugucaaaaucaagagucacccguauguuuua

SEQ ID NO: 4405 - RNA, 1221 nt, Mus musculus
uaauaucuuuccacaauugugcuggcucguuuuaugucaacuccauacaagcuagggucaucugagaggacggaaccuaaguugagaaaacacuuccauaagaucuggcuguaggcaaaccuguagggcauuuucuuaauuagugauugaugggggaagguccugccuauugugggaagugccaccccuggucugggguucuggguuccauuaaaaaaaacccgaguaagccauagggagcaauccaauaagcagcaccccuccaugcccucugcaucaacuccugucuuuagguucuugcucuccuugacuuccuguccugacuccuuucacugauggacuaugaugugaaagcacaagccaaauaaaccauuuucucuccaacuugcuuuugcucauggugucucagcauagcaguaguaacccuaacuaagacauuuagccugaagaugagguugucaaugaugcaggaacccuggucugaguggaaaaaaaaaagguccuuugggaaaccucauucugaaguaaaccuacaagguauaaagagacagugaugagggcaagcauaauugugugaagucgggaaccagccucugugcuacaguuaggguguuggcuaucucucagaggccacugcauuaagauuguuucccaggguggcucugcugggagacagaggagcgagcgucuaagcguggggccuacuggggaggcuuugagucauuacaguuguccuuuuaaggaacugugauaucuauucccuuauucauuuuguacuuccugggucacaguggggacagcuguccccacguucacacucccaccauaauaucacaugucaccacagaccccaaacaguggcugcucauguaaaacuaccaaaaacggcaagcccaaauguguaggucaauuguuuuaguguuguguuacagaaaaugcaacuaacacgcucuggauuacaggaacacuauuggcucauuuuuuuucuuuuaauuauuuacacagcagugcuucauugguaagugccaucagcauuucaaguagagaaaggaaaaacaagcucucaaggaaacggaagugguuuugccucuggaauuucaugcugaacgagugagcgagcgagcgagugagcgagcgagcaguucacaucuggccugaagaugagguugucaaugaugcaagaacccuggaagcuaaaauauuaaaaaaaaaagaaaaaca

SEQ ID NO: 4406 - RNA, 23536 nt, Mus musculus
gauacaaaggggucagagugccaggcuuuauggcccaggcucugggcuggagaacugauuuauggaucagcuggccuuacugcaacuuugaacacuaauaaaaacuaaaccaaucuuuugagaacacacacaccaccuagugaaguccuguuacccaaagaaaauggcucaaguauucaacacuucuaaauaagagccccaaaaccaaagccaucagucacaaccauauaggaaaacauuuuugaagccuuuauuuacaaaagcuuuaaaaacaaauaauacccucuguuuugcaaauaauguuuaguuuaaaaaggaccgcccagguacagcauuuucauaucauguuuacagaauguacaagggaaacgaacuauguugcuaacaguuggagacuugcuaauaucgauugaaguguagauaacacacauuacaacuuguaguccaucacuucaggguagaguuaauguucaccaaaaucuuccaacacaugcucuggucuggucacauauucugcauggcuaaauauuucacagucucuugucaauauauauaaaauagauugcaaagauauacacaaaaaaauaaacaagcauuacacuccucagguaauuuuauuagcuauauauguguguauuuauauauauuuuuugcauuuuguuguuuugcaccaaaucucuccauuauuuauuuuuguagcauuuaugaaaucacauuuauuuuguauuuuuauugauauaaaauguaccuuaagacuuguuaucuuuggacuuuaaugaaauugauuuguguaguuaacaaaucaagaacaucauaaauauguuuauaaaauaaaacaguaaggguaaaagugauggaguaaaaggaagccgaucaagggaggcggugcugucauaaaacuggagcuccaacaucuuaauggccagccuucuggcagagaggagauagccaaucacagggcuucuuccugaaggguguaaagcugguuugaaauucuucagucacauagcagccuaugcaugccaauuagaaaccaacagacaugagaugugcuuggaaggcuaaacacuacacacagaaacaguaguuacuaggcucuucaguaguuccuugucuuuuucuguuauuccuguugaacaauuugcacaaugcacgugcuguacucugaaugucaaaaacaagcaaauacuguaaaaaggugguagaugguuauuuuucuagcuaagagcaagaaaaaucacaauuucugauaaaauagaggauugaaaucacucucuaaagugcaaacuugaugguccacaaucuuaaauaccuauaaguacugcagaauagaaggagaggcauggaagagggaaauaaauuacacucaaugcuaguuaauuuaggaaaagggaaaaacaaaaccaagcucaaguaggcaaaguuuaucaaauuauucaguaauguagcuuugucacacaagcuugauaagaaguguauuaaauuaaggccagauuuaaccugaauguacuuuaauuuauuaagaucauagcuaagaaaggccauacuuauuacugaaagcagagaaggucuacaaaaggggggggguauugccuauuauuuaagggaugauaaaaccuauauacaagcauguguguaacucguauaaaauaaaaauaagaagacuauuuccugucaugacugcuugcuggcuuccucuucauaugcauucccugugccguucuguacauaggaugagccagaaccaaggccauauaagugaccacaguauuuggcaucaucaaugugaucuucaaagaacaucuaaaaagaaaauuuugaaagaaaaaaaaaucaucuuaagcaaaugauacaaccuguaguuuacaucucaacacuguaauugcuacuaacucuuucugugauguuccuuugagaagcuaugcugcauauuuaauaaauaagacugacugaugcccuuaacuacaggccuaaaggacacguucuaaaaagcaaaaauauuuuucguuaacauuuaccucauuuuaauaagaacuuaugagcauaaaaaacauggcagacauuuucauuucuuuaacauaacaaacuucacagaauaugagaaguaaugucgagaaggggaggagacauuauaccaucuuagguugucuuaagucuaggugcaagggugaacugacuaaaauuaacaaaauccuaagcaugguauagacaguaaaccuuaacacucucacuacaucacuguccuugaagaagacaauaaaaaggaaaauaaggauaacaaacuggugccagaauuccaccacugacuagccauaagacauuuuaaaauaaaaauccagcuaggcagugguggugcacgccuuuaaucccagcacucaggaggcagaggcagguggauuucugaguucgaggccagccuggucuacaaacugaguuccaggacagccaagacuaaacagagaaacccugucucaaaaaaacuaaaaaaaaaaaaaaaauccaaaaggugguccuauacugaaacuaaguuaguuacgugaguggacaauucaaauaacuucugaaucaauacuaccuggcaaaacaagucaaaugcguucugucaauagcauguuuuuaccaagagaauauacucaaaauaauuccacagcaacuauuucauaaaaauguguuucuguaggcacauuuuauauauauauuuguaccauuuauaccaaacuaaaauaggacacacacacacaguguaccaaaaauagaauacauguguguguguguguguguguauauauguguguguguguguguguguguguggguauacaauuaaaauuuguuuauuauuaucagcaaugaaguaaccacgacaucuaucaccuaguuaucuauccuaaaaacacucaguuccacuacauaucauccuucuacuccuaacaauuuuauacuugaauuccugauaguuuugacucaacuauaugucagacuucagauuuaauuaauaccuauauauucaaaaagccuuuaagacuuaguaaaaacuguuaaguucuacuuuauaaaaccuuuaaagcaaugaagaaugacaugagcaaaucuauuuucgccaccaguuucuagaaaaagaagguacgacucccuggcucguauggggucuaagaaaguugaguucccucacuauuaccuuuuuagcuuaaaaaacagcauguucauauguacaugaucucuacaaucaccuaauuuuuuauucuauaaacaacauauuucaguagaauaaauaauguuuuuuuauucuauaaagaguuuauucuauuuccuuuugcguuacauuucaggaggacuuauuuaacauuuucauucaaaugugguggauguaacuuauauaguaccucuauuuauaucuucacuuaguagguucuuaaugcccaaaacuuuugucaucagaccuuuaauguucucuaccuaacaaccaagaaaaaggcacugaugucuucauacuucucucauuuugaaaaaggccauuccuguaagcagugagucagauccugccuggugcugagggccuaugcgcuccagcucuaacugcucagcaacuuccuguaauccacccuagaaggaagaaaaguugcuugucaaauagagaggacuuugggacuggaauucacaauuacagauuuagacacugacaaaaauaugaauacauuuuuaauauguaaagaugaaccuuguaaagauggcaaggggauugauaaaauaugaaucuguaauuuaucuguggacuauaaaagccuuuuuuuaccagaauaugaaauucuaauaggaaaauuuuauuuuaauuauacaucuuaaggcaaguuaagcaugccuuaacaacuuuccagagauaugaaggaaguagaucauauucaggguaacaguaauaaaccauacucagugucauuaaaaauaucugcauccccuaaaguauuuaaaacuuaguaaaacaaagacaacaugaguguucagaccacugucauugucaaucuaccacauaauuuccauuuucucaacuaaaaagagaauuuuacaaauauacaacucuuuuagaaugguugcucugaucugcuuauauuacuauagcuaugacugagaaaaauaacgagugucaaaggaaaagagaagaaauagacagacacagaacagacuaccaaucaacuuccuccuuaaaauacaaagccuuuacuauccuguagucacauccuagccugacaggacuccugccagcaacgguuucuaacauugugugcaccaugcauccuuggcagcugcuuagaacacagcagcagacuagauaugaaugacugguagcaccuuauugcuaacauacacuuuuaaugugagcagcucacauagcacucaauaaaauauuugauauuuuuagauauuucugaauauauagaagaauaaaaaauuaggacucuguuucugaaaacuaucauuauaccaagcugucaauuaaaaaaacaaaauacagccgggcaugguggcgcacgccuuuaaucccagcacucaggaggcagaggcaggcggauuucugaguucgaggccagccuggucuacaaaguaaguuccaggacagccagggcuauacagagaaacccugucuugaaaaaccaaaaauaaauaaauaaauaaaagaaacccugucuugaaaaaccaaaaauaaauaaauaaauaaccaaaacaaaacaaaacaaaacaaaaccaaaaacuuccagagccagccaggugggagccuuagauucucagcaugccacucaucaguguaaguagucagaauacucugcuggaguucacuuaugaggaaaccucaaaugacacaggauucugugacuuucaacugacagucaugagauaaucuuucaagaaguucuccuaguuauuuggcaccacaccuacaacagugacaaauuacuucuguccuacaauucucaguaaauuguugaaacuaaagcuuccacauuauaauuccucuauucuugcuuaagaaaaacuauuaaauuccuuacuguuuccuaaagcaaagcucugucuguauuuuucuaaaaccuagauagggaaaacuuggccaaccuugguuuuacugaagacagggacaauauuggcuacacauacacuuguuuccuuaguuauaacuuaacauaucacaccaaaauccagcaacuaaaaacccacucaguguauugccagggaucugugccaacucaggggaauuugcucuugagccaaaguaguacuuuucuuuaaucaggaaauguuuguuuugauaaaauuaauguccaaagguuaaaaauacauggcuacauauguucaguauuaucagaauaagcuacugucuauauagaaccuacacauuuacuauauaguauuuaugccuaaccaguuuuagcuacgaaaauaacaacaucauacuuuaacaagaaagaauaaaggagagucucuagucaggauaaucugaaggaaaaccaccuuagaacacuacugagugucucugcccccugcuggccaaccccaaucuguaugcuugugauaguucugugugcugggaguaugagaaccucuguaauacagggcucugucaguguacaccucacacuuucauuucaguugaugacccucaaucuggcaucaauaacaaaaacauggcccuuagcuuggcuuuuguuaaaaauuuauucuggggacuaaagaguuggcucagcagcuaagagcacagcuguuguggaggaccaaauuucaguuucuagcacccacuagguggcucacaaguacccauaacuccaguuccagagggucugacacucucucuuuuagccucugcuaccucuugcuguaaacuuccacagaagugagugagaguguguguaucuuaaauauauauauauuuuuaaaagauuuauuuuauuauuauauguaaguacacuguagcugucuucagacacaccagaagagggagucagaucuuauuacggaugguugugagccaccaugugguugcugggauuugaacucuggaccuucggaagagcagucgggugcucuuacccacugagccaucucaccagcccucuuaaauauauuuaaugcaauuaauauaucaacauuauucugggcuggaaaaauggcucagcagguaagauaacuugguuggaaagauagcucagcagguaagagcacuugcuguuuuugcagaggacacaggcucagccccaacacagcauggugguucacaaccauccauaacuauaaucuaggagaugggaugcccucuucuaaccuccucagacagcaggcacacauuuagugcauauacacaugcaaguaaaauacccacauacauaaaauacaauuuaaaguaucuacaacaagacaaaaauccaaccaaggaaaacacaaaaccaaaacaaaccuuauccuguuaagauaaauaccgcagcuuugaagagagauuguuuauuaagaauaggaucagauaauuuaacuaacuuuuuucuuuuuuuuggagacaggguuuuucuguguagcccuggcuguccuggaacuuauucuguagaccgggccagccuugaacucagaaaucugacugccucugccuccuaagugcugggauuaaaggcaugcaccaccacugcccggcuuaacauaacuucuaaaacaugguuuaaaacauucaggccuaagauauuauagaaauuacuuggucuaaauugugcuucucaaccuuccuaaugcugcauccuuuaauacagcuuuguuguggugaaccccaaccauaaaacuauuuuuaucgcuucuuaacuaugauuuuucuguuaugaaucauaauauaaauauuuguguuuuccaauggucauaauugaucccugugaaaggguuguucaacuuccagguugagacucauugggcuaacuaaugugcuaguuccggauaaagucaucugaagccuuacuuugagauuuuugcagcucuucaugagguacuucacaucauaaaugacaggaaaaaauaaccgaaggaucucaaagaaaucaaguucuuccucaggcaaguuagaguuggucagaauuuugauuaaauagccaaagucauaaccacuaauaaaaagauuaaaauaauucagaaaaaaauacauuaauaccauacaaugaaagaaauuaguuuuucagauagaaaguuaaacaagucauacuauaggcaaaaggauuaacaauaacguacacacaggaacaaugaaaagaaacacguccauaacuacagugcagaaacugaucacucagcaucuugaacacaugauaguauaaauuuaacucuacagucacuaaaauaacauuuuucugauauguaagcuggagagaugauguucaaacaugaguauuuuugacccccaauacccaaguaaaagcugaguguuuuaugucaaccacacagacaugcaagugcacaccccaaaagauagguucaguaaggucacugccacagugaaugggaagguaugugaaaauguaauaaaccagcaagacuuaacaugccaaaggcaaaaaucauguaaaaccuugucaccauuuacaugagauggugacacuuuccaauuucgaagaauaaaucccuaacagaguauuucauuuccacuaagugacuuaauuaagauguacauuuccucaaauguuucuaugucaguauaacucuccgagacaguugucaauggaaaaguuaaaugugacaggaacuaaggaaaaguaagaacugguuuuuuauacaauacaacccccugcucccucaaacugacgucacacauccuuuaucacgagucuucccacagcggccuaacuccuuccccuccugaaguccuccugugaagggccugugccagccuucccugaagcccaaccccagacaucuccguacaacaagcguuugcuggugcugaccuuuagguucaugaguuuccuccacuggguuaaaggagaggaauuauagcuauaaaguaucuuuuucuuaccuauaauuuaaacucauuauuuggcaaaugaccuuacugagccuaucuuuuggaggacaaacaaaaucaacuuuuauuugauguuuauuauuuuacuuguaauuugaaggaggagaaguuuuaccauagaagaucuuugguacacgcacccaagagcagguaugugugguuuugguuuuguuaaaagauccacagcacuguucucagugagguacuagacagacucacggcagcuaauuccuucuagagcuaagcacaacacugcugacacaguaacccagacagacguaaaaggcagaugggacagaagcacacugcaaccccuuauuuauuuauuuauuuauuuauuuauuuauuuauuuauuuauuuauuuauuuauuuauuuauuuauuuauuuauuuuuuaccugugaaaugauagccauuugaccccuucacaaagaaccacuccugaagucauaagaaguucugcaaaauauugggucucaauuccuuccuccucguguuuuuuaaacuggauaccagauguuguuaguagcucuauagaguccugagcauacauguccucccuggcaggagaaagaaaacgaaaguucaaaauucccauuaaacaguuguucuccacuuaugccuacaacuacaaugcagaaacaagacagaggauugguuuauguccaaccauucaaaugcuucacaaugaucaagaaaaauaaaauaugagguauccaaaaaguaaauaaucauucaaaaaguccaauggugaguucacccuuaacaccaacucaauuucaucagcuucuaaacauuacauacauuucacugggcuuaaaaagggucuuuuacucaccagaggcuaccacagacauguucuuuucagucucugcagcuauuuuagugcugccagauggagcuguaaccacagccaugagggguuaugcacaccucucaugcucucagcagaaccaggaaggagacaccaaguggccaacaucucuuguggcugaguuaaacuacauuccaucuuaaagaaaaaggagaugccuccucucacaaaugaggagccuuucagcggcucuaguuaagcagugaacuguucagauaaagacucaguuaugacaucauuucuucuucagcaaucacauaccuacauuagaggcaaauacaauccuagacgacuaccuuaaaccaagccaggaagcacacuauaaaccagcucuucaaacuuuuacuuaaaccacacaaaaagccaccuauaguuucuaagcacaaauacauuaaguauuauauuaaaaaguugaagauucaugaaaaaguaucuuguggauuuaucacuuauuuuuauuuacuuuuuaaaaaaccuuaacauugguuucuaccaucagcaaaagaaaauuucuauaaaagacuucaauaaaacuaacaaaaccaaaauuaauguuugauuuucaucagauguauuuuuguagcuuauucucuggaaaucaauuucaaaggucaguuuaguucccagacugucaggaacuaaaugacaaaauuaagaauugaagcaucuaaaaacagagaggagccacagucaucacuuucaaacaucaugcuuucucuugaaacauccuguaggaaagauaucagaauaaauucaaugcaggcccucccacuacccucgguuaaauuguuuguuauacuaaaaauaugucccuuaaaugagguccuugggcucacacugaagcucguuuaaacacgauuaaucaaucaagaauacaguagacuguucuccaggcucauguugcucuuagccacaugcucaaguuauuuuauuauagucaacauuauguaaccauuaccaaauuaaauaauacaucaauaagguaggauagugagucuuggugcauuuaagucauuauuucccaaacuugcccaaugauaauaaucaccaggggaacuuaccaaaaauauggauucccaggucccaaugcagucccagaccuauugaaucacaauucccaggugagagaccuggaggaggaccucgguauuuuauaauaaaguaagguuggcaaacaaagacacaugaacacucccuuucuuucucucucuucugcaaaauuuauauaacucagucuaagcuuuguagaaugagucuuuuauaguaaaguuugguacagaacucauacuuuauaauacccaacucauaaccuuaauggugaggucaaucucuagagaggaugaaggaaacuuccuacaguaagguaaauuugauagcaauuaggagucucauuuccaaaucacuguacaauccuuuucugaugguaccaacuuuagauguucuacauucugcuuucucuacucucaaacauucuagcaauaaagggaaaaauacuaaaacuaacauuaaaaaguaacuauaacauuguuuagucaaacuguaagaauuucaucugguguuggcuacugccuguuacaucuauuauucagauuuaaguuagcaaaguauauaguuaugacuaaacaugaguaaaaaacauguaaaaaucuccgaagauuuuccaaaaggcauagguacauacggcuaucuuaguuaauauccuaaagaugcacuaucuacuaacucaaucauguaaaaauaccaaauuuccuauuuuuauaauaugaauaaacccuauuauaagaacucacacuucuaaacguguucuuaucaacauuaaacuacuucuugaucaccucccagaugcccaccauagggucgauauagcaccuccuucaaaugucacuuacuuuuauacuaaugguuagccaucuuuaguuuuuaauaaauuaaauuaauaacaauagaccuuaauaaacucaaauaacagcucaaaauaaaguaauaacacaaaaauauaucuaaaauugcaaaguccaugaaugacaagaagacaacuaaaaauaggaaguauucucacaaguccaaauagcaagcuauuuaaaauagacuaauuauuuauucuuuugauggaugaaacugggcagaaguuuccaauuugcaaaagacuauaacuuucagaaaacaguagcaagccggccugcuuguuucuuaauaugcacauaugugcccaguuaaaacuuacugaaauauuccuucugggaaugaauacauaaaauuuaacaagguuuucaucuuuggauuuagauuucaacuuccaauaaauuaaccacaaaguuuccgaagaauauacagauacuccaugaucaagguuauaaccugauaaccucauuagaaguuaggacgacaguaacaaaaggugaaaauauuacuacaucaccuaaaugcuuggcagcagaguguaaugcaagcuaucauagagaagagcagccagcugggagacagugcuuccuacugcuacccaacacuguacaagaguauacagugcugccaaagaaauggcacaaaauucaaaauuuaaugucucauccacugaaugcauacuacuucuguauauagucaaaaaguguaaguugagccaucaugagucaggagccaugugaagggcucacuaaagaaccuaaagcauagacccuaaucauccaaccacagcauaguuagauauaccacaguacauuaagaaaaagguccacuuagguggcagacaggcagaucucugagcucgagaccacccuggucuacaaagcaaguucaagacaaccagggcuaugcaaaauaaaacaaaaaacaaacaaacaacaaaaaaaaccaaaacaaaaccccacaaaaaaaaaccagaaaaaggucaaauaacggauuacucagaacucugaauaacaauaucaccaauaucacauauaaaugagaaauccuuaauauauaccaaaaauauaauaguuacacaacaacuaggaggaaguguugagaaacuaguaaaaguuguuucaacuuuucaauacuaaugcaguuucaaaagcaugcuuuuuguaaaaaagaaaaaaaaugucagcaaauaugcuuuauaaagucacaguguaacacuguuacagucaaguuuucuuucuuuaugucugaaauguauauacuucaauguuaacaguaauccuguggguaaauccacaccucgcaaguguguuuaccucaccuuuaaccugaggagcuaaugagaaggugagaaaacacuacuagaaaaugcuguccaucaagccaacaguuuuaggcuaugucaguggugaggauaauccagcuugcucacuccauaacacucaaguuuagcucugaagaggacacaauagcagccagugugcucguuaacuauggcugugauguucuuuuucuguuacagaguuuaucaagcacugggcaaagaaagcaaagucuuagcuugaaaacacacauuaauaaccaugcuugcuuucaagcccacaguaaguacaacaguuacagugaccaaaauaccaauaugucuaaagacacauuuuuacauagagaguauuuauuuuuuccuaaauguuuguuaccuaauacugaucuagguauuacaagucaugccuucaagauucagagaauguuaaguaagacuugaagagcguucuuccaauuguagguauuucuuauaagugggcuacucucaagaaucuaugcaaagcuuaaugcaacacacacugcaacuauacauaucuuuccacaaaucuuucuauuuacaccugauaaauaaugcuuugcacuuacucccuugaugcuaaugguaaaacuugaaacaacacuggcaaaccuaaaagaacccugacuuggacaaaugugagaauuaaacacaaaaauuuucgcaagcacagacaacaggcagagagaugaaaaccacuaggcuauuaugauguuggacaauguucaccaacacugugcugcagagccuagugcacuaacacgcuccuucuaggcauucaacaaggucaauuuccaccauccuucaacacgucuaagaugcuauuaugaugcuucccacauuaugcaguacuacuuuuaucuucucaaaggcuuuuguucucauuaacauuuuucacuauguucuuaaaaauuuuagccuaaaauuuucauugugugugugcgcgcgcgcgccugcacauguccaucauaugacacauauucaguucucucccaccaugugaguccugagcaucauacuuaagaucauccaccaugauggcaggcacuuaagcacugagccaccucaccagccaaugcacucuuuucuuuaccauccuaugauguuaccauuaguagaaauaguagcaaaauuggcgguaaaacuaguuuugucugaguaagaaaaaaacaaauguuccuggagaauaauggaaaagccacugcuacaaaaauuaccauccuugcaaugaagacuaccagcuuuaccaacuaauacccugagauauuagcucccagucacaaacugaguaucuuauauaaaaaaacaaaacaaaaacaaaaaaaccaaacaacacccaaugcuaugaugauuaauuugagggguaaaaagaacccugaagaaguuaaaauaggaaaaaacuaaagaacacaguaaucauuugaggagagcaugggaggacauuuucaccuguuccaaagcuguaguacucaugaagcacuaugaaaugacaguggggaugagcacguuagccuuucuagggucuauagggacugucaggacaguacuagauguuaaaauacuaucaggauuauuuagaggaguaacaacacauuuuucaagauacacaacugcaucgcuuacacuacugccuucuaaaaccaucaguccugcuauucauuaggucuaacauaaaacuguacauauucaacaaaaaauaggaaugaagaaagaauucucauucucauguaagaauucuuacacuagcacugauuuucuuaucauuuucuguugcuauuuuucaaaccagauguuugaucauauuauacaaauauaggcuaccaagcagaagggcaccacaauauuguaacauaguacagaauauacuauauauuuuauuuccauaccugaacagcaguaauaugccccugccucauacuaggcgcuuauauccugaagcucagaagucauaugaacuccacaaugguuauaaauguggcaaacuuacuuaaaacauuguguguguguguguauauauaaauuuuaaaaauccaaaugcaugguucuugagcauaaacuuugccaaugaugcugugucaaaaggauggacucaccuucaugcaguucccucagcuaugaagauuguaauaauuaauguagaacuauuuuaacuaaagaaauaguuuauacccaagauuugagguagacaucagguuuugguaaauaugcaagcuucaauacuauuacauuuucuguauguagauuaagagguugaggauugcauuggaauagcccuuuagagaaaaugaauuugaaaagaaaauagccccaauuucccaagaaauaucuuaguacacguggugaguauuuagaaugcaaaguaugacuguaauaauaguuucuucacaggaauaauaacuaucuuaacaagucacaguagauuggaguuguagcuaagugguacccgcuugcuuagucagcaaagcgccaccccaaucauauguauuccaaguugggcauaaaaacaaaugugaaagcucuaugugugguggcacaagccuuuuaaucccagcacuugggaggcagaagcagauggaucucugggaguuugagcccagcauugucuacauagagaguuccaggccagccuaggcuauguaaugagacacugucucaaaaaagcaaaacaacagcaaaauguaaaagucaaaucaauacccuaagggucaugcuuagggccccagguuuaaucugcagcaccuuaaacaaugacaaacacaacagaaacagcaacacaaauacagguucacaacuuuccauaaaaaugaccaucauauuuuaaaaauaacaucucuauaacuaaagucuuugaaauuagaaaguuuuuauuaucuuucuaacugugaagcaauuacaacugccucguaauaauaagccuaaacuuuugaauuucuguauuuaguacauuuccagggacacugagguuauauauuuacuucccacuuacgucaaauuaaacuuaaaguuaaacugccaaguugacguuccuggaggguauucucccuguucauucauaaaggucaguccgagcuggauuaucuuuaacaagucuacauuacaccgcaacaguugguacugauagucagcauugcuucugaauucuccaaugggucuugcaacaacgccuggaaacucgguguccuguaaaauaauugauaauuguuuacuaaauggucauaaauacaacccauaaacucucaggaaauuuuugauacaagucagagaauucuaugacaaugaaauucuguauguucacacucaaugcuuauuuuauaagcaugaacagcauuaccuaucagaccucaauauucuauaaacuuaaauuacuuuuucuugaaauuuauccauaaauuacuauccuguacugauaacucauaauaaacucaggcaaauauuugggcuauuuccaaggaaaagaaaaaucauaaacugauuccuaaggaguaggcauaugaaacuacacuuauagcauuacauuacuaaacucaacccgcaugaaagauugauuuaaaaguuaaaaaguacccugugcuuuccaaucaaagcagugagacaccaaaauaaagaaaaagucucauuaaugucauuucuuuaguuagcacagguguuuucuguguacagucacacucucucuuguaagcuguccuuucuguaaugcagcuauuccuuauuaucugagauauaaaugaccacuaacaauuucugcugcucauaaaaauaacggucccugccgagacagaaaguuucagcucuaauuauggacaagcauaccuuacugaaugguaugcuauacaaagaaauuccuguuuauccacagagaugcauuucuuuuuaaauugugauaguaaaauuauguauuaguuuagcaugagcauucaaauuaaggcuaacaaaaaagaggaggaggaggaagaggaagaaaaaaauaguaagucaauaugacagcaaagaaauuaaaauuugcugaauuuaauacaaccaccagccaauuacuggauucuauaaaaauuaagcuagacgugaagugggccagggauagaggugcaagacauugaaauaucgccuucuagggcuaauaauuguguggaucaagaaaauagacuagcacugggcgugguggcgcacugucucgagaaaaacccugucucaagagaaacccugucucgaaaaaaaacaaacaaaaaaacccaagaaaauagacuagcuauaacaaauacacaaaauguaguaacaaagcagaaaauuaauuauacaaacaugcuaggcagacugaauaccacuuauaagagcagacuguuuaaugaucaaguauguuucuggagcuuuagcaauuuuuuuuuuucuaaaagaucuacuuugguuuuucuaucuuucuucuuuuuaaaaagauacccaggaacucacuggucugaaagcuuauuuggaccuaguagcacggccuugggauugcuuagagcugagcugacaugcuuagauaggcuuuauaguccucccacugaacguaaucagcuucacaaaauuguacaucaacaaguacauucuguaaccauguccuccuccccaugccaaagacgucuaaaccacacaacauucuccuccuagcugagugagcgacuccucccaucugcagccuugguaucuuacucuugccuucucacaaagcagcucagacucaguaaaaacccauaggaaugccauagcuuccugagagcacagggaagccugccucccuuaaucucuuaaacccaggugaagcaagacuaaauccuaaagcaugucugccacuuacacucaaaugucccugacuccuaaucccuugccgauuaaugcaagcaguaaaaacucaacuugucaaaauaguuuuguuucugauagccuucgaugaaagaaauaguccacuuuuuucaugauuaaauuaauccuuagcuaucaaugagaaggguuuaacugaugguuuuugguuuuuguuuugguuuuuugagacaggguuucucuguauagcccuggcuguccuggaacucacucuguagaccaggcuggccucgaacucagaaauccaccugccucagccucccaggugcugggauuaaaggcgugcaccaccacgcccagcuuuaccugaugguuuuaacagcccacuccagggcuuagggggacaguucaucugguaaaagcacuuggcaugcaagcauguggaccagaaggaguucaaacucaagaaucuaugcuuaaaaggugcauggcccaugugcuggcaauuuacauguuuggaaagcagaggcagguggaucccuggggcuuccuggccagucaauguagcuuaaucaggaagucucaggccaccaaaagacccgugucagugcaccccuccccccaaacacacacacacacacacacacacacacacacacacacacacacacacacacacacguacuuauucacucacacacuucccacuucacccuuacaaaaggcauuuuaaaaagcuuuagucauguccauaccauagcaacauaauuauauuuucggauaacuugacggauuuucuucaucucuucauccagguuacaagcccaaacuucacaaauucuuuggcuaugaucuacgguugcugcuggcauagugacagcacaaggagucuagauguggagcaucaaaauguuauacuugauugaagauuugugucauaaaaauacuuuacccuuuacuuaugcaccuguugaaauaaaaaaacaccaauaucaugaaugugaauuauaaaacugggcugguauaaaccuuauuuauacaaaguucaugacucauaacaaaaucaaguuuuagacaguuccuuuucucaagguauacagcuaauauuuagaggauaaaagcaccacaccgccgauuucccaacugaauauaaauuucacuaauuaagauuugcuccgaguucaauucacuccacacaaaacuuugaaccauuucaagccaaaaaaaaaaaaaaaaaucaacaaaaucaaacguuucauaacagaaugcuugcuuuuauucuucuaacaaaacauuuaaaaaucuuacucauucaaagcagagcagaggaaacauuuuucuuaaaaauguuuugaaaagccauuaggcaaucucagaaacaaauauagcgggagggagaaagaaagaaagaaagaaagaaagcaagcaagcagguaggcaggcaggcaaugaaauguguacauuuaaaaauuucuaauuucaaaaacuggcaacccaagagagaccucacgucucugccauccacacaagguucacgguauacaaugguaagauaauuaaucagacggacagggaccaaacacacaauaacccccgacaaaaccagcgaguuaaaagaggguggccuggugucccaaacuccuaaauguacgcuggagaaaacaaaaggugaugcagggcacgccuucuuucuuccuccccuccguccucacaccggucccuacacgcgcucuaccgacacacuguacuuuaacccugcuuuccuccacccgcucuucucuacugcggucucaggggucccuccaaggggcagccaaggccuucucaucccugaggucgcgcguccuccgugggcgagcaacguggagagagcacggccgccuucaugucaaggauaagucgcucggcuggccgccggccaggagcagggugccuauucgcauggccuagagccagaccgacuacccccaaaaaccacugccgaggacgaaagccaccggggccccaaguaggccaccgcccuccacucgcaauuuccuucccacaacgaagucccagguacaaagcgguggcgucaucacugcgcgccgcgccccugacagcccccacccgccccccgcccguuagcaccgccguccccccgggcuccccgccuccgccaguuccgucccacacagccacgcuuaggcgggcgccaucgcgcgcgccaaucucgggcuccccacucccagccccuuuucccaaggcgccccagcacgcccgggcccccgccggaucuacuugggucucugagcucgcgcuccuccuccuccuccucgccauagagcuagcacccggcggcggcgguggcgguggcgguaccggcggcggcggcgggagccccauagacgccucucgcccugcgaaagggggaaaggggagcuggagcggcgcucggcccagcgcggcgacgucgcuccucgcacgucccgccgagggcgcggccugaugacgccgggcgccgggugggcggggcccucccucaggaggcggggcgggcaggugacgaacgccccggcguuggagcagcugagccggcaaggcgaccaggccuagcuaacugaccccgggguggugguggcccggagcacaccgggguuccguccagccgacgagucgcccuucuccagccgcccgcagugguagcucggacccccggggccagggacucacgagcgcggcgugugggagacggcgcggccccugggcaccccguccgggccgugcucgaucgcccgggaagcacugggcuaagcgaggagcagcaggccagaaccuuguagggccucgggcccggggacccgaggaggaugagcuggcucuuuccccuggcgaagagcgcgucauccuccgcggcuggguccccugccggccucaccagucuccagcagcagaagcagcggcugaucgagucacuccggaacucccauuccaggugacgacugguggcuucggcccaggguaaaguaggacgggagggcgggcugcuugcaaacacaccgugugcgaauccguaggccgcuccaucagcugccuccuguugaugggucuuccagugggguuaagcgcuugcuucccuaguuugugucccuggugccccaccgcuguucagcuccucucuugacuuggcucaucuccacugacaaacggagucaucucucuuuaaucuguauacagcaccccuagcucacacgcuaauuuuccuuuugaucuaccugauuguagcauugccuucgaauuguuaacaugcuaagagacaguuggaaagauaauucccaacaguuuuaugaacugaaaauuuaaacuguugcaacgucaaagaaaagggaagccaguguuuuuaguuaacucuguccuggugacaauccuuuugagucuguaauuaaagcucacccuguuccaauaaccucuuucugucuuguaauuguuagagucuuuagacuucucacuuucuucuauuuggcuccacacuuaggacuugccagacaaccaucugcauuaucuguugucuuuugaguuugcuuguuguauuguagucaaacuagaaauacaggaaaucagauuauuucgacuuuuuuucuuaaauauaaaauuguuugcugcagucuuuuuuuuaaauuagauauguccguggcugcuacaggcuuucaaauauuagagcugcuuugcgauauauggauuuuacaauuaacuaacagcuucacagcacauuuuauaaagcauauuagagaucaacaugauuaaacucuagacuuucaaaaaccuugucacauuauacacauuauaauauguuauacaauauaauuauguauguauacauaccuacucacacauccaugagauaauaacaucaaguuauugaacacaccaucaagggcuauuuuuguguuacacaucuauuuucuucccaagcaaguaagcuauaaccuaaaaaaacauugucuaaagaaaaauucacuacaaaaucaguuugaaugaggccuguugcugacugaacugaguuucuugguugucaacuucauuuuugguuguaggaaaguuucaaaaagucauuuacugucuuuuuaaguagaaaagaguagcuauccuuuauuguugguuucacuguggaaaauucaacucauaaaguugucccacuuugucgggugugauggcuuuuccccacucaugguaaggucaugauccaugccugcucuuaaagcuuuggguuggcuacacgagagaacaaaauagacuuguguaagccaaauuuuaugugguguggagcuuucauaaacgaagaccccgagucccagggaaaccuuuuugucuuaggaguaggcagugggugggagaguguuaggacaaaagggcacgaucuaauggugguagacugaaauggaggaaacuagcaaguccuagauuugaggugugcuugcuuguuugguuuugguuuuucuaaacaggguuucucuguguagcucuaguuaucuuggacuuggcgcuguaggcgccuugaacucagggauuugccucucugccucucaagugcugccugccagucucccuauucuuaacucuucugugcagcauuccuucugcccuguuagagggacagagccccucuagaaagaggauuuucuaagaguggccuuucuagguguuagguuucuuuuaucauccaugaggaaaggggacucuugucuuuaggacgacuuucagaggaaaaugugggguaagagauaggaagacagcaggagaguuugcuuccaaucuucaagucucccuuaguucaagguaucaauaauacccaagagcuauacuuaugaugguagcaauuucugaacucccaacauaagucagccuuacucuaaaugggguuuuguuuuguuugcuacucuugagagcagagucauggauaacuagagcuacacaaagaaauccugcuuugaaaaccaaaccaaagcaaacaaaccccaaacacuugcaagcuacacucgcaagauguguaaaauaagguggcuaacuuuuuuuuaauauuuuuauuagguauuuuccucauuuacauuuccaauacuagcccaaaagucccccaugcccuccccccucaccccccuacccacccacucccacuuuuuggcccuggcguuccccuguacugggacauauaaaguuugcguguccaaugggccucucuuuccagugauggccgacuaggccaucuuuugauacauaugcagcuagagacaagagcuccgggguucugggugacaaacuuuugagaaacacuacaaagguuucugccuuauaaugucuacuuagaaaacuguagacuguguuaguacuacuauugcagaaacacgguuagaauuauucccuagccuuuacucuuuucuguuaguaaugcuggugauuuuuuauucuuagcggauaagauggaacuuuugaaacacuagagucucuuacugcuaaggcuaguauaugggggacguuaucugaaguuugugcuuaaguuucaaauagaguuaauaaaaugguaauuguuccuugaaggagaucuggaguugguuuagaaggaucaguaaguaccuuuaaauggaugaugcaaaacuauuuugugugcaaaucuuugaacuagaaauuuuggacagguuacauuaucuacacauacuguagaacauaacaacacuaaguauuugauucuuguaaguucuugagauuuuaauuaaaauacuuuaaacuuacaaauuagauaugaauaauucuaaacauuuaagaaucucuuaaacacuuuaacaaauuguuaccuucuucaaaagauuagaugaauuucauagcuuuuuuuuuuuuuucuuuuuuaagugagugauacccugcaggaacaagucugaaacugucauaaaaaacuaaaggaguuuaaccaaagcaagaggacacauauaagucugcuauggaagugaaaauggaaguuauauaaccuggacucaagaacuaaucuucuagauaauaaugauaaucacacuauucaguuuaccacucaaacagugguucccaaacuuccuaaugcugugaccuuuacuaaagcuccucauauuguggugacucccccaaccguaaaguuauuuucauuguuacuucauagcuguaauuuugcuacuguugagaaucaauguaaauaucugauauucaaguuaucuauguggcccaacccuugugaaagggucauucaauccccaaagguguuaccacccgcaccaguugagaacuacugcacuaaaacuuuugaguucauauguagaaaaacaaguuuccucugaaaucuuuaaagaacaccuguguguguucuguuuauaaucugacuugguggaggugcuuucaaucccaggagguguaauaauuaggggugaucuuaacucacacucuuaccucuuuugucgugggaauaggcuucacccuccccuuccucucccuccucuucuuucucuuuguggucuucucccugguuuguuuguuccuuccuucuuucguugauuccacacucacucacagggagccaccugccucugcuuca

SEQ ID NO: 4407 - RNA, 40601 nt, Mus musculus
cucccucaggaggcggggcgggcaggugacgaacgccccggcguuggagcagcugagccggcaaggcgaccaggccuagcuaacugaccccgggguggugguggcccggagcacaccgggguuccguccagccgacgagucgcccuucuccagccgcccgcagugguagcucggacccccggggccagggacucacgagcgcggcgugugggagacggcgcggccccugggcaccccguccgggccgugcucgaucgcccgggaagcacugggcuaagcgaggagcagcaggccagaaccuuguagggccucgggcccggggacccgaggaggaugagcuggcucuuuccccuggcgaagagcgcgucauccuccgcggcuggguccccugccggccucaccagucuccagcagcagaagcagcggcugaucgagucacuccggaacucccauuccaggugacgacugguggcuucggcccaggguaaaguaggacgggagggcgggcugcuugcaaacacaccgugugcgaauccguaggccgcuccaucagcugccuccuguugaugggucuuccagugggguuaagcgcuugcuucccuaguuugugucccuggugccccaccgcuguucagcuccucucuugacuuggcucaucuccacugacaaacggagucaucucucuuuaaucuguauacagcaccccuagcucacacgcuaauuuuccuuuugaucuaccugauuguagcauugccuucgaauuguuaacaugcuaagagacaguuggaaagauaauucccaacaguuuuaugaacugaaaauuuaaacuguugcaacgucaaagaaaagggaagccaguguuuuuaguuaacucuguccuggugacaauccuuuugagucuguaauuaaagcucacccuguuccaauaaccucuuucugucuuguaauuguuagagucuuuagacuucucacuuucuucuauuuggcuccacacuuaggacuugccagacaaccaucugcauuaucuguugucuuuugaguuugcuuguuguauuguagucaaacuagaaauacaggaaaucagauuauuucgacuuuuuuucuuaaauauaaaauuguuugcugcagucuuuuuuuuaaauuagauauguccguggcugcuacaggcuuucaaauauuagagcugcuuugcgauauauggauuuuacaauuaacuaacagcuucacagcacauuuuauaaagcauauuagagaucaacaugauuaaacucuagacuuucaaaaaccuugucacauuauacacauuauaauauguuauacaauauaauuauguauguauacauaccuacucacacauccaugagauaauaacaucaaguuauugaacacaccaucaagggcuauuuuuguguuacacaucuauuuucuucccaagcaaguaagcuauaaccuaaaaaaacauugucuaaagaaaaauucacuacaaaaucaguuugaaugaggccuguugcugacugaacugaguuucuugguugucaacuucauuuuugguuguaggaaaguuucaaaaagucauuuacugucuuuuuaaguagaaaagaguagcuauccuuuauuguugguuucacuguggaaaauucaacucauaaaguugucccacuuugucgggugugauggcuuuuccccacucaugguaaggucaugauccaugccugcucuuaaagcuuuggguuggcuacacgagagaacaaaauagacuuguguaagccaaauuuuaugugguguggagcuuucauaaacgaagaccccgagucccagggaaaccuuuuugucuuaggaguaggcagugggugggagaguguuaggacaaaagggcacgaucuaauggugguagacugaaauggaggaaacuagcaaguccuagauuugaggugugcuugcuuguuugguuuugguuuuucuaaacaggguuucucuguguagcucuaguuaucuuggacuuggcgcuguaggcgccuugaacucagggauuugccucucugccucucaagugcugccugccagucucccuauucuuaacucuucugugcagcauuccuucugcccuguuagagggacagagccccucuagaaagaggauuuucuaagaguggccuuucuagguguuagguuucuuuuaucauccaugaggaaaggggacucuugucuuuaggacgacuuucagaggaaaaugugggguaagagauaggaagacagcaggagaguuugcuuccaaucuucaagucucccuuaguucaagguaucaauaauacccaagagcuauacuuaugaugguagcaauuucugaacucccaacauaagucagccuuacucuaaaugggguuuuguuuuguuugcuacucuugagagcagagucauggauaacuagagcuacacaaagaaauccugcuuugaaaaccaaaccaaagcaaacaaaccccaaacacuugcaagcuacacucgcaagauguguaaaauaagguggcuaacuuuuuuuuaauauuuuuauuagguauuuuccucauuuacauuuccaauacuagcccaaaagucccccaugcccuccccccucaccccccuacccacccacucccacuuuuuggcccuggcguuccccuguacugggacauauaaaguuugcguguccaaugggccucucuuuccagugauggccgacuaggccaucuuuugauacauaugcagcuagagacaagagcuccgggguucugggugacaaacuuuugagaaacacuacaaagguuucugccuuauaaugucuacuuagaaaacuguagacuguguuaguacuacuauugcagaaacacgguuagaauuauucccuagccuuuacucuuuucuguuaguaaugcuggugauuuuuuauucuuagcggauaagauggaacuuuugaaacacuagagucucuuacugcuaaggcuaguauaugggggacguuaucugaaguuugugcuuaaguuucaaauagaguuaauaaaaugguaauuguuccuugaaggagaucuggaguugguuuagaaggaucaguaaguaccuuuaaauggaugaugcaaaacuauuuugugugcaaaucuuugaacuagaaauuuuggacagguuacauuaucuacacauacuguagaacauaacaacacuaaguauuugauucuuguaaguucuugagauuuuaauuaaaauacuuuaaacuuacaaauuagauaugaauaauucuaaacauuuaagaaucucuuaaacacuuuaacaaauuguuaccuucuucaaaagauuagaugaauuucauagcuuuuuuuuuuuuuucuuuuuuaagugagugauacccugcaggaacaagucugaaacugucauaaaaaacuaaaggaguuuaaccaaagcaagaggacacauauaagucugcuauggaagugaaaauggaaguuauauaaccuggacucaagaacuaaucuucuagauaauaaugauaaucacacuauucaguuuaccacucaaacagugguucccaaacuuccuaaugcugugaccuuuacuaaagcuccucauauuguggugacucccccaaccguaaaguuauuuucauuguuacuucauagcuguaauuuugcuacuguugagaaucaauguaaauaucugauauucaaguuaucuauguggcccaacccuugugaaagggucauucaauccccaaagguguuaccacccgcaccaguugagaacuacugcacuaaaacuuuugaguucauauguagaaaaacaaguuuccucugaaaucuuuaaagaacaccuguguguguucuguuuauaaucugacuugguggaggugcuuucaaucccaggagguguaauaauuaggggugaucuuaacucacacucuuaccucuuuugucgugggaauaggcuucacccuccccuuccucucccuccucuucuuucucuuuguggucuucucccugguuuguuuguuccuuccuucuuucguugauuccacacucacucacagggagccaccugccucugcuucacagugcugggagguaggacucuuaaauagaagucggaaggaaagcccagguuuuuucaauaauguagagcugugugggaagaaaacaaaugggaggaaaaauguuucucauguuuuagauguuguuguguucaugggacuucuggagcuguuuuggauugugauugaaggcugguaacaaauguaaaauagaaggacaagguuucccuacugaauuaguugcucuggagcaaaccuccuuuccuuugugguacuucguguuuaagauaaauaacuccucacugguggcgugacuugcaccguccuuuucaguaacguguguuugugaugauccuugcuaacccggcuaauauguaaggucuccagugaagcuguuuagucgagguucucuguguugcacccacaguuagaaaauacuccaaauggaugagguaauagugauuguucuaaacaggucucucuuuucucuauaucuaaaguuaauuagccucuuauuaauuucuuuaucucuaaaacaaccuagagcuauguuaugaguaguaauuauuacuuaucauuaacuguaaauucaaaguuauacaaguaaugagccaucuuuauuaucuuuaccuggaucucccagguaaaaggcuucugcauuaauuuugauacuaauuauauaauaaugggaaugcuguuuuguuugcguauucaacuagaguauauuaaguuguuugugaugcagacagaauuguaucuuccuuuuguaccacuacuagacuccuaaugaaaggaagccaagaagucaggagcuacagcuggguugcugccuguaguccuuacaugccuaugaccacugaacugaaaggauucacugccugcuugcucuuugcucuacucagccugaaaagucaguugauuccucaagccucucaaugggacaugcuuuaaggcacaaaacaaaauaaauccuggcauuggagaccuguaggggacccaccaaggaacagagcagugguucucaaccuucuuaaugcugcgacccuuugauacacuuccucauguuguggugaccccaaccauaaaauuauuuuuguugcuacuugauaacuguaauuuugcugccccguuaugaauuguaaugcaaauaucuguguuuucugguggucauaggcgaucccugugaaaggaucacucagucucaaaagggauaaagacccacagguugagaacugcuggaauagaagcguuguaaugaaacuguccuagauugcuggcuguaguuuuaacacacacuagaugcacagucuguuuguaaagcauucaguucuucccgucuuccauuuucugucuguggcucuuauacauaaugccagugauggggauggaugcggggucagauauggaucacagaguccuuuuugauuauucaaaccuuaauccuguaacuucccuugacaguaagcuuuuguguagucauugacuuacagcuuuaagcauuacucuuugcucauagugcaaggcuuguacccuuuagcucacugguuucuaguaagucuuucugcagauuuuacucucaggacucacaaacaucgaaccauaacaaacuuguaauaggauauauguuaucgucuuuuguuuuuguuuuuguuuuguuuuguuucaagacaggguuucucucuauaguccuggcuguccuggaacucacucuguagaccaggcuagccucaaacucagaaauccgccugccucugccucccaagugcuggaauuaaaggcgugcaccaccacuguccgacauauguuaucuuuuaaccucuucuauuauuuuuauugaaggauucguauuuaguauuuaaagcugaaacuuuauguuaaaauuuccaagucuccaauauccuuuuaaaagauuuuauuuuuggagcaucaaaguuaaauguaacacacacccuuaacccccaugacgacucuuauaacguuucuuuuaaaaauagggacaucuggcaacaacuuuuauauaacaacauuuacuuuacguuaauaguaaauguccucugugcuaggcuggccucuuccauuuaccauucucuauuguauaaauagcuguauauucacaugcauucccuggccacuauaggcauuugagguuaacuuguugcaauaaaacguuucauaagaggaagaauaaggagauguugagcuccccauaggccccccucaaaaggggccagccaaucaccggcuaaaaucucagcugugagcuacaguuaagcuccugagaaguagagucuuuguaugacuguuccuagugugaaacauuuagcuagaacuucaugggcaccugguaggcauucagaagaccagacuggugauagagaaaugcagagacaguaggagccaagcugaucagguaggaacuguaggguauccgaccagaggcaaucaccaagcagaaacguugcuuucuggaaauuuuaugggaaacugaacuuaaagugaacggaguggugguuuugauguaggaaauuucaaaauaacacagcauucaggcaguagaaugaauacucuugagaucaaacagauuuggaagaaagaauugggcauuuuugagacuagccagaaaagauguguguuuaaaggcauaaccaaaagcugccacacgugaugggagucccagcuuucagcagacagaagcaggaacagcauauguuuaagaccugccuaaaaaacacuguaaaaccuuuucucagaaguagaaacaaaaaauuguaguaaaggccuaguuguuaaagagauuaaccucaugaaaacaaauaguaaguccaaguguugcucccugggacagugacgaguuugcccuguuuucuggccugugaugaggcagcacauggugacagcgcagguugcacagcuguucuuaggauagcaagguuaaaaacagaaccagaaacucuaguccucuaaucuucuuuaaggcacaugcuuccaguaaccuaaaucccucagucaguaggcuggucgcuuugaaagccucacuuuuccaguaccagugcugggaccaagccuugucaccuaggccuuuggagagcauucccaaccuaaacuguagcagguacucuuuuauuuugcaugugaaacuuuuucaagaauguguucuucaguuccccuuuccucguugcaaagucuuaguugacuuuuaaaacuucagugaaguuuucccacucuguucucagccaguguauucuguguccauggucauuuuccuauguguuuugaacauggcugagaagauauuaugaaauaaguggguggaugucacacagcucuugaaaacaaagucaagcaguuggccuuagaauuucuuacauccauguucuccaagagacugauuuaggcugaaguauuuuccaaauaacacacaccauuuacuuaaguuaucuauuuuaaaauucuuaguuuuucauguucauaucaacugcauauuuauacugauauguguacaugguuauuaauuuguucuuacgaagauauuaagcaaacaaauuugaaaucuucuauuuguuuccuugaguuuuuugguuuucuuuuguuuuuuucugguuuguugaguuagguuccuaccuucuaauauuuuuuucccuuugaaagcuuuuugaugcucuuauuucugcuuuugagauuucuuucuacuuguuugugguuucuuuaucuguuuacucuaacuugccugugguaaagggguaggggggaagaaauggcuauuucuauucuuggggagagucaguaacuuccuaccucaugcagaugucucuacugucugcacuggacugagcagagagaagagaaaggccuucccucaguuagacagcauguuccuguuuggcaugggcuggggucuaggguuuggaagacauauugauccuguguggguguggcaagggccuuuuguuuuuuuaauuuuucuuucaaucaaauuuucaucuuuuauucuuuaaaaaagguuucacugugucugacugucugaucaauggccuggacaauggugauccuccugccucuuucuccccaggguugagauuacaggcaagcaccuccugccugccuuucaucuuuuaucuugcaggcuuccucacauuuucaugucugcuuaugguaauauuugcuuuucaugcuguuaaugauuuacuuuuuagaaauuauuuggucuuuuuuaaguuuauaugguaaaugaaaauuguccuuuugagagguuuacuuaugaaugauaauuugaguuaccuaguacuguaggaauauaugugguaucuugaacuguuuuuccucagagucacccaacuuucccaucaagcuguaugcuccuauagagacauagccauuucaguauucccauuuuccugaaaauuacuguguacauaguaucuguucaguuuuacuguauuuagggaaauguuuauuaacaauaaauagaaacaaaacauaaacgauugcuuauuuuuuaaaggcaacuuuuagccauagcuaauauguguuuuggauucacauuuagaaacuacccaaaugugugaccaauuuauauauucugacuaacagaaguuuaaaaaauuuauagauuugcuuccuuuguguauaugagugucuugccugcaugcauauaaaugcaucacauguguacaugguacucacaucgagaaaaaggcauuggauccccuggaacuguaguuaaagauggcugugagcugccgugugggugcuuggaacugaauucagguccucuacaggagcaagaagugcucuuaacugcugagcugucucuccagaccaaacauuuuauauuguaaauuuauauagcuccaaagauuuagaagcacuugaaguaaaacuucagugguagggcaccccuucuauaugcaaggcccuucaaguuuuccccuuucuauaguagaaucuacugcuguuguccgucguagccucuuguuucugauuguuaugagugaaacuugccuguugucuuagucaggguuucuauuccuguacagucaucaugaucaagaagcaaguuggggaggaaaggguuuauucagcuuacacuuccacauugcuguucaucaccaaaggaagucaggacuagaacucaagcaggucagggagcaggagcugaugcagaagccauggagggauguuacuuauuggcuugcuuccccuggcuugcucagcuuccuuucuuauagaauccaagacuaccagcccagagaugguaccacccacaaggggcccuuccccccuuguucacuaauuaagaaaaugccuuacagcuggaucucauggaaggauuuccucacccgaagcaccuuucugugggauaaguccugcuugugucaaguugacauaaaaccagccaguacaccugucauuucuaggagacaacaucacagcagauuuucugguucucuggcucuuacauacaaucuuccugcucacucuuccaaaacauucccugagccugaggugcagaaguuguguuguagaucuauccacuugggcugagugccccaagaucuguuguucccugcauuuugaccaguuaugguuuucucuaguaguuugagucuauugcaaagagaagcuucuuggaugagaggugagagcuacacuuaugugggucuaaggauaaguauuuagaaugcaguugguaauuauuuugguuuaguaaaguggaggcaguagguucuccaccaagauccauggcaucacuagccuggguaguugcucgguuccaauacuggcauggguucucugguauugagcaggccuuagggcuaauuugacagcuguugcuuaguggcaagaaauguaugccacuauugcaccuauggauaucuugacauguuggucauuauugugauuuauaagucucacagcuggguaggacuaugauugcuuccauccacuggcagguugcauuuuaauauguuuccugugauuuuuuuuuuuaauaaaacucagaaaaugacugaaaauguuagagaguuaaaauuuauuaccacaaauccaagagauauaauagguggauuuuauaaaugcuuucuuuaaaaauaucaauacauugaguaguuauugcuaauaaucuucugaagccuccacauauaugaucuuguuuaaucacacaacaucacaagaccucugugauucuauuacuaugaagagacaccaugaccaaugcaacucuuauuuaaaaaaagguauuuaauuggggacuugcuuacaguuucagagguuuauucgauuuaucaucauggcaccaugcauugugauguaccugaucugcagggcugugagaaaacagccuagcaugagcuuuugaaaccucaaauccagccaggcaugguggcacacgccuuuaaucccagcauuugggaggcaggcggauuucugacuuugaggccagccuggucuacagugugaguuccaggacagcccgggcuacacagagaaacccugucucggaaacaaaacaaaacaaaaaaaaacccucaaauccuaccuccagugucacacuuccuccaacuaggccacacccccuaauccuucacaaagaguucaacuccuuggugacuaagcauucaaauauaugagccuauaggggucaguuuuagccaaaucaucaccaaguaaaauggcccaugugggaucugagccuaggaaaccugucuucagucacagagugcucuucuugacuugagcugauagaagagucuuucacuauucaucccucgugacaucucgguaguacagaagaauaaacuuagggcuuuguuuuaauuauaugguauucauaaaggggaagaugguaucaacuaaaaccaguccccguagggaagcuuucauaaaaaucauuauauucugauauugauuaucuguuugaauuaccugagcuauuucuuuauucuuaaauuuuuuauuaguugaaaguuauguacaguguguuuugaucuuauuuauuuccuccauacuccuccuaaguccaccccccuuuccuacccacacacgugguuuccuuucuuuuaaaccaucaaaccuaguuuguucuauccauauauucuugaauguguggccuuccacuagagcuugguugauaccuaccgacuuauguaccagaggugauggcuuuagaaaaagcugacucucccucuuccagcagcugucaauugcuaauugguucucagcuaagggaacuuuaguauuuggucuggcuuaagcuuguaugugguuugugcaugugugagggggucccugcagauauccaggcagggaccugaaagaugcuccccacccuugccccaugcagauugauuuuuaucaaccuggaucagacuuggggagucuaguggcagacaguucauucucaacauauaaaacaugguacaauuuuggaaaaaguuuucagguaauagucagucccuuuccagguguacaauaaagcuuaaggugugacuacuuauaaacucuuuuacagaguacaugugcccaugagaguggguucuauaccaggcuacaaaguacaugugccuaaggauggguaaugcucuagggagggaagagucugagauaaucauucuggggaauuugggugaggucugccuccacagauagcaaaaaggucaccaggccauuaacaaaaccuacucucagcuuucugguugguaugcagguauuugauuuuaucuccuccauugaggagacacuccugugugauuaauauuccuggugcucuuagugcuucucucuaaguacaaggaccucugggccccaacacuugucacaguugcuauguguucaucuguauagcugccuugcugugucuggagaguguuguuuccuuguauuaucaaucaccucuagcucuuacagucugcuuuuuuucuccuuuucacaauggucccugagccuugggaggagaagguuuugauguagaugucccauguagggcugaacauuucuuagucucuuacucucuuuauauuggacaguuguaggucucuauuaaucaccaucuauugcaaauagaagcuuuccugaugagguuugagagguguauuaaucaaugcaucuaacaauaacucaguaggaggcagauuacuucuaugucauuuagcuguucuccccuaguuuagcccuaugagcuguuuagcugcagguucuuggcccuguaguggugcuagguagggguaucauguuguagucagggaugugaauacaaucagaaagugguagauuuuuccauuaugcuugugccucuauuguaccagagcacaugccuuacuggccaguuauuauuauaguuuucaggguucaucgauggauaugauugauuacuuuucucuuccaaccagaauuugaugguaagacccugucaacauggcccagcagguuguucugccuuaggccaagcaagucuauuaagaaacacagcaucuuauguacaguuuucaaguauguguggggguuggggaguuugggacaggcagagucagcagaaagcuaucauaaugggacaaagucagcaggaagcuaaucaagcaauauuguacaaaaagaacacaggcuaucucaagugugucacaaacugaacacagaauggccuuggaacugauagccauagucuuuugggggaggaguuggguucccagggucagaaguugcagcuuccugcacuccacuccccaaggucugggcuucaggccacuacuggccuugccaugcauauuccuacuuuuagacaaggaauuacauuccuucuccauacaucagggccuuaggaaaaccauuggcucacgcuggcuucaguaccuguuacuaaagacaacacacacaacauagaacaaaggaaagucaagcugguccugaccuggaagcucccucccugggguuagcguuccuaccucuggacgguucuacaaaugcuacggaaggagacaaguaaccaccaaauuucuuaccuauaucuuauuagugaagcaucauuccauagaguauuagaggaaaaagcuuauuuacaucagaauuguuguccauggcuucaucccaauuguggugguuuaaaugggauggcucccauaggcucuucuaugugaaugcuugguccucaguugaugguggaagaauuaggagguauggcuuuguugauaauguuucucaaccuauggguugagaacccuuugggauugaaugaccuuuucacaggggucaguuaggacuauuggaaaacauauuuacauuaugauucauaauaguagcaaaauuacaguuaugaaguaacaguaaaaauaauuuuacaguuggggagcagcacaagugaggaacuguauuaaaggauggcagcauugggaagguugagaaccacugcucuaagaggugugccacuggagugggaauuugagguuucagaaguuuucucucucucugccuacagauacagcaccaugccugccuucugccauacuccccaacacaguagucagggcugauccucugaaacucugaacaagaccuuauuuaagugguguuuguuuguuuuuaguaaauugccuuggucauggugugcuucacagcaauauaaaaguaacacuuaggacaccaaaaggacauaagauuuacguauuugaggggcuagguuuuuauuaaagacuugaaaauauaauaguccaauauugaggaaaauaagcuuuauaaaagcuguuaguuugaaauaacuaaaauaacaggaaauaggucauaaugcauuugcuaguccauucaaagauucuugaauacuaaguaucaacuacugaguacuaccuaguguguuuccccuuagaacaauuaugacugucagcauuucaggugaguucccucaggcucuauauuucuuaguaaauuuuacuuauaaacaugccuauaaucaauaauaagacaaauugcuuguagggugucaaauauaagggcuuuauauuggaaacucuucucuaauagugauaaagacacccaaaauaguagcucaaacaagauaaaagcuuauuagaauaaaccuaaaauaaaccuaagugaggcguagugacacuuguuuuugauacuaguacucagggcagaggcagauggaccucugugaggucaagaccaaccuggucuacauugggaguucaaggacauuccaggcaugcauacauacauauguguguguguguguguauauauguauauacuauauauguguguguguguguguguguguguguguguaugcuaagacuugugucaaagaaaaaagcaaacaaaaauuuugcuaacaauuucauacucaucaaggaguccagcuacuuggacucaaggagacccuacaaagggucauuuguagggucacucauggcuuaaagugguuauuacugugcaagccugacauccagggggaaacagggagaaggcaagaaagccagucagaacuccuaguaguugccuguucuuucaacuccauuguaagcugcuucucuagaacuccaccucacuacuaaccuauauuuuuauuggaugggaccaaagucuuuaacaccagcuaauuacaagaaagacuagaguguggcuacucagacuaaaaucaggcuucuuuguggagaagaggaaagauggagaacagccagcagcuguugucuugccacuccaaggcacaaucaucuggacugcuggguuuaagcaguuaaguccguaaagcugcuaguggcggguuacagaacucagauauuuguugacacauauuauuacccagaaggcuugcaguugcuucuacuaaugauaacuuggauaaaguuaucuuaaaucuaagauuaauuugaguuuuccucaccauccuucccuuacaccuuggauaguucagaguaucauugccugaauauuugguaagccuuuccaacuauaguaguuuccuuucuagauacaaguuauagcauauacccaaguucugugauuaaaauaaaaacguuucaguaggcuauagcauuuaacacuugcauuugauauuaaugguuuuauaacagugaucucuuuuuucuuuuuccaaauuuucucuuacaguauagcugaaauacaaaaagauguggaauacagauugccauucacaguaaacaaccugacaauuaacauuaauauguaaguaguguugguuucuauuuuuauauauuagguuuuaauuuuugcuuucuaucuuaacagccugacaauauuagugugugaauagaauuguaauuuauacuucauguaauaggagcuuuuuuguuuugucuuuuaguuaauaucagaaauaagcuguuugagugagcucauucaaagagacuauaacauaacauagugccaagcuuagugaaauaauaacugccguggcucauugcuaacacauggacauaggaggccuuguucaauauuaguucucugaacaaauuuaagaauggauauauagugcuggcaaaaaauaaucaacuuuacaaauaugaguuaugagucuguacaguagcuuauaaauuaggauagauuacagacacauaauaaaugucaacaaacacucagauuaguuggcuccaaagaccacuuauugccuccuuuacaaaacuauuuuaaaaaucuuuaguuauuaaaaaaaaacagacaaaauaaacaaacaaaacuuuuucuauauaaaugaauucaucuuauuucucuucuagucuccagguagagguagguaggagaggucaacaaaaucgcaguuuuaguguuuuguuuuuuauaaugcuaucuacaaauaaucuucuuagcaauauguaaacagagacauuuaaaaggaaauauucugaguguucaaaauuugaaaaacaguucuuuauuuaauaaacuucuauuaaaguguuucacaaacuaacuuugauuuuauaguacuugaaacaguuugaacuuuuucacuuuucugaauaagugccauagacacaugcacaaagguacacgggcacgcacaggcgcgcgcgcacacacacacacacacacacacacacacacacacacacacacacacgugcacgcgcacacacagccagagccaucagcuaaacaaccagacggaguuuuacagcauuuacuugauauaaggugugaccuaauuucuagcugagaugguuuuauucauuaaguuauacuaucuuugaaaauucauugacaugcuaaacagacuauucuaugauacgugguuucuauauuacacauuaaaaagaaucuauuguauugaauuacuauaucuuauugccaaaacauaaccuuuuauauauuuucaaucugcucaaauucuauacuaaggcacuucuuacaaaagaauuaauccacauaagucaaugugaaaguuuaauaaauugcuuuuaaauaacuugguuuuaggacuauggucacauguuguacuuucuuuucauuuguuuguguauucucguguuauuccuuucuagauuacuuccuccacaguuuccucaggaaaagccagugauuaguguuuauccgccaaucagacaucauuuaauggauagucaaggauuauauguuaccucuccauuaguaagcaauguacguaugugcuaugguuuauuucagaguaauauaauguauucauuacauuuuuauuauucuugaaaucugaaauguauagacauuuucaucuugaaauuaguaaaguuucccuggagaauacuguuuacuugaaguuuuuggauacaaugugguugauuaugugacaagguaaaaacuuaauauaccccaauuauuuaccuuuggacaaucaaauuauugugaagugugggaauauuuuagccucauuauugcuugaauagacuguuaaccugauauuuauaguacugauuguauuagaaauuguuguaagucauguugacacagugcucuuguuuuucuguuuauuuuuuccuauuuuauguguaugaguguugugacucacauguaugaaaugcgugcaugcaccacaugcaugcagggcccauggaaagcagaggucauguagaacugcacuuaugaaugugagcugccaugaaggugugaggaacugaaccugggccucugcaaggacaugaagugcucugauccacugagcccucacuucagccccccauuucuauuuauuccugccugcaaacauugguuaagauuuagaaugacauuuagucacaagaaauuuuguuaccgcuuuuuggagaggguuucuaucauuauguauuacuguuacuuucaguuuacaaugcacucagaucuuggaaaaauuauucaaagucuuuuggaugaguucuggaagaauccuccaguuuuagcuccuacuucaacaacauuuccauaguaaguauacuaauaguauguaaccuuagcacauauuuucauuuaucacaauugaaaaauaguuuaaagaaauugaagugauguuuaaaugagaucucaccuucaugcccauaagaccacaguuaucagaaggcugugucaucuuuuuguagcugaccguccgcccaccuuugugauggcauuaacauggcauggcgcuauucuugaauuucauauuggcuaguacuuauuggucuguuacuauaaaagaugaggauuuuaacuguuggaaauuuucuuccucuuccuagugaaauuauaucuacauaagucuauuugguauuuuuguuacaugacucuugaguauuaagcauugcagagccaagcauucuuuuuagccucuuuguguucugucauaccggguagguaauuccuagguucuguguuuuguugguggguuguuuugcuugcuugcuuguguguuuucuuucccccacucuuccuuaguagguccacuuucugucucacaggccucauccaguagcaucccuuuauuguuucccucagauuuuccuuugcugguguggcuuuaagaaauaugaaugaggugaaaacucacugaauucucuuggcuggcaauuuuguuagccaaauauuaagaccuuaguggaggcuaucggcuauugccauugaagguggccuggguucccucacagaguaacacguggagagagggcagaucagccaguagaagccgugcuucuuauuuagaucuagacaugggugggugcugccaucaucauuucugcuguggacuaaguccacuuggacuggaaagggagaagauaaaaaauccaucccucacuaguguggaagaauugaaaaaaagccuguguuugugggaaguguucaccggaaauccugcaauagcuauuuuaaaaaccacagucugucauagcucugaucacaagaguucaccucuguccuauaugcaaaaccauguucaggcuuucacaagaguuuuucacaguucauauuuuauagacugaggcucaugguuagauuugacuuucauuaucuaaaaggugcuuagguauagcagagguucuucaguuguguuccucaagaacagcucuuagacugaagaaugguggauuaaaaugacaagauugcugccccacacauagcagcaacaugcaaugguagaacaaaccugugauacucacuguagguuacccuacccauaccgacaagauguaggaauucugaaauccggcugggcucacugcuuggauggaccuaugguuuucuuuuuuguuuguuuguuuuuuuauuagguauuuauuucauuuacauuuccagugcuaucccaaaagucccccacucgcucccccacccacucccccacccacccacucccacuucguggcccugguguuccccuguacugaggcagauaaaguuugcaugaccaaugggccucucuuuccacugauggcugacuagggccauccaccuauaggguggauguuccaccuauaggguuccaccuauaggguugcagaucccuuuagcuccuuggguacuuucucuagcuccuccauugggggcccugugauccauccaauagcuuacugugagcauccacuucuguguuugcuaggccccggcauagucucacaagagacagcuauaucaugguccuuucagcaaacgcuugcuaguguaugcaauggugucaucguuuggaggcuaauugugggauggaucccuggauauggcagucucuagaugguccauccuuuugucucagcuccaaacuuugucucuguaacuccuuccaugggugauuguuuccaauucuaagaaggggcaaaguguccacacuuuggucuucguucuucuucaguuucauguguuuuacaaauugucucuuauaucucggguauacuaaguuucugggcuaauauccacuuaucagugaguacauaucauuugaguucuuuugugauuguguuaccucacucaggaugaugcccuccagguccaaccauuugccuaggaauuucauaaauucauucuuuuuaauagcugaguaguacuccauuguguagacguaccacauuuucuguauccauuccucuguugaggggcaucuggguucuuuccagcuucuggcuauuauaaauaaggcugcuaugaacauaguggagcauguguccuucuuaccgguuggggcaucuucuggauaaaugcccaggagagguauugcuggauccucugguauuacuauguccaauuuucugaggaaccgccagacugauuuccagagugguuguacaagcuugcaaucccaccagcaauggaggaguguucccacaaagaaucaagaauuacaguuguucccaaaaguuucaagcuuccccuauucccaagcauauggccaaaauaauacuaauugcaaacuuaucauuauuuaaacuuuaacuuuugacuuauacuucagagcucugagaccagcuccuugcauuuuuccugugaagcucuaaugacagaugugggcacagcugccaggcaguggccagaaagacucagguuaacccuuaacucaguaguucuccuucugcauauuguacacagugacgcucggaagagucccaguguuuugacuuaguuuuacuaguauauaauuuuauguuuuuuauacuugcuuacccaggaaccacucuuaagauguugugcaaaacuuauuucauaauuucaguaguuuuuuuuuuuccuuucuuguggucccaauguuggcucuauuucauuuucuaauaauuucuucaaacuuucuuugcaagucaaacauuaaucuggaacugccauugugcaguuccuacauuguuuccaagaugagaacacacagcuugcaccugggccauuaggacugugcugugcugggcugugcugggcugugcugggccccgugccucaauucuuaauuguugaagaauuauuacaucaaggaaauguaguuucacagaauucaugagacuagaaggaaaaagauauagggaagucagauauaauagaauaauuaugcauaccaaggccaauugaaaagcagucacgcacacaugaaaucucuacagccguuguccaggguuaggagaaaugagaacaaguguuuuuuagaaggagcugcugugggcuucugagacgucuccgucccagccugcugugggcagacccugucuugguugcucuucccagcaacucaguucaggagcucaagcagggcuagaaccuggaggcaggggcugguacagaggcuguggagaggugcuucccauggccugcucagccuacuuucuuaaagaacccaggacugccagcccagggaugggaccacccacaaggggcugccuccccguccccaccccacauggaucaccuauugagaaaaugccuuagagcuggaucucauggaggccuuuccucaacggagguuccuuccucucugaagacacacacacucccccacacaguaccguguguuugugugcauguacacgcaggcacgugggcacgcauauguggggcugaugucggaugucuuccgcauuggaggccucauguauuuuugauucagaguuucucacucacccuugagcucaucagucggcuggcugggcuggccagugagcuccgugaguccucaucuccugccucgcccaucguucagugcuagggcuacagauguaugucucuguaccagauguuaaauaugugcugggaauaacagcuuaagucuucaugcuuaugcaccaagcauuuacugacucagccauuuaccaaggcagccaucagauauauuaaugaguguagaaucuauaaggaagaaucuauacaagggagagagcaguguuuacaagaaaguacuaccuaaaaucugaaauaugcuaauaugaggccauaucaaagcucuuugucauuuuuaagucucaauguucaucuuucaagauaaaaugccugucacacuuucuaaccacaugccuuucaagcuuggccacuucuccaucaagaagaaaagcauguucucuucccucaaaucuggucaguaaucaauaugugugugugugugugugugugugugugugugugugugugugugugugugugugugugugugugugugugugagagagagagagagagagagagagagagagagagagagagacauaaacagagagagacugucucccagucugccuucaaggacagaggcacuccugcugccguagacacugaccuguaugagguucucaagagacaaacagcagagaaaauagagauuugagagugacagaguguaguguccuacaccuuuaauacuagcacucaggagacaggcaggcugaucuccaugaguaggacgccagccuggucuguacagugaguucuagccccuugaaagcuauguaaugggcuuaucuuccucccucucuuauccuucuccuucgcccucuuuccccaaucccucucuguuuuuuguucuuuuuuaaagacuggguuucuucauguaucccgggcuguccuggaguucacucuguagaccaggcugcugccucugccuccugagugcugggauuaaagguguggaacacuaccacccagcugaggcucaucuuaaaaggggaguuguauagaaauggcaggagaugaggucauacagggagagagaucagaaagaggaggaucuagggcaggauucaaagguauauaucaacaaggaacauguaaugaaugugccaagggaagguggaagagaggcuuagcccagagcuuauagcaucuagacuacagcaggaagucuguaggcaggcaagacucagacaguaggugagaacugggccaaagaguagagaggacugcucuagccacuagagaugcucugaaacugucuuaaauuucucuaacuuguuuuugucauaaugaguaaaguaacucauggaacuuuuugugggaagguaaggcaccaggauccacucagagccagcuggccuggcccucugugccugagcugcaguccuagcugcuaugugcuuuuuacauuuugagacugucacacugacuuacucaggcuagucuugaacucacaguucuggcucagccucugaguagcuaagauuaaaagccuacaacaccaguccuagcuaauacaaguauuuuaauccauaauuuuauaaucuguagcaaguauaacuuugggaggcaccuggaaauuggauuauucuacccucugagaagaaaaucuaaaguaagagaguuuuaaacaagcagggauuaaaacuagaggugcuuucaugaaagauuuuuuauuaaaggagauaucauccaaaaauaagcuucagaguuuggaaagucaaccagcaauguuucuugcaacaauguggauaaagaaaaugcacuagugaguuggauggucugucuagagagaagucuuuacaguguugaaggugcuguuugacuuuguuggcuuuaauccauggaacaggagagaaagagcugccgaauauaucggagacaagacuuccugugauuuaauauccagccucucauuauucugcuuuucccaagacuuaagaagaguaaaguucaggggcuggagagauggcucagcggguaagagcacugacugcucuuccaaagguccugaguucaaaucccagaaaccacaugguggcucacaaccauccguaaugagaucugaaggccuccucuggugugucugaagacagcuacaguguacuuacauauaauaauuaaaaaagaagagucaaguucagacccuuucagaggguuagcaauggaucuucuaggauccaggcagugccuuaucaacuguccaguaaggaaaacaccuaaaaccguuaaagguguugucucucagcagccuugcugaaaaucccauauauacauuucagaccuugguuuguugcuauuaucugaaaagcaaagaggugaucagguccuuaaucaucuauaaauaagaaagguaagcaggaaggggaaaaaaaaaaaacucacuggcaaaaauagcccuacuguuuuuucuguuugugcugggaaucgaugccuaggauugugugcauugugcggacuuuaccacugcacugaggcccuaacacacucuccuucugucaggauauuccuuuuaagugugauauugcaucucuuagagcuaucugguuuucuuauaugcauuuuaauauugucauuuuuuucuagaaauaguacuuugacaaauauuguaaaacuguccucucuccuagcuacacucauuucacuuacacacacaaugcccauuuauccaugcccuuuccaguaugggauauugucagaagagaucucugcccauuuugugggccuuaaaaaguucuuucguuuauuuguuaucuaacaguuuaauugcacacuguuuuccugauguaaagauacuuuauuuuauggaaguuauauaccauuguguccucuauuugcuguuacauuuguuuugggaauucuuuauguguuagaaaaguuauucuucuaugugugauagggcuuucaguucaagaaaauuuccaacucagguuaauuucugucauuaaguaagauuauaguaguucuauaaaauuuaguuuuaugcaauuuagaauuuguaccaacauaaagugaaauauuuuaguaguuacuuaguauuaucucaaauauaccuuuucuuuaucugagagucacuaauugaucaaauuauuauuaacucaaauguauguguuucugugauuuuuuuuuuuuuagucuucauuuaggccugaaauacuccucauucuuauauaauuugauuucuucucaauuuuucauuuguuuauuuuuuuuugagacaaggucucccuacauaacccuugucugguguagaacuaacuguacagacaggguggccuugaacucauggaaaucugcuugguucuauguagugcuggaauuaagggugugggccauugaagccagcuucucacuuuuaagggagaaauauauuaauuuuaaaccauccugcuaaaauauauauuguuuauucugcugucuaagucccagguaaauaaugaauugcuaguuuuuaaaguacuccguuguguuuauguacaaauuuguuugcaguguuuuuuaacauuauauauauauauauauauauaauauauucuauauagauggauagauagguagauauuccauauauuugauuuuucuuuuaaaaucuguagacaaacagccucaacuuuaagguagauacugcccaacaucaagagccauuuagcaacauuaacuugaguaaccuucuggacugaauccucuccguaaagaaacagaacuaagugaugucacuggaguaccaacaacucagugacuucuaauagacuuacagagagcaguggggggggggccggugcuuucuggagcaauccuacuuuucauagaaaccacauuuuuucggaggugcuuauaguuugugacuuaaauaauuuuguuuaauuauaaaaaucaauugccagaagaaauuccauguauggaauuguauaaccacuguuauucaggacaauuuagggaugauucgacuccuaacaccugccuaaugauggucucuuucuuucuucagccuguauaguaauccaggugggaugccuccguaccccucccagggguuuccauuucuuccuccauauccuccaccagaagcuaacaggaauaucacauccuugucuguagcugacacuguuucuucuucaaccacaaguuacacugcagcuaagcccguggcgccuucauuuggcauccuuucaagucugccauuaccaguucccacaacugaaucuucagcaucgguugguaccucuggagucuguguuuuguaccugugacauggguguuuggucagcuagccuuuauuaugucuaucuacuaagcaaggcacaaaagauuaaaucauauuugucaucuccgauaacagacucaaaaagguaaccaaugaggguuugcgcauauaguuucuagagauaguccagagcugugggagacaauugaggccacugccuccagagaccaaaguagauguaaugaucaguccaguuuuuuacuucauccccagugcuucauacugcacacuuaguacuugcuuaguggaaaaugaugcagauaaaugaaugauggauuuaugcuugaggccagauuuuuaaagaugguuauaaaaaaaucugaggauaucaagagguuacauaaagugacuggagguuacacagugauuggaaaacauugacagagucuuguacuauaugcggggugacauguuuguaaaguugccuguuacagcucugucuggaugucaaguaggauuuacuggacaaggcacaagauuggauuauaccagagaagcaaguaucagaucaaagaggaucuauugcagcaugcucaaggcuuccagcauuuuauuggcuuaaaauuuauauguuuauaaguaaugcugguagcaguugccauguaacauauuaaagaaaaaaaaacaauauuugauguuuaaacuauaucuguggauuuggaggcuggcauaaugauucaggcauuaaaguguuuguugugcaagcacacagaacugaguucagaugucuggcaccuuucauaaaguuccaggcaugguaauucaugccugguuauaaggugccagguguccuugauacauuuccagaacugagguaaaaaacaugaagaguaaagauggucuugucugauuuacuuauaguuucauauucaaauuaaauaaaauuauuuuaaagguuuucacuguucuuuuagcuugguaagcgguguaaaucagcuuuagucugauaaauuuuuagacuugccuauaccuagggauuacucuagauguaacgguuacaaaguucucgguugaguaagaaauccugucucagaaaagaaaaaaacaaaacaaaacccaguguugaccuuuggccuucacacauagcugcucuuguacucacauauguacucacagaaacacaaauauuuauaaauauguauaugcauauacauuauguucaacauuaccaauuuuauauuuuauaaucauuaaaaaaagaaaccugaaugaauuuugguuuuuccaaaaucuuucaucauuauguuaagaaaagauuuuagccgggcggugguggcgcaugccuuuaaucccagcacuugggaggcagaagcagguggauuucugaguuugaggccagcguggucuacaaaguuacaaagugaguucuaggacagccaggccuacacagagaaacccugucuugaaaaaccaaaaaaaaaaaaaaaaaaaaaagaagaagaagaaaagauuuuaagcaaacugcuuauuugauuuuuuugagaccgagucucaguaauucuggcuguucuggaacucacucuguagcccaggcuggcccugaauucauagagauagaucugcagcuucuuccucuugagugcuggaauaaacaccugugccguuuuucccagcaacaaacuaguauuaauauauuuuuuuaauuaggggaaaauuuggaguguucuaauaaaaacagucauaaauauucaaauugguacuauguucuuuaacuauccuauuuuauuuaacuuaaauauguaacuacccagagugcuggugguuuacuaauguauacuugaugucuuuauuugaaugaagcauauucauuuauaucuacgaaauccacagauaauucugaacaccuguuacaauugcucauaagagauuuauuuuauaaucauauacuuugacacaggcuaauaauacaggcucuuccaagacacauccuccccuccccccuccccccauaaaguguaaacucuguauagaaguccagagaacuagacugguggggaagacuugcgugcuggugugaugugcagagauggaggugcacagcuugcucgcugagagacugggagugagagcacugcuagaugcagcacuucaguuauuucuagucgguaaugcacucacucgcaaguauagcugagaccuaauacucuuuaaaacucuucuuuagguuaaccaaaaugguuuugguuauaagaugccggauauuccugaugcauuuccagaacuuucagaacuaagguaaaaaaaaaaaacuugaagaauaaagauaguuuuaucuguuuuauuuauaguuucauauucaaauuaaguaaagugaauuaaguuuuugacuguuccuuuucugugguuguccuggugaguaagugguauaaaucagcuuuagucugauaaauuguuccaugacuggucuguaccuagggauugcucuggaugucaugacuaccaagguaaccagaguucuuuucucuuaugcaacuugcaaucuuggagaauuuuuuggugaaugcauuagauucugaucaauucaaaauagauuuuucauuguuucuuuaguagauuaauguaucucgaugaguauacuaaaguuauaauauauucaaaaacuaauuuuauuagaagccaaaguuuuauucaaauuuauagcugauacaguggcaggauuaaacuuuaagguacuguuuuuuuucauagaacauaagaugugccaugaauaaaacauuuuauggucuuuccauuuagugggguaccccaugugccccacuaaggauuuauaauauccacgaggcuacuaguauuaagaacauugaauacaauuaagaauaauuuggaauuucaugucuuuagaauauauucuaccagcacuacagauuaaagccuugugaacaauguuguaauuuaaaauauaaaguuggacuuuguuugucuuuuaguucauguguaaacauaaaaaauaacauguaaagaaugcagguuccacaacagaaaagauguuugcuguaucuuaaggguuaguaugcauuauaaugcucaaguuccaaaaauaacgcuguuuuacaaaguauuaucuuucuuuuuuccuuuuuaaaaguuuaccugcuauaaaaguuaugaaaacaucaaaacuacaggaggagaacuaaacagcgugaacagccuccauacuuagccaugcacaugguucccucugucuccggggccugucuguuccccucugcuggguaacugcaagugacucaggcuugcucucugcagccugcuugcugagguuuccuuuuuguuuuccuagcaccuacagggugcgcagcccucccacaucaaucacuaaguaagacagugccuuaggcuuaccugcggccuacucuacaaaggcuguuuuucucuguggagguuuccuucucucccaugacuccagcuuaugucacauaaaacuacccaucacacaagucaagccagaaaauuguggacauuugucauuguggagaaaaaccacaugacuaacauuuauuaacaauuggcuuuuucuuuugugucuuuagugugucacagcucacagauaugaaugaacaggaggagguauuacuagaacaguuucugauguugccucaacuaaaacaaauuauuacugacaaggaagacuuaguaaaaaauaucgaggaauuagcaaguaugucucccuuugcuuugauucauaauuccugagaaaaaugugaucugugcugagaaauaagcagagauuuaucuuccaggaaaaaaucuccuuuuggaacauagcuuggaaggcaaaaggcaaaccguuuuagauaaggugaguuccugaucauuuccaaggcauuuuuacucuucagaaaucaaaauaaacagcaauuuuauguuuucuuuuaguaugaauuacuucuacaaaugaaaucuaccuuugaaaagaagaugcaaaggcaacaugaacucagugagguagggcugaugaguucuuucugucccucaggagcugcucagccacaggagcuggccccgcccugugcaucugacuuuauaaagcugacugacagcuggaaacagaguucuuguucuuucaggguuugucuauuuccaaauccuauaaggaaugaaaccccagcaaagcaggaaaguaguguaacugcuauaauaaaaccuaguaacaaaaagauacuuuacauuaaguauaauuuaaaagauuagacugcuacuuaggaaaaauaaucuuuaaaaauaaaauagaagauguaaucuuuauagcuuauugcagcaagaaacauuguaguuaauaauuuguuucccuuaagagaugcuuauauucucuaguuagaauagcauagaauauuaaguagaaugaaagaguauuaauaagacuugauucuuuagcauaugacuuaaaaguuuaauauuuccaguaaucucccaaauaugguuuuaaaaaucugaguggauuaaaguaguuaggaaggaguugaauauaaaaggguugggaaaaacaugcuucaucaacaucaaaauauuguguaaaugucauuuaaaaugaugcaguaguuuuguaggaagauggaaaauaguuguauggagcaggcugcaguucuaaaauagauucguguaugugacuaauaacuagaaaaacuucaggagucaacaaauuguguaauugcuuauugguuuaggaucugaugaaaaauugccuucaucuuuuauaucaaacuucauaaaggucauauucuacagaauauagaaaaguacaauacauauaguaucagaacaaaguauaaaaaucaguuaauuccuaggaauauuuuuaaaugguuuuuuaaugugaaaaaauuaaaaaguccuguuuucuaauuguaauagaaggcaaaagcauagaggaaaauguucacauuugaauauauaaauuuaaaauugagaaguacuaaaaauaaaagugaaugcuuuuguuaagaacacauguauaauauagacaacacaaaaguugcuaguggauuauaaagagcaaauaagaaaguaggaaacuccccuaagagaaaaugucucguaaagaauucuguguaggggcugagcgguagagcaugugccaaacauuuguaaggccucagcugcaccugacacaacacaggucagcuuuaccacuuuuucucaccccuggacauguauguaagaauuacuugaggugauucuagaaauacuuaaaaauuguccugagguaguggcgcacaccuucacccacauacuuggaaggcagagguaggcugaucuccgugaauuugaggcuagccuugucuacagagugaguuccaggauggccagagcuacagagggaaaccugucucaaaacaaaaacaaaaaacagaaaacccauagauauguuuguggauuaacuucugacauuacuaggagacggaagucucacaggaaauucccugauccuuugcuucuuauaaucuuucuaaauuuccuugaaucuuagcuacaggaguuguuuuguaucuguuuggacuggguucuacaacucuguacuugauuaguuguggucuucuauaauggucuuucugguauauugcaaagagacguguuccuuauggaggcgaggacugcacuuaccuguggauuaaggguuaugcuggauugguaauguggugguuguagguucuuuaagauccacaacuucacuagucccggcuaguuaguuggcuagguucccaguuacaggcaugaauucccccuuuguugaacagguccuagucuuauuagaaggcugagcaacaaaucaaaagaggauuucucaugccuaauguuugauuuuuuuuuuuuuuuuuuuuugguuagguggucuuugguucuuggagggagcauugucaacccagaagggaugucauuugaauauuaauauucuuuuuuauacucuuggaauguauuagagugcauugauuuuguagaucuuuugcguuaucauugucaucguaaccuaacaaagacagacaagaacaggaauacaaggagaugcaggucauugggucauuugaguagguauucucacaaugauuuaauuccaaaauaucuaggauauaacaguggauuuucaguuucucauuuaacaguuuuacaguuugugauuugguuucuuuugugcuugcuaucuguauuugcuaauuguaggucaaauugacacaagcuauaguuaucagaaaggaaggagcuccaauugagaaaauaccuucauaagauugggcuguacaagaauuuauaguacauuuucuuaauuauucauugauagggggaggaccuagcccauugugagugguacaaucccugggcucuauaagaaaacuaaguaaaccaugaggaacagauacaauagcagcauuccuccauggccucugcaucagcucuugccuccagguucccaccuagcuugaguuccuguccuaacuuucuucaaugaugaauggugauguggaacaguaagccaaacaaacccuuucaucuccaguuugcuuuuagaagaaacccuaacuaaugacuaaggcaggauccauccaaguagccaaugcugaagacccccguggaucuugcuucucauaucucugccucauuuccccgucuguaguuuaucugagaauuauagacuaaugcauugccugauuuuuuuguuuguucacagaguuguagugcaagugcucuacaggcaagauugaaaguagcugcacacgaagcugaggaagaaucggauaauauugcugaagacuucuuggagggaaaaacugaaauagaugauuuucucaauagcuucaaggaaaagagaacaguauguaauacucuucaauugaggauaagugacaacauaauaacaauuuuuuuaaguauguucauaaguaaacaucguuagcacauaaccaagccggaguuuugacuacugagcagaaucugaaagccucuuuggggaaggauagcgggacucuacuguuucuuuaaaccuguuaguucugaguacacaagcagguaaaugaaaugauaguucucauucaggaucaguaguaucugugucauuguguaggagcugguaaaucagcuguaauagucugcaaacaaccugcuuaacaagucgccuaaauacauaaucuguagacauaaaaaauaauugaaauacgauuuaaaacuuucaagaacagcuucuagucugguauuuccauuguauccaaggggggaaaaaucugcuuaacaauuugaugcuaaauauuuaauaguccuaaauauuuaccuauuaucucugaaacaaucaccuuuguuauuuaguaauuuuuaugaaauguuuguguguaggguuguuugugagaguguaugauuguguguauguggccuuaaagaagacagggcagauuuuaugagcuucauuuuucaugagagacaaaauucagagaugguuauuaacuugccuguguuuauaguauuaguaaggaauuuguuucugauccauucuauucuguauagugacacuaaaguuuguuaaucuuccauagucaacaagagcaaaguuuaguucuuuuuuuuuuuaagcacaggcauuugaaauuaaauaaucaaaauuuaauauuaguaaaguuuauacucaaagacuuuucacacaaaccuuaauguucuucuggauuccuuguaaauucugaagaauuacuagcuaccuuaaauguuaaaaagcuaaaggaauguuaacaaauuaaaauauucuuacuuggaauucugucuuaauguaggaagcaguuggaaaagugacugguauuuuaaauaauuuaucuucuagauuugccacuguagaagagcuaaagaagagaagcuucaccaggugauagcgaugcacagccaauuucaugcuccucucuagguaugcauuucuagcuagugucucaaggcuguuauacaagugugcuuuaacuuaauaguucuuaacagugccugcucacugcuuuaacaugauucuaccauuauaguuguugauuguucuaaaauguugacaauuauaaacaugaccauauaaguacaucuauaaccaguaagaacucuguagauaauuucucaguacuucuguauccuuagugagagugugcguuucuccuaaggguagcuuacagucaugcuucuaccauuaggaaugucuuguuuacagaagaaaaccuugccccguauucaauugcugugauaaaauaccaugacgaagguaucuuacagauggaagaaguuauuuguguuuauuguuggugagggagaauccauaauggugaggcaggcuuagcaucaggcagcuggagcgggaagcugaggguucacaucuuuaaccacaacaugaagcagagagcagacuauuaauacaguguguugugaccucucaaaguccacccauagugacuuacaagcaaggcugcaccaccucccaagacagcaccagguggucagcuacccaggucuauugggguagcuuucuuucaaaccacacaaacugaaauaagagcuuguuaacugaaggagaacacaaaguuaaggaaagugcagcccaguuacugagacagacgaagccucucaguaaccaaaacgcaucuuccuucucaggcuggcuguuuccgcuuucugcaugaagucugaucagacccauugcuuuccauguauucagcaagcacugaccuacaucaccaguuccauuuuuuagucacccaucaaccacagcagcugcugugcacugagagucuugaguugcaguacuaaucccuaggagaggaugaaucagcugcaugcagccaucuggcugaaggagaggacuuuaaggaggagcaugggggauucuuuugaaaagggauggaguaauaggcauuucuuaucucgaguuuuuauuccauuaguaucgccucugaauuguguuacgucuuaauuuccaaacugagauaauuuuuauacuacuuguguuuaucccagaucccagcccaagcaguagaaauagauuauugaaaggagcacacuguaaucuuuuccuugcccaguuccuucccagucaaguuacaauaccuuaacaggaaggcaguauaaaggaucaggguugauaaucuuaaauuaaaucuuaaauuugacauuuuuuucauuucagauuuuccugaaaccaugaacuaccaagagagaaaugggacacaggccuaagcacauuguuuucuauuuaugacuuagggaugggcacuugaaaccauggcugagguccagaugcgauguagauugucuaucaccugagacugauuccguacagauuagaaugacugcuauauuugacaaaacuuucugcacuauuugcacuaaagauguuuauuguugacaaauccuguauuuaaguuccucuauuucugauuaaacaucuaugcauguaauucuagcuaauuuuuaauauuuuuaaaaacuacugauuuacauuuuuaguuuuaacuugaagcugccucauuuaucaagagugcuuauuacuuagauucuucuuccugucagccuuuucuuucaaaaccuauuuucagcugugaaaaggucaucuagcccaccccgauacacacacacacauacacacacagacacacacacacacacacacacacacacacacacacacacacacaccccuuucuuucuagaugaugaaacuguccagagcaguuuguuuucagauauucagugucaggaaacagcaguccugccaaggugccaucucaagaaagcaaccuguaauaccugcaguaaauaagagugaagaaucuacuuucuuacaguuucacuuucagacuaaagauacauuuaggcagcgauacaggucaaugcauugguuguauuuuguucuggaacagguugcacuguguagcccacucuagccucaaacuugugcuucuccucccugaguacaggguuacagacaggugccaucaucucauaaauagauauuuuacuuauuuuuaaaacugucuuucacuuaaaccaguacaauacagacuuccaugcuaacuaaaauaaauaaguauauauggguuuuggguaaaugauacuccuuuuauauuccaaauguaaaaacaaacaauuccuuuuguuaagaaaugguaaaucuaggcagaaauaguaaaauuuuaauacuuugacuugacuuuuuaaacauuuuuuuuccuaagaaagcuuuauaauaacaaguaaugucuuaauuuuuaaugaauuuaauuuucuaauuguagauguauucagcaauuuguuucuguauuuugucacagagcuaaagaagaaaaugaguacauaucugagguugguaaguuaggaccuaaaucacuaaauaccauaacacauaauugcucaguuuucauccgugacugucauuccaaagccugcauacauuauggauugucuucauuuuucuuacucuacauauuuuugguaauggaguuuuaagaaagucauaaauauuuucuuauugaaaauuuuuuucauguuuguggaagacauauuccugugacuauaaagauuaucccgugcuggguaugcaccaugauagcugccugucuugcuggcgcuaauguuaaggguaugcuauggaauccucaggcagaccuacagauauaggugagauaacagguggagucauguuucacauuugugaccaacuugggggcauucagagacuucugaguguacugguauuuguguuuaacauucccagcagucaccauagucaguggagaauuugccagucacagucuaguugcuuucuuaaaaaaccagggauaucccagaacaagagaccagcagucuucuuauuaagguuucugcuagacaccucacucaguauuguagaaagacuacccagagacaacacaagugugacacacaaacacaaacacacaccacacuugcucacccaggccagggcaugcuuuucuuuaaauuuguauuauccaaguuucauugucaauuaaugaagcauaauuucucccuaaaaauucagagagccucuuuacaauccagacauuaaaccaagacauuugaccacaguugcuugccuuuagcaaguugacaaacuaguucagacauguuuauuacuuguagugaauaucugaauaugccagugugaauuugcauucuuuauuugcaggagacagaguacaugguuguaauuuuauggccauauuuuuucuuuguaaaaauuggcuauagaucugaauaccaaacacauacucggauuuuacuuuaguauaaaggaaagcuuaggaauuacuagacuaccuagguagaauuugucaaggauauuuaaagguaagcuguaacaagucgggaaagucaaaguugggugaaaacuucagauuaaaugaacagaguauagaacaaagguuguuugaccacaguuuauauauuuaaauugcaggacagcuaagauucuguuguaggagaaagaaguaaauugaaguugugcuuucuguucuuuuaaggcaggguuucuagcccagacugcgcucuaacuuugauguaacugaggaugaccuggcugucgggucuuccaccucuugaguacuaggagccuaagcauguaucaccaaccccaguccuguggagcuuggggacugagcucagggcuucaugccuggaaggaaggcacucuuaucuauuggccgaccugcauccucuuaaggaaugaaaacuugggcuggggagguggcuaagugcuaacuugugugucaugcaagcaugagggacccgauucaaauucuuaggaccuauauaaaaaccugguacaugguagaacaggccugaaauuccaucacuccuauacaggagaggaaugagagacuugucccaggaagcuuugcaggccaauuuauauaguaggcagaauggcagccagugaggcccuuguuacaaacaaggucggggcacggccugacaccuguuguucaguguuccucucacuucagcacugaagguugcugggagguuuuguuuuguuuaaauugccaaaugacuuguucaaacaugaucaaaauuacuaaucaauugagcuguaacuauuaaagguugggaaguaauguccugaauaaguuauauauuuugaaguauucucugaacacugcacuaaauaauaaaacaccucacaacugaagcuucauuuagagugaacauguaguacuagagguuucuaguugaaucgaccaugacuuauccagggacucugaaaggcaggcugcagugagcauguguagcuucaguauugacuuguaaaaaaaauaaaaaugacuccaugaacauaccuaaauuaugucuuguaaagggauggagggaacaaaaagcguguggcucugaugcuaauaaaggugucacauuaaaaaguaaaaaauuuaaauacauacauacugcuuguuuuuccaaauauguaguacagaugauguuuuaucuuuguuguugaccuauugucuaaagagcagguacuauacaaauggcgaaacagccaggcgucaugacacacaccuucaaugccagcacuuagguggcaaaagcaggcaggucccugaguuugaggucagccagggcuacagagucagauguugucuuaaaaaaagaaagaaagaaagaaaauaagugauuuauguuauaaagcuguaaaagccauucccacuauauuccauauguuuauuagcuauucuauaggaaaugaguaaauauuccuuaggcuuacuugggaaacuuuccaacagaaaaugcucaauuuaacaucuaaaggaauuacacuugcuuuauuuuuguauuaauaauauuuuuauauuacaggccuuuaguauauuaaauucauucugucuucaaaugugagcauuauuauauuguaugacauuaugugauguguguguauaacucacacuauguuuuaagucucuuauccuuucauauuacuguauuucuauuuccaaaaaaauugaauacauuaucugauaaaaauuuucacacuuuaaaguacuguuauaaaaaacuaagauuaaauguaucucuuuauuagaauguacuuacacuguaaaaucauauaauaagaacauuucaguauguucaaacacagcaacauuucuccauuaagaguuuucagaucaaaagcucaauucaaauccuguuuuaaaugcauuuuaacagaaacuucagaauugccauccaguaguccauggucaugagauauugcuaauguuacagaaaacauuagcuuucuauagaauuuguaaaaugaaaagugcuguaaccuuuauucccuguguuuagcagauggguuggggguuugaagaauggcucccaaaggcucaucuauuugaaugcucuguuccugguugguggaacuguuuaggagggauuaggagauguggccuugugggaggggguuuguuccugggagcugccuuuaaauuuucaaaaagcccaugccuuuucuaguuagcucucacugccucuugguuaugucuugaaaugugagcugucagcugcugcuccaaugccauaccugcuuggcugauaccaugccuuccaccaugaugguuguagauucuaacccucugaaacuguaaguccuaauaaauccuuuauucuaguugccuugguuguggugucuuaucacagaaagcaugcgauaacuacaugauaagcaaauucccucguucuugaccuuuucccuuguugauguaucacuaccuacugcauuuagaguguuguaguuugcaaucagguuggcuggcucacaguuuuguuauguguaaucucugaaagaguaguaaaaggcuacuaagagcuaaugucuggacucagauucgagauggagaaaaugaauccagcuucagcuuaauagguucuacauucaugguaaagaaagacagacauuuuuuugagaagcagaagaugcuccacaggggaaaaauaaaaugauuacauuuauaacagaaaaggguacucuccauauuuauuucuuuuaaauauugguaaaggcagaaggaaaugucaaaguuccugaaugcaaccugcaacuggaagugaaaucaaagucccaacauuaucagguaugggagaaaccaggagggcuuuuaagcagacacaugcuaugccaggaaagacugucuggacaaccuugggugaagauacucucucuccuuguagugauauaauuuucauagucuagcaugagccucaggaaugaugaucagucuucaguaugauuugauaaaacaacugguuauugauaaagagcuuuuuuuuccccauuuucacagcuguaauuuuaugguucuggauagaacuugccauuucucaacauuuuuacuacgaauugcacuuuccccuuaauuugaaaguguuucugugucuuuuacuuuggaacuccaaaggggaacuuaggcagugagaaacacagcuucguccgagucccgguccuugccacugucuucgcugggugcaugcucaccaccacugggagaucgacagcucaaauccuccaccccagacucuugaucacuauucacugagaggucggggucugagcuuuuuaaauugucuuggguuagaaucagagcagaaucuucaucacccugggacgggcuccuggaugggaaggacuugcuguucccacuguaauccugagggguguuggcugugcuguggucugagguagagaaccccgaguguuugcugggcucacuuugcuuacucuucacuuugguaccauguaaguggacuuucugaauuuuuuccagccucuaaaaaaauaaauaacaacuuuaagaaacgucacaauuuauucuugcauauauauuugcauaccuuugacucccucccaguugaggguaacauuaaggacaagacucuuguggcaguugaaaaccagaggacaugaacgucagcaaaacuaaccgagaggcuugcuuucuaauacaaggaugguaguaagcgccuugguaagacugucuacgaugugaacaauacaauauaguacacuaccuggaaauggagccccacacuuuuuuuuaaaugacuauacaauuugacauaauuauuugcauuguauuaacacuaaacuuuuuucauuuuugaaacauuuguuuuauguauauagguauuugcuuguacuuaagucuguacaccaugugugugccugguaccuguggaggucaaaagaggcuguuggaucccuaaggaaauaaaguuacagagaauuguaag

SEQ ID NO: 4408 - RNA, 609 nt, Mus musculus
caugggcaaaggagaucccaaaaagccgagaggcaaaauguccucauauacguucuuugugcaaaccugccaggaagagcacaagaagcagugcccggaugcuucugucaacuucucagaguucuccaagaagugcucagggagguggaagaccaugucugcuaaagaaaaggggaaauuugaagauauggcaaaggcuggcaaggcucguuaugaaagagaaaugaaaaccuacauacccccaaagggaaggccaaaaagaaguucaaggaccccaaugcacccaagaggccuccuucuucuuguucuguucugaauaccgccccaaaauugaagacgagcauccuggcuuauccauuggugauguugcaaagaaacuaggagagauguggagcaacacuguagcagaugacaagcagcccuagagaagaaagcugccaagcugaagaaguacgagaaggauauugcugccuacagagcuaaaggaaaaccugaugcagcgaaaagggguggucaaggcugaaaagagcaagaaaaagaaggaagaggaagaugaggaggaggaugaagaggaugaggaagaggaggaagaggaagaugaugaauaag

SEQ ID NO: 4409 - RNA, 145132 nt, Mus musculus
cggguucccgguucccgccuggccgccagggugcuggugcggguuggggucgaucugcaagccccagguacagacgucuccaaggcaggacccgccgagggugcagaacgccguggcuccccccagggcuggcuccccggcucugcgggcaagcgcggaguggaucccauuccgucgcccaucccggccgcgguggggaccuccggagaacgaggagcuggggagcggcgacugcaacgcacucacggugaccggacuggcuuuccggggaggggggcggguguccuaguggguuucaaaguaggaggaguggggaggcugagcucacgugggacccgcggggcuccugcaggacagcgggcugcaguugcugucaccuugaaagugaccgaggcgguggguuuauuguggauaaaggacaacugucaaguuugcauccucgguggaaagccgcccaccaagcgcuggauucuggcucuggaccuggcagccucaggcuuccggcugggcgacuugccgggguccauucccacuaagcagucagggcagaaaauaugggagaaagggaauuagugcaguuccccagguccucaugcggguuuuacucccugcagccugcggguucuuacaaacucuaagggaaagcccacguugagggucgccguauugauuacucaauagaggacuuagcucgaauuuccgcgaagucuuugcgcccccccccccaacuagggugaucuguucacuuuucacuuguaaaagugacacauugaauuguaaacauagcuugcauacuggcacucacucugcaaaaugcuacuuuuaaauugucuuguguucuaccagaggaaauccaguguauuuuguuugucuuaaaaccagagucuuaggcaaaacaggaggaaagcgagcuuucauguucugccaggugauuggaguucaaucaagguaucaaaucacagcgcggugggggugggaguggauuccggggauccggagacaacuugugggagggcaaaaaagagguggggucgggcccccgcuaaacauaugaccucuguaaggaauguuuuacaaauagguuaucaguuuaaauaguucauccccguucucuccagcaaucccuuuagggcaaucuguacucuguuguguggguguguuuaaacuucuuguuuacagauuuauuucucaagaacuguaucgauaagaaaaguuaugcaagaaaaccuguuccugcccuguuuuuuuaaaaaaggcauagaauuuaguuuaaaauacuuuuaaaauguuguaucgaucuucaccugaacccucucuccacugccccggccccccccccccgugacccacccccuuguucaauggauggagcgaagaguuuuguauauaccaaacaccuggauuaucauugauagcugccccagccccucaccuguuccuuuuaaaaacuagauuuaugugggaaacaaauuguguuugggagaggucuguaccuuuuaauuaaccguuaggaauucaaggauaauuuuuguaggguuuagcuaggauugugaaauucuggauaaauuucuuguagacuuuuuggaaacuagaguuacaagaauuaagcuuuuaagaagcauguugauuaguaacccugagagcucugauuucaaccggaauggaccgcugauguauacaguuugauacauucaggaaaauaagagucaaucccaccauuucucuuuuucuccccuuuguaaacuauaaugaaaauucccccauuauauaaagccuucaaaaucuuaauaaguguuacacauuauauucuauacacgugucgauuuacuuaaccuuguuuuacaagcugaucuuuucauuuucaguuacuguaauuaaauaugcuauugcaacccuuaaucgcuuuuaaaauuuugucugcaagguagguuuccuuaggauaaaguccuuggaaaucacaauuaguggugcaaaaguuucuuuuaaaaauauugaacuuuggucuccaaaacgccuuagucaaacuaagcagaccagaacuggcucuuguguuaccgucuuucuaacacccuuaaaaggaaguaguauugccagcuuuauaggugaagagugcaaucuugguauuuauguuuccauuucuaggauugcaaauguuaucaaguaccccacauggguuucuaguuccuuuucuuguuuucuuuucauuuugagacaggguuucuuuguguagccuugacuaucuucaaauuuguccuguaaaccaggcuggccuugaacucagagaucugcuugccucugccucccaagugcugggauuaaaggcaugugcuacuacaucgggauaguuuuccuuuuauuucaguguagcaucacauuuuccucuugggauauuggcauuuuucuacuuauaaaaaccuccuccaggccguuggguuggcauacaucuguucauacugcaaauauuuuucucaauuuguguuugcccuguaaacacauuuauagauguguugacuuccagaaguguacuucaguguugucaaacauguugguuuuucccaaaauggauguuuaguaguucugagucacaguuuaggaaccacauauggcugucacuucuggaacuaugacuacaacuucuauguucugcaguagcugcuguugugcaauuuuuuuuuccuuuugcacauguuaaugacaaauuguggagaaugguauaugucauuaggacggucuuagggcuuggagaaauggcacagucugcuucuuccagaagaucuggguuuaguuuccagcccccacaucaggaagcuuacagauugccuguaacuccagcucccuagggaacuaguguccucuuugggcccuuuguaugcaccugcacucaaucagaucagaacacuuagggaaacuguauauaaauguugggugaggguuuuccugauucuuugggaccugaggaaucuugaaaccaucuauuuaaucuuuaggacauuuuuuucauaucucuuucuguccagaaagcccugcaaucacucuaaaagcuugaguugaacccauccauagaauguguccauaagcuuaucaugucuugccuugcccuacccuaaagcugagaaaaugaucaagacaaucuugaaucuagguguuuguagugcuuuaaaccucuaucagaugauuccauguuuguaucuuuucagugacaacacuccacagaucuguguuuccuaguauucugggggaaaccuuuuuaauucauuggcuaucuuaucagcauggcugugucgucugugagcuuuugaauucauugaugaauauuuuaauguguucuuugcuaccaauagagccaacaacucaaaaguucagagaugucuuugaagaaacuuuucaauuggcaucacauuguuuggaauuuguuuuauguguaugaauguuuagcuugaauauguaccacaugcaugucugauguucauggaggucagaacagggugucacauccccuggaacuggacuuacaugugguugugagccagcaugucguuauuggaagcugagccaagguccucuguaagaaccacuguuaaccacagacucuucucucuagccccuuaccuagcauuuuuaugguauccaaagagguaacauuguguguaugauccaaaaucaaguaguagccauuggcuuggaaagagacagcauucuccuccuuauccaguagcuguguggcaauggaccaugugugguugguuagagcaugacuacauagccaggucucaggauguaugccugcaguuguagcacuggggagguagaugcaguaagaucaagaccaguguuggcuacagccuaaaguguggcuagcuggguuuacaugagucuuugucucaaaaaguaaauugucaaagucuacagagagcugcaacuuucacaucuggugggacuguucagagaacauaccuuuaaagauuucucuguaacagcucaaaugguuagaguuucagauggccagcaaauguuaguugauuuggacuuucuugaaaucucuugaccaaguuuggccuucaccucacagagaacugacagauucugccuccacccugcugagauuaaagccaggugccugaaaucuugugcuuagccaagaaauguaggugcuauacaaucaaaacaacaaagucugagaaacuuaggugcuauacaaucaaaacaacaaaaucugagaaaaauguaaaucccugggauugaaagucuuuggaauuugcggcucuggggauuauaaagucuacucucuuauaguccauuugcaauuuuugccauauuuuuuccccauuuuuuugaggcaggguuucuauggaccaggcuggcccccaucucagaaaucuucaagacucugccuccuaaguguugggaucaaagguaugugcuaccaucaccuggcccagauuauuuuuaauauucauuauuguaguuuaguuuaauacggaauugcugauacguguuuucuugauguccaaaucuauaguugauaaguuucccaaauucuaacacuauuaauagauuaaguuauguuuuuugaagggggcgaaaacaaacaacaaaaacaacaaaaaaaccuuugaaggcuugagauagcucugcucuggaaucuugacucuacucugggucucugaagaccuugagcaaguuuaucaucagccccccuucuugcauacuguccuuaggcccuaggggugugccaccaagcugagaguuaagaauggcuguucaggguuuauguuugggcauccaaaaaugucuccauaaaaggagaugacacucaacagacagacagacaauauacagacauacagacagagcgagcaagcacuagugccaggauauguuguccucugaagaaaaagaggaucugggaaauggcuaagcuagccugaagucuuguuuuauaaaagccugcuugacaagcgugcagacuuugggugcagucucuauccuuugcuuaggaugguucaguauaauuagggauugaaugugacuuucuuugaaauguuuguuuccaagccaaauuucauaaaaguugauggcaguuacaguuuuugaaaugacuucaguguuucuugaaaucagcuucccuuucuugugggcauuuuucccauuauggcacaaaguaucgccuuagcuuguucacuugguccaagauaaagaaaaaaaaguguguauuuugggauggcauauuugggguuuuuaucuuuacuuuguagaaaaauacagcaacauuucuuuuccuagacagugagcuaauuugcucuagacugugucuaaaggugcuuuaccuaauagccuccagaguccagaaguaggaacauacggaacguuaacacaacaaacucuuugucuauuaaggccaaucaguuuaccuaggauuaacuuaaaaacgauuuugcuuugagguuaugaagcuaaauauaaucuuaaagucauuuuaaguuucucauaagcugccauuguuugcuuagauaugucauuguauauguguguguguguguguguguguguguguguguguguguguguguguguauguguauggguguguguguguagacugggcaggcugaugagccucagugagcugcuuuggaaaagauuucuaggucauuguauacauuagugugcuuuuaauacaggcuugaaccuugaaaagaaauuguguuuuaagcuugaugcugaacuuauuauacuggaaguauuagucugagaguggauugaucgguuacccugaucuccagugaaaccaugcuaagaaauuuuguguacuaaauuggccuugagaaagacuccaggggguggggggaguaucuauacuuuaacaagaagaggacuaaguaaggguaaagguacauucuuuuguaaauaaccaugugucugccagugauugcuaagucuggacuggugggaguuagcuuaucuucuaugccuuuugugcauugcuugcuagcuuggcaauauuuaacuuggguguuauuuacacauucaccaauuuggaaggaaaaaaaucaacauuuguucacuuuauuucagauaagcaguuuacaggagauguuagacaguauuugcugucacacaagggaagggauuaauuuucauuuugcucaucuuguacuauaaacaaauugagauuuuaauuauuuuuauccuaagaauaugaguguuugccugaauuugcaccgaggucaaaggauggcgucagauccccagguacuagaguuacagaugguuguaagucaccauauggguguugggaaucaaacccugguccuuuggaagaacaacuagugcucuuaaucccugagccauugcuccgggcccuuguaaaaauuuuuuuugaugauuguuaaugauucauggcauuauguggguaccccgugucuacuuaaaacauaacucagccagcuugguggaauaaaaauagucgccaacagagaccuaagcaaucuaagagauaucauucaaacauagacacccccuccugucucccccaucucugugaaacugauugaguuguauuuacuagaauacuagcuaaacuuguacuauauaugucuuaccuuuuauuauauaguagacuccuacguugacaucaucuuauucuuaggcauguuacauaguugaaauuuguuugccuaccacuacuaacuuaauccuguagauucgaacucgggauugcaggagguccagcuugcuguugaguaaccagguuuggagacaugaaaaaagaauggguuagauagggcugagucaggaucucuugacuaugaaaaccgagcuugcuuucauuaggugcucagucuauagaguccacauguggaaccaagccauuuauauguguaguuggaauuauuuuuuccaugcuguauucuagagaaaaaggcucgaagaaaaucccugcuguuaaaaugcuguauuuaguuuugaccaguuucaagcccuauuaggagcucacccuguugccagaacacugcuaaguaaagggacagagauucagaagggauuuggccucaguucucagaguguguuaguauuuauguugcuacaaauacucucauucucauaaauuguuuaacaaguaauuuguuauagucuccacuauguuggaaacuaugucuguugucuugagcgagguuugguaagaaaugugguaucuaaagaaucuuugcugagcuuagucacccaguuacucaggagccugagacacgaggauuauaaauucaaggccaggcuaugcaagccagugagccccugccuuggaaguaaaaggauaaaggugagaugggaguauuauuuauggcucagugguagagcaguugccuaauaagucugcagauccugcauucaaucccaagaucccacccccugaaaauaguuccuuauuucuuuucucuuauuuauuucuugagacaagaguaucacugugucaacuugacuggccuggaacuugcuauggagaccaaguuuggccuugaccucaccgagaacccucugauucugccuccacacugcugagauuaaagccaggugccaccaccugcggcacacauaguucuuaaaaaaaaaaaaaauucuguaguggccaguaguuuuccucauuagacauuuacuggacaccguggcuacucuuucuucucuccaugguguucuacguuaccuuuggaaaguguuuugacaauagaguugaaaccuuaaagugcuggguguauuuggacucuguggcccugaugcaaccugggauaauaagucgaguuggugugggaauuugugggugcuuuccccaguuccugaugcuagaagccuuuaagucugauguuuauuuccuugguauuuuucuccacuuucuucaucuacuucucuagcccuccccccacccccaaaaggaugcaucauuagguugagccaagugucggagagcaggaagacgcagacauuccuauuaaaguuccuacguaguuacgaggagccacucucggaacaucuggcacacccacgugcaaauacuuuuacagaauuaauuccaccugugauaauuuauugucuccaugugugcagacggucacaaguugaccauuucucuugaauggagauuuggacuuuuuuuuuuuuuccucuuuagagagcuagguauuuacaauuuacagaagaaugcagaugacauugcagucugagaauucucucccuccgaucacacuuaagauuuguguguaguuuuuucauuccuauggaacacucuguagcucauuagagucucucauuauugaacuugauuuaaaacuuuuuuuuguuuuguuguuguuguuuuuuuguuuuguucuguuuuguuuuuucgaggcaggguuucucuguguagcccuggcuauccuggaacucacuuuguagaccaggcuggccuugaacucagaaaucugccugccucugccucgaaaaaaauaauuccaacuacacauauaaauggcuugguucuacauguggacucuauaaacugagcaucuaaugaaagcaaauucagugcugggauuaaaaggcaugugccaccaccacccggcaugaaguagcuucuuagccacucuuuaguggcaagugcggcuucucuuucuguucuuuaugaauuagcaauaaugaaauaaguuauuuccgcuguuaguuagguuuugcuaucucaacagcagcuauaaaaccuuggagagaccuauuuuguuauagaguugguaaaaaaaaaaauguuaugggaaccagaacaccuggaacgggcauggcauguguaaugggaaccaaacacugacuggucagauaaagcuggaugcauagcucucauccucuguguuaguaggggauuuuuguaaguuaucugagggaucgugcaugucuuuugggguuaugccauggcagcaccaaguacuuagagcgugaccaauaggugcuauuaaaccuacccuagucugucugaaaucugcugacucauagguggauguguaaucacccugacgaagguuuggugaagguguugccuggaucagcugaugcauuugugggaauuaaacuccaggcacaagaaccugauaccuuucuccuuuuucgaaaauaauugguuuacacggaauauuugacuuuuauuuauucuuggacuccacuuuaauggccucuugguuuucuuuugaguggugaacuuggugaacuccugguuuuuucuuacauuugagcugaaucuuuucaaucaaggcagauacuuccuucuuucauauaggcuguaaaaccauguuguucauuugcugccuguacauucuaaaaguacuuaaaauuaagucaucacuuugaacuuaugauauguguugacuuuaaaguacucaagacccaucaucucauauuuagccuuuaacuuaguccaaaauguucagauugaagacuuuuucuuucuuucuuuuuauuauuuuaagacuuauuuauuuuuauguucacgaguacacuguagcugucuucagacacaccagaagagggcaucagaucagaucccauuacaaaugguugugagucaacaugugguugcugggaauugaacucaggacaucuggaagagcagucaaugccccuuaacuucugagccaucgugaacguuuuuggggacgcaugccuuccauccaugcuguuggaaaacaccuuggacccaaagcacauuaagaaccuuuacauuuagcgagcauaucagcccuguguguuggguauauccagucaugagagcuauuuuauauagaaggaaacuggggaccaaagcuuuuugucugaagguggcacuuacccuuccuuccacuacaguccuauuguaguggaauucugcuauucccaguaaugaauuacuggugcuagcacauucgauauauuggcauuuaagugagaucaaaguuauaagauuauguggacaugugaaaguuaggcagcguaaguuaacuagucuuuaacuauuuuucuauucuuuaagcacagaauguaagaggcagguguauuucugaguucgaggccagccuggucuacagagugaguucuaggacagccagggcuacacagagaaacccugucuugaaaaacaaaaacaaaacaaaaaucaaccaaacaaacaaaagcacagaauguaaaacagaauguuuaagcgagguccauggugcuauuuguagagagagaggccuucugacagcagaaggaaagacuaacaaaaaucgagaauccucuccuuacuaagggcucugugggguccuaagaagcugaucauuauucaguacuuagacaccagagaagaaaggauccaguuucagagggcagcaauagggcagaucaagcagccugucaugcugcccuagaaaucagaccucuuuugcccccgacuucucuggauuggguggauccuauauccccugaccgaccaccuuaaauauucaaaagaugacauaauuuggguagaaauuugcccaacguuaugagagaugguagagaacagcaggugacaaacccauugugucagaacuggaacuacacauucuucagaagauucacuucucuucccacaugggcaucuggagaauaugggauuugcuaauaucaggaucagagaugccaaacucgaagauagcggagauugucaagaaaaguaaagucagccaguuaacuaauucagugacuaaugagaagaaccccauuaauagguccagaggcauaaagcccagaguauacugagugacagacuucauauagguaaagcuagaaaaauuuagauauaaauauuuacugauauuuauagacaccuuuucagauuggacugaggcuuuccccacuaaacauaaaacuacauccacggugacaaagaagcucuuaaaggauauacugucaagguauggacuuccucagaugauagggucaaaaaauggaccaguuuugugucccaaacaagucagagacuagccaauauucugggcauugauuagaaacuauggugcauauagaccccagaguucaggacagguagagaaugaacagaacccuaauagagaccuaagagacuggcaauuccugaguuaacucuccuucccuuaucucuuuaccagguaugaaacucuucuuaccagaugggacucaccccuuuugaaaucauguuugggauacccccuccccaauuguucuugacauagagguaggggucauugcugaguucaaagaucaccaguugcuauaugaucucaaagguguccaaugggcucauaagcauguuuggccuaaacuucguguucucuauaaaacaggucccccuccaggcaggggucauuagagccucauuagaaagaucccuccuuaucacccuggagguugagggauuacaacauggaaucccugacccguuuucaguugaagacaaccuagaccagugggaggaaacucagucucaggacuccccuccuaccccccaucucccacugauggggucccuauccaaggcccaggaacaccacaaggacuggacaaugagaacccugaugaugguccaguccuuuccagucaccaguaccuccaggccugaguuagcugagucauaaagacauagaccuguuacuguuuucaugagauuagauaaacuucaggaagacccaugauugggccuucuaguuaccagagaagggugggaaugagaggccaagccuacuccaucuugggaccagccuccaucuucaaggaaaaaaaaaaaagccuuagaacuugaccagcagcagaacccaagcugcacccacguaccaggaaggagagaguuacucccuagcuacuuccuagcaacagguagucaaagauuagucugaugguuucagauguacuuucagacaguuugugauuguauauggucuugcuucagagcacccaccuguccgcuuacaauagacauucaguuagaugcuugccaggauagacccccucccccgaucccccacuuacuuccauuuccuuuaaaaccuuguccugcugaggauuccaggcugcuccaccuucccuuccuguccuucuaugucaggguuggcuaugucaggguuggauuggaggagaacccaagccagagcuuguaauaaaagagguacccuaaugcuauuacauuggaaacuguuccuugguggucuuuugggguucacaaauacuuccugacacaacacugccgguugcagcucauaacaauagauugcagaggcagccggaucucugugcaguugaggcuagccuggucuacauagugaguuccaggucagcuggaaacccugucuugaaacaaaacagcaaauucacuucuauuuuuauuacuuucuuuucugucuccagugcuugggauagggcucugcuguguagacuagggugaucuggagcucagugagccuucugauucggccuuguguguguugggugauauacuccacugcuauaacauuugguaguuuucagauugcuuuuucaaaaagguauaauacaauuccguaagaaugaccauccgaaucccuuguuucccauuuugcagauuagcacuccaacaucuuggauguuaacucaaggcuaauagguagacuuuccuggacuauguuuuucuaugaaacccccgaauccuuuuauuuuugagcugugcagagguaggagaugauugcaacgaggaggcaauccugggugaaaauuuaacuaggaggugagggcucgugccaucuagaaguggaagacgcuaauguccaaauagccccaguuauaucugagccucgggcaugucuucuggccauaaagaugaucgugucuuucaaguuccugcugaggaauguacaguguuaagacuuucaaaguaggcccuuuauagagaguggcucuaacuuuggcugcacugugaguuagcugugugccaacguugcccuuguguucaagaugguuuauggccaauggaaagucugacagguaaucauuuucaugaaaaggguacaggaaguugcuguuuaauaaagguugggagguauaaggugaggugcugguuugcguaacuacacauauauaaaugacauuuuucaauuggucuuggcaugguuuagauggaaaauuauuuccuuuuagccaaguggaguuugaaaagccgugacaacugcccagagcuccugacugagaaguuguucacggucauuuagcacuaucaggaagagauuuuaguuuagccuuaagcccugcuaacccuccucauugaccuuaaugagccuucagguaauuucuuuaaugaagugcauaucacugacaaaaagcaagggguuuuuacaggagucauugcccaagcccaacuguguagccuuugaacauaccugaucagcacuggguacgcucggcuugguuugaauuauuuacuuugguaaguacagucaugucuguauuggcuccguauuguuuuggaaccugauguguuucgaccagugcggguguuuucugacuuccauuuuaaaaaggccaguuuugaugaaauugugaagauuguuuauaacaugauacgauagccccaagacuaaaaacugaaacuuguugauguacuucuaccugaguacucaggguguuuuacaugucuaguugcucaauaggcucuugcagaauguuguugccuuagauucccagaagucuauuggcugguguuucugguuugcuuugguucaggcucuggcuacaggggagggucaagguggaaauauccagucuggaucaguaaagcuuagaauuuugaauacguagaagaacagaggcaauucuucaagugcgucacguggguaggaaggauuagcuggaaaauagauuacagagaaugaggacuaagagaaaaaaagaaaucugagguccccacaugaaguaguagguacgguccagaaaaucccacugaugcuuauugguugaaugcacuuugaaaacaaauuaagauaaaauuaaaucccaggagaucaaguggguguggugggugugucggugcacaccuacaaucucagcacuccagaggcugaggcagaaggaucugauuuugauuucagauucauccuggucuauauagcaagacccagucucucaguuuuguugaguacauauuuguguaaccaaugcagcaaucaggacuuaaaacaccucuuuuacucuggaaaguuuuucuggccagauaaacaaguugucagccucugguccucagaaaugugagguuaguaaguuugucauacaagguuguuaaaguuacaguaguguagcuaacaguggucaggaaguuuccaaacacuucuuuuagcuccagaccagugcugagguggaucgagucuguuucauagguaaggaaacugaggccaggagcauguuggccucugaccauaaugcagacacacaguuugguagccucaagagucacuacagcugccggcuuguccagguggcuuuggggucuguggccacguacacagacucgccaaguguuggaugagguuaagguaagagggauguggaaagagauagacuuuugaggugggcagagugguuaauucccauggucccagcuacucaggaagcuaagguaggagcaugacuugagcccaggagugguucagggcccucuuagauaguaagaagacccccucuaaaaagcuucacacaucugaacugaauuuccugccuguggcuaccaugguuuacgucuguacuucuggguuaaccuuccauaaaugggaggaggaaugaggacagugacugucacaugguuugucuaagggaccaucagcuugagugugcuuuccugcacguggaugucauuagcucuguggaagagguagcugcugaugucccggucccugccucccaugcuacugccuuugggcugaugaguggacugacaacgugucagucccuuggugugcuggccgcuguguuuacacaacuuuucucggugcuucugacauucgagagcgucacauccuacucagccccauucuacagcccuugugagcagaaguaggaaagaaucuuuuuuuuucuuccuaaaaauuguuuuuauuuuguuuacagaagaaauauauauccugauacaaaacaguguauaugaggugggugacuuucuaagggaucccaaaauugguguugaguucugggucuucauggggucaucuugcaugugcccccucuaaauccccaaaggcaggccuccuuguaugguccgcucugucuguguauuucuagagggugggagacuuccuucagagcuuuccauuacccuuuuacuugagcucagagguucuaaaugaaggucugugagcugaggguguuuggcagcagcguauuuaccaggaugacugauagguucuuaagucaguguuuauagaauccaagcuaaaggaauacuuuguaucugcaguugggcacuccauuuugugccaaaauguccuuccuaauguggcagugguugaguuugguuuaacauguucuccacggugguuuaaaagcugguaugccugugucgccccuccuguggccaggagggacaguucaugaguacaggagaugaaaaaggcuucgaagggcucacugcacugccucaucccuagggagcuggcuacucuaccacuguccucuccucuggcacagccaggacgucuccugaggcacccugggcgcuggucauguccacgauuccagcuucuguaauguuuuccuuguacgcccuggcuuuccuuauugaaaugaugaaugauuuauuuauuuauuuauuuauuuauuuauuuauuuauuuauuuauuuauuuauuuauuuauuuuugcuccuugaaugugucucacucacuacagugucuccaauccuagccagggacugucuuagaaaaucaagcuuuuuuuuuuuuuuuuuuuuuugacagaauaaaagcuucaguauggaaaagcccccucugccacagagacgaggaaaugggcagaauuguugugcaaaggaacugaauugguguguaaaggaacugugggaguccagaaauuguuggucccuucagggcuguucugagugucauugugcagcuuucugauuggagguucucucaugugauacaagugacauaagguugauuucuuuuauuaagagaauacuucuagagaaauggacuuggucuggguuucgacuauaucguauuuauauggugguggggaaugaagccagguguguugguacacacauauaaucccagcacuuaggcugggcugggaggcuagcacaucaagagcuagaccaaucugggcugcauacaagaagcaaacaaguggagaaggguuuuacucucaacaaguccacuugguucuccuggccagcucuccucugagagcuaggcuaggaaauuagcaucucggaggagaaauguuaguuuguucugauguaaaaucuuuuuacaggaucagagucauccggagaaaggcauguguggauuguuuauuuaaaagguuaggggugagccagguggugguggugguccauaccuuuaaucccagcauacaagcgucagaggcagggugagcucagaguuugaagcuagccuggucuacauagugaguuccagaacagccagugauauauggagaacacucugucuaaaaggcaaauggaugguagugguggguaggugaguggggauuagaauauuagauaguugguggcucagugggugcguagcucauuuuucuccuauccucgagagaggauccuuucugccugccucaucugucuuugaauuaugagcugaccuuucaugucccuaggucccacagaugugugagauuaggacugauguggccuuggccuuggugguuucagaauucaauggccacagcugagauggccuuucagcaucccucucuccgaguuguuucagucuaggauuuauggucaagaguaguuguugaguuuuacgcuuugauugacuuccacuugucaaguggcauuaaaggcugucacauaacuaagagcuaaacucagaccauuuaauggugcuaaaggcuuagaguuaaacccucagaaauauguguccagucaacaaaauccauucuaaauuaccaaauuguucucauauucccacagcauacauauuaaauacguuugcuucauaagauauucuaucauguauuccuccacgucucucaaggccuaauucuaagauagcaguuguuucccacuuccggcucccauuuaacagaugcaaaaaguagccacuacugaggcagugagaagggaagggaguggacuuggcuggacauuuugcuuccugagggccaugguuccuuuguucuucuagaauacuugcagaguuagcagucugaagaaaaccccagcgucagaggcaguggagcacaccagauagggagagaguaaaggugcucugaugucagugccagacucccagaagcaaaugcuacaccccagggccaggaaugcugagcucauacuuugauacuauagaccuguggguucggaaauguuaacauaguucuucauaaaacccagaugaggaauaaagaagaggcuauuuuuauuucagacugugcuuggaggaaagacgcauggugagauacgccuucuccauauauuuggauauauugcccaagaaauuauaguuacaagacuuagugcccaggcuggugggauggcuuggcaguucagagcacccauuguucuugagggcuggguucaauucccaacacucccauggaggcucacagcuguguguaacucuaguccaggguauguagucaaggcacacaugguacacacacacauguagguuaaacaccuauacauaucaaaaagaaaaaaaaagugaaaacaaagauauuuaguuguaguuugaggguaguggguuuccguuuugguguguuguuguuuggggguuggugaaucuaggccagccuggauucagcucggcuucagcaucccaugugcuggaaguacaagcguguggucugggucuggugcucuuucacuuguucuccugaaucuuguuaugguugucguccauagagguauggcagcaggcuuaguuuucuagaaggccuuuucuaaauagaaaugauaaaaaauaugugguuuuaaauaauguagugguuggaucacuuaacacaucaucuuaguauguuuuucauuuuugaagaauuuucuuugaccuuugucauuuucaauauccuuuccaaggcuagugugucaacauugauaauagacaugccaucucaaaaacaacaguaucauaucguugaggucuaaacuuccuggcauauagguauggaaucucuauccaagagcaaugacucuuugaucuguguuugaugaaauucuaggcacuguuugcacauucgaaauggaggccccgccucaggucuggcuggcugaggguagagggagguuagcuauggcugacauccaagcuggcuggcugacuucggaguguucuccccuggagccugaaggagauucuugugcuagcuggggguuucucucuguagacuguccucaggauuaucuaggggcagcucaagaaucggagaggagccacuggccuaaaaauaacccuugcuuacaaugagcaucuaccuggcacagauccacccgcugccacagagcagucgcacugggaaaggaagcaagcaagcacagacuggcgugcagggggcggggccuccguguucccuuccggguucucaaagagaggugaaaguuugaaugguuuauuuuugaaaagagcuuagaaauaguaaauauuuagguaauuuuacgguaguaggcuuaguucuagaggauucuuauuuacaagaaauucuuuuguauuucaaguuaaucccaggauaagugugagggcuugaaauguuaacuugucuuuuucucacauugccuggggacacagugaagcauuguucgggccaugcggacaauaggauguuuagacaaagguucacccgugcgcuggcgauggaagauucugaggagauguuugaacauucguucucaggagacuuuaggugcugugugguacauacuuucuuuugaacacguauggauuucaagaccagugaaacaggacugucucccagcugucagaguagcuggaagucugacuaggugagaggggagaggauguaggaguggaugauugauggggaauugugccguggaugucaggcuccgcaagugggcaguggaagcucacuuggggacggcccaguagugccuagccuuuggcaguauuugucaccuguaguucaaaggguaauuaugguuuguguuagucagcuuuucaccacuauaaugaaaugcuucagguggcaaaucuagucuuggcucaugguuuugaagguuccuggccccaaacaggugaccccuuauuuuucacaucugacucgcauggcgguaugucauagguuguggcaguagcucaaggcagggcgaauagagcacaagcugggaaauacagagaaggaaaugcaaugggaucccauaaugccuuuagggacccgcuccaauaacagaauaugcccccucccaccccaggucccaagucuugaagggccacagcaucucccaguauuguugucuggggacuaaguuuuugauacaugggccggugggggugggggguggggcacucaucgaaccuuguuguuuaaagucagccagucccuuuuuaucaugaguguggugggaggccaugaguaagcuuaaaggcauugcaaucaaaaggaucgguugaguuaugugguggagggcauauuuuguaaggagacauggagauaagagcuugacauuucugucuaggagacagacaggggcgguuugugccagagcauauuagagaaggugagaaauaguuacaaguagagcuauauauuuuuuuaaaaaugucuuuggggauguauuuugauugcuuugggguaaaaggaaaggaggcgauuuaaugcugccuccuguggguuuggcccugccuaccugagucaaaugaucuaccuuggagcaccugagaagacacuuggcuggcguccagaggcagaggacgcauuuacuuugaggugacuguuaaaugcaaacuuucauguuaaaucacaguauucaagaguucuaagggagggucagggcuccagaagggagguuugagaagagucuccggcaguuguuggccaaagacauuuuggagagaaacaguagcaaaccugagaccgggugaaggaagugccuugaacucggccuccauagugucgaggguuugcuuagccagccaggguuagccgucugagggaucucugaguauguuccuuuauaaccuuggacaagcauagaaaagaaaucagcaaaccuuugaaaagcaaugggacaugggauuuaguuaaguuugggcaaucuucucuucggggaaauaaauauauuugguaaucauuguuuugaauauuagcagugugugcaggcacugcaaaucguuuaguaccuaagacucaaaaugacucugacuucuuagguacugguuauaauacaguuaaggauccccauucucaaggacuccuccuuagauggccuuuugccccaggcaagggcuauuuuugauuuaugaacuugguauaucuggaacuaacuuuaaaaacccaaccuucugggcacacccauuggauuuuuaguuacucaaauaauuugaggcuugaaggcccaccuuuaauccacuucucuugggguaggaagccccgccuuuagccugggccccaccuucuuguggcagccuauguaaaggacagggaaggaagaggauuugcuuuuuguuugcccacaugauggcuagcaaguuuauuuagaguccacuucuucaggauuccagagcacacugaaggccaguugagaugcccaaccuucgggacggaauaguugcugcauucuugacuuuccaccuggagacaaccauuguuggaauaauuggaucauaacccguaagccaaucuaauacaucuuguaauuuauuaguucuauuuuucuagagaacccuggcuaauagauggcacuauuccggaguauuuaacuauagcuucagauaagcaucuuguagguagugacuguugacauaugacacguuuagaagccgcgauuugcuaucuauuccucaggucugagguaaguguguggcuugcagaguggccuucgcugucccucauauucaugcuauagucaggguacauguuuuucugcuauagccauaaucuagcuauauucuguccaucuucuucccuuauauggauuucugauggaaugcuuacccaaagauuggugcuuaauauauuucauaagcaaauaucaugcagcauuagaaagaaaauguccuagagguacccaagaagccuugguuuggguucuaacuaagcucagugucuuauuuauugauacuuauugacauguagcaaaauuugcaccccuuuggcauaccuuauuauccuuggacuugauuucucuacuuuucuuuuuucucucuucuuucuuuccuccccucuuuccuuuguucuuaccuuucaauguggucuuugucuuaguuuggguuuuacggcugugagcagacaccaugaccauggcaacucuucuaaggacaacauuuaauugggucugguuuacagguucagaaguucaguccauuaucaucaaggcaggagcaugguggaggaggagcugagaggucuacaucuuguagacagcagggccacaacgacuucaacaaggccaaggucacuccacccaguagugccacucccugggccaagcauauacaaaccaucgcagucuugcuguacagccuaggcuagcucagacaggggauuauaccucagccuugugagggcugagaauauagaccuauaccaccaugccuggaaaguucacugaguuuugauauaaaugauaaaugucugugugugauauguguguguguguguauauguguacauguauaaauguauauauacacacauacauauauguauuuguaaucaccaaacgcacaugcacacagacagaugaauacacaaagguauuuccaucaaacuagaaaguuucuuugugucucuuuguucagcucuccccacccccuuucccaaacaaacauugauucuguucuuuaaaugggauuauauagcacguagccuuuuguauguggcaucuuucacuuagcauguauuuuagauauucauguaucaguauuuuguuuuuuuuauugacuggcacuucauuauacggaugugccuugguuuaauuguuugcagugauggguauuugggucauuccccuccacccuugcaaauugguuuucucauccuguucuaacucagaauacacaagaaauuaaagcaucaguaucauagucguccuacccccaguucacaucgggugacuuccauuucccauguacugugccugugagcauuuuacaugaugauaacugugggacaaagguauuuuuuuccaguugucucaugaauugcagaguuauuaaguaguuguauuuccuugcguuucugcauuaaaaauuuauaauuacuuuuaucauuuaauuuuuaaaucuuugcaguuguccaaagcuauguuucaaguccuuuguucaaaguuuuuguuaagauaaauuccuaaccguuugcuuaagaguuacugaaacaauagaaaucgauucaagugaauggucaaaacaugguuaagugucacagggcugugugcuguuucuuagaacuguguguccacaaguuagucacgagccaaguuaguuaagcaaucaucccuuuguuguuuuucauuucugaauuucucaguacauuggucccauucuuaucuuuccuuuucugcuucuggguaccugaagaaagguggucgugcauagggaaugggacuugcauguucuucagcuccuuggauguacugacccuggccagcugucucuaaucuaguguuauggagagaaagaucugauuugagguaguaaagacaaauauacuaguaugugacuuacugaauccacauucaaaaaguuuacauauuauuaaacaaaacuucacuuucuuuucugguuauugaauuugcuuuucaaaauggugauuacaauuugucucuguacugaauuauuacuaugguuuugagaaaggauaucucgggcuggugagauggcucaguggguaagagcacccgacugcucuuccgaagguccggaguucaaauccuagcaaccacaugguggcucacaaccauccauaacgagaucugacucccucuucuggagugucuaaagacagcuacaguguacuuacauauaauaaauaaaucuuuaaaaaaaaaaagucaagagaaaggauaucucuaugcugucccuugaacuccugugcucaggaaaacuccugccuuagcaugaugcuuagcucuagcuauguaaguauaugugcaugcacaucucucucucucucucucucucucucucucucucucucucucucucucucucucucucaugguuuuucgagacaggguuucucuguauagcucuggcuguccuggaauucacuuugaggaccaggcuggccuugaacucagaaauccgcccaccucugccucccgaguacugggauuaaaggcgugcgccaccacucccggcuuucucucuuucauauauuacauagcuaccacaguuucccccucucuucucccagucccaccccccaaaccucuucucuaucccagaaccauuucuccuucauuuuccaucagaaaugaacaggucuucagggauaucauggcauaacagguuacaauaagacuaggcacaagcucugauaucaaggcuggaugaggcagcucagaaggaggaacagggucccaagagcaggugagucagaggcuucuccuacucccacuguuaggaguccuacaagaacacucaucuacacaacuacagcuuaugcacaagacuuaggucagacccauauagacucccugguugucacuuuagucugugugcuuaugagcacugauuuguugauucugugggcuggguucuuaugguaucuuuggccccucuggcuccuacauuccuucccccacucccucuuccucaggauuccaccugauguuugacuaugggucucuucaucugcuucuaucacuugcuagaugaagccugucugaugacuauuaugcuaggcuucugucuacaaguauaacagaagaucauuagaaauguuugguccuuuccugggucucuagacuacccagccucuggugcuggccucgcaggcacuugucagucauggauucccucucaugucauggaucucaaguuggaccaguuauugguugaccacucccacaaguacuguaccaccuuuaccccaguacaccuaggaggcuggacaaauuguaggucaaaaguuucaugucuggguugguauuucagacccuccacuggaagucuuuccagguuacagaagauugcugguucaggcuucauaucucccauuacuagaaaucucugcuagagucacccuuguagauucuagggaguuuccacugcacuagguuucuaucuuguccccuaaaugugcgcccucccaaaauuccagucaucuguccaagaacucucuuccugcugggcgugguggagcaugccuuuaaucacagcacucaggaggcagaggcaggcggauuucugaguuccaggcuagccuguucuacagagugaguuccaggacagccagggcuauaaagagaaacccugucucgaaagcccccccccccaaaaaaaacucucuuccuccauucccacaucccucucaucaccugcccccaguccacccaugaaaucuauccuauuuuacuuucuccgaucugugguuccccuuugaucucuccuuguuacuuagcuucucugggucuguggauauaacacaauuauccuuuauuugauggcuaauacacacucauaagugaguacauguuugucuuucugggucuaggcuaccucacccaguauuuuuuccacuugccuauacauuucaugaugucauuuuuuaaaacagcuacauacuacuccauuuuguaaaugaacuacauuuucuuuagccauuuuucaguugagggauaucuaggucguuuccaguuuuuggcuauuaugaauaaagcugcuuugaacauaguugaucaaguguccuugugaugugguggagccucuuuggguauaugcccaggaaugguauagcucucucuugaaguagaucaauuccgaacuuucuucaaaacggccauauugauuuccauaggggccuuacaaguuugcacuuucaucagcaauggaggaggguuuauguuccacauccucacugguaugagcuguuacacgugucauugaucugacagguagaagauggaaucucaagcaguuuugacuugcguuucccuaauagcuaaggauguugaacauuuaaguguuucuucaccaauugagauuccucucuugagaauucuguuuagaucuguacacuguuuuagauuggauuauuugguuuguuguugucuaguuucuugaguucuuuauguauuuuggauauuagcccugucagacagaguuggagaaaaucuuuuuccauuccguagguugcuguuuuguauagcuuuuugucaacuaaacacaagccuaggucuucugggaagaaggaaccuauacugagaaaaaaugccccccucagauugaaccugcaggcaagucugggaggaggcaggccuaucuuauugauuaaugauugcugugggaaggcccaacacaccgugcgugguaccauccaugggcaggagguccugagcuguaugagaaguggagcuaaggaagccauggagagcaagccaggaagcagcuuucugagggcucugcuucaguucugccaucucugguucuccuucuagcuuuccuugaugaugggcguguacgccaucuuuccuccccagcuugcuuuuggccucgguguuuaccacagcaguagaaagcaaucuagaacacugagccuccagaaucaaggacuucuguuugcaaccaugcccagcuccuauugggucuuaagagagaguccaugucuguuuuguucuguugaacuucuuuuuuuuuuuuuuuuuuuuuuuuuuuugguuuuucgagacaggguuucucuguguaguccuggcuguccuggaacucacucuguagaccaggcuggccacgaacucagaaauccgccugccucugccucccaacugcugggauuaaaggcgugcaccaccacguccggcucuuuuuguuuuucaagacaagguugcucuauuauagcccuggcuguccuggaacucacuuuguagaccagacuggccuggaacucagaaaucugccuaccucugccucccgagugcugggauuaaaggcgugcacuaccacgcccggcauguguugaacuucuugucuaucauucugaauuuuucucugagugauguuuaaugaauaguuggaaaaccuuaauguauaguuuuguuuauugaaagcuuacaugugugauguucaggucauguucuggaccucugugaaugaauacaaacaugcucauuagacaacucguagacucagaacuacacauucuuacccaguuaacuguggcuaagauguucuuaggucaaggaggcugugaauagggauuuucaaacaugagggaguuaagugacuuuugucuggaaacagugucggggcugguguugcauucucuuagggcacaacacgggcuucugucucacauuuuuacuccagaucuagacccuguuucuaaaccauguaagucaauauggaguguguuucuaauugccaccuugauuucucaaguccuacuggaagucacccauuuaucagcagacuguucuauacauguggucuauuccuacacaugacacagacacagacacacuugcucaauaucucuucaucucaugucuggaaguugugcuauagccuugucuaaaacaaaaaggaaaacaauagacucccucacuuucccuaagaaaaccuauuagcaaacuugcucuggccacuaugguaauuuuauucuuucuacaauaauuugccuguuuuguaacucaaaguagaugugauauauacaaacaugaaaauaauuggccuuauauaagaauuuuaaauucugggcaggcagugguggcaugucuuuaacucuggcacuuggaaggcagaggcuaguggaucucuaugagucugaggccagccuugucuacaaagcaaguuccaggacagccaaagcuacagacagagaaucuuaucuugaaaaacgaaggaaaaaaaaaauaagaaaguuccgacauaggauaaauauggaaaacauuaugcuaaaugguagaguugguugguaaaguagggauuucagucaaggucugaagaauaggaaggugucaucccauaaucagcuuccaaacgaugacaccauugcauacacuagcaagauuuugcugaaaggacccugauauagcugucucuugugaggcuaugcuggggccuagcaaacacaaaaguggauguucacagucagcuauuggauggaucacagggcccccaauggaggagcuagagaaaguacccaaggagcuaaaggggucugcaacccuauagguagaacaauaauaugaacuaaccaguaccacccagagcuagcugcauguguaucagaagauggccuagucggccaucaguggaaagagaggcccauuggucuugcaaacuuuauaugccucaguacaggggaaugccagggccaagaagugggaguggguggguaggggagugggcgggggaggguaugugggauuuuugggauagcauuggaaauguaaaugaagaaaauaccuaauuaaaaaaaaaaaagaaaaaaaauaggaagguauguuaggcauccgcccuuaaucccagcacaugggaggcagaggcaaggcagaucucugaguucaaggcuacucugaucuauagcauuccaugagaaauccugacucuaaaaaacaaaagucuuaaaagugaaacuucaauaaauauaaauauuuccguuuucauauuuacaaauacauucuuucuaugugacucaugagcccagagaaguuucuaugcacguaguguagucgcucaguggucagucacaauggcgaguacauagcacuuggaguguaacauuuaaugugugagguguuugugaggcagcucaguuuucuggggaagcuagucuguucuguguggcugaaaaaguugaugucuggaaccccuaauucugacuguugugauccguccuugugagaaaagcaagaaugcuguggaacuugucugucaucucagcacuugggaggcagagacaguggauuuugaguuucagguuagccugagcuauauagaaacaaaaggagaaacgugcauaauaagaagguuacccuucuagccauuuuagaacaugcaguucaauggccuuauuuguauuggcagcguugugugacauguccauuggcuccagaacuuucucaucccaaacggaaguucugugcaagcuaaacaacucacccacuccuguccuuguuuucugacaaccucuauuuugcuuucuacuuguacagaguugacuaagaacaauaugacaauggaaucuacuugcccugguuggcucauaccagauuuuguuggcugucuaccucucaauggacaguuaugugacaucuacuucuuaauuacugggaguggugcuuuuguggacauggguuauauguauguccccaaaucucuuuuggguguuggaauggcgugccagagcagauggugauggcuguguguagcuucugggcaacugcaagauaguuuuugaugacagugcaccauuucucauucuuacuaggaacacaagaacuguguaguuucuccacaucgacacccaugugguaauauuagcuucccuaaugcauauagcaugaugucauuaugauuuugauuuguauuuccuguaaauuaacggucagugucuucuugugagauuuuccccuggacuuuguagaagugauucucccucucuucuguuguguucuuggaagaagggaaaaaaugucauucauuugauauucaggauuuccugggacuaaguuggugguaacuaaaguuacaugggaaugucuuucucccuccacccuucauuccacugaaguaaugguagaaauguuagggauggguagguguguuaauuuuccauugcugugauaaaauagccagaccagaggcaccuuagagauggaaguguuuauucugaauuguaauuccagagggauaaagguccauuaugccaggaacaggaagcugagagaucacaccucaaucccaaacccgagcucagagagggugugugagcuguugaguugggugugacuguaaccauucaaccuugcccccaacaacagacuucucucugcaaggcuugacagucuaaaacauuccauauccucccuaaacaaccgacguggucucacgugucaaauccgcgagcuucucuaggacauuucuuucuuaagccaccaaauuccaacucuugaccuucagacugguaaccaucucaugaugaaaaauguguuuaguccaaguucaaaguucaaaagucuccuucaacaagucuaacaguuuucaauacuguugaaaauccccagucucuuuuuuuuagacucagggcaaucucuuaucuuuagauuuucuuuuuuaaaugucuauguaaaauggcacuggacuacagggauauaguaaaagauagaccgauaaaguaaagccccuaacccagcaagacaaacagcagauccuuauguagcucugugucugguaucugggccuucaaagcacuuaggcaguuccacucuuccagcuuuugcugccugcagcaaacaucucucucuuuggauggcuccacucccagugugcaaaacuccuuguaagaggacaucccagcauccuggggucuuccacagcucaugauuacacccccacaaagcuaccuuucagggcuucuuggucucccagagccuucuugcgcugacuguagcccugcuuuguguugucuggcugcaguuggcucuuggaagcugcugaggaagagucuaugacccccucauccuucacguuucuaaagcuagccccgcguggacagcacugccagcuugcaguagacucucagccuugaacuauauucccagcuuugauauucaguugcuuucuagcaagagaaagauuuguuagaaaauuucuuacacagacuggaagcuuagcugggcggggcccggccccuuccuuacccuccacuuacucccuuacucuccaggauuccugugccgagcaguccucucucuaaucucuuuaacaacuauagcaccuuuuccagcauauguuucagggucaacguuaaguaagcuuacuagugccuuucccuacaaucuguacccuucguauuucuuacccuucuuuuucaucauagacccacacuagagugaugagaaagcaucgcuccagacucgguguuaugcugucuuggaauuuaccaaagaaauuaguauguuacuuguuaauuuggucucaggcaugcucuuagaagaggguagaagacauuaauauucuuugcccaacaugugcagaguugaauggaccaugcuugcacgagccuagaagacagugguguugaaaguaagguagagggcuggagagauggcucagugguuaagagcacugccugcucuuccagagguccugaguuuaaaucccagcaccacaugguggcucacaaccaucuguaaugggauccgaugcccucuucuggugugacugaagacagcuacaguguacuuacauauaauagauaaauaaaucuuuaaaaaaaaaaaagaaaguaagguagauggugaaugugguguucaagauguuucugaggugagcuagaggccauuuaugugguaacguuuaacacuuguaugccaaaguuucccagaggcuuuuuacauuccuucaaaaccaaaaaccaaaacaaacaauaaacaaaaacaaaaacaaaaaaacaaaacaacaaccccccaucuccaacaacaacaaaaccaaaaagcacacaaauaaacaaggguagguucuucauaccaauagcuaacaguuccaccaggcugaaucuaucaggguugggaggcgcaggggccacagcagcagggagcugagggcucacaucucagcggcacacaggaagcaggaacaguaaccuggaaguugggugaggcuauauaaugucucaaagccugccuccagugauacaccuccuucugcauggccucguguccuaaaaguuccacggccaccagaaaacagcaccaccaguuggggaucagcugauaccuacaggugccucugagggacauuucucauucaaagcaccauacuagguuuuccugaauuauuagugauuggauuauggauuaaagggaauuucaucuugcgagucagccuggaaaccugugucugcuuaaggucacaaaguggacuuugaaggacaauaggcaaagaguggggaccuaccucugaagguuguguaauuaggugaugguugaaggagucagaguucgggaggguguggucuccguuagcaacucagccagcccuacccucauacccagugcucugguccuauucauugucucuucuuuggaagugcuagcuguugauagaggaguauggcgaugcaugccagagcugauucucaugagcuggagcgguuggggaggucggaauucaugagaagucugcuggguuugcaugccacguugaagucaggaaucguuuugccauuguguauguaggaaaguggugaagacacacucuuggacugcuucagguaaccccagugaauccuuagacuauucagaaggagagugaccagcaugacucaugaagccuaguucccugcugcccaaucugggcuuugugaugggagaauuuacaaagugacguaaaagcuucagggcagagguguauguggcucagugguuagaccacuugccuugcaugcacaaggguuagauuccauuggaggcgcacacugacuacuuucuuugguuuugguuccuaaauucuucuuuuaaucucccuccuggauuccuacuugcagaucuggaguaggggauggguaaugacaagaaguacuccuuuagccuaauugaacuuuuaaaauaaucuucauggaaacggggaaggggucuaucucucucuucucuuucucucagauaaacuuauuuuguuucuggcauuuaaucugccuuuggggagcuagccuccugauucucuaauguagaucaaucagccuugguaccuaaucucaaauagguucuauguccguguccucucaagggugccuuguguccguuuuguuugucucugauuuuuaucccuugguguuuccuugcgaugagucuugggcggcugugcggugucagaaacuggaggaacuacuuuagccauacagaguagccauacagagcgaggucugaaauguuucagagcaaggucugaaaugguuuuacguagggcucaugucguuuauauccuugaauaauaaugugcaaucaaagagauuggauauacuuuucuuguauuuuggucuagcuuuucugugcagaaaaauuuacauuguuuugugacccggaagauacugaaugugcuggugucuuaucuuaauuggcaucgaggauuguagccaacagugcuccuuugguaugguaucaauacggaagaagccggcuucuccugggaagcuagaguacuaauuuuugcuuuagaagacacagcauggcagucauaauuaugagucccuuuguuuaaaucuccugcgguauaaucaguaccagcuauuccaaacaguagagauuccagccugcauuuacaaagugucuuagucaggguuaccauuguugugaugaaacacaaugaccccagcaacuuggagaggaaaggguuuguuuguuuguuuggcuuacacuuccgcaugcaucauuguuuaucauugaaggaagucaggaugaacucaaucgggguaagauccuggaaggaggaacugaugcagaggccaugaagggguguugcuuacuggccugauccugcuggcuuguucacagugcuuucuuacagaauccaggaccaccagcccagcgauaccccccccccacacacacacacaauuagcuggaccauccaccaugaaucacuaauuaacaaaaugcuuuacagcugcaucuuauggagauauuauuuucuuaauugaaguuccuuuauuucagaugacugacuuuugcaugcgucaaauucacacaaaaacuaguuggcaauacuuggccuguaccuuugagccgcagaaagaacauuuguuaugcauauugauguggaaugggaacaccuuuaaggauuuuuguuauucuuguuuauuuuuuguuuuguuuuugagacaaaaaaaauuuuuuuuaacucaggcaggccuuaaacucaugagucuccugccucagucuccugaaugcuuggauuauaaguagcaucaacaugccuggcuguuuuucaacauuguuuugcuuugcagucuugccucuagcaucuggcuuuccuuguaaugaaugugguguucuucaugcagcauuacuguaugaacucaugccauuucaccuaacguaguuguaaguacacaguuaaaggagauaaaaauuagcacuuuguucuaaaugugcagugaaauuuuguuuuucauacuuuagugagggaagaugagucgaggaggcggcgagagauuccaguccugauuuuacuccagauaauuucgaagcggccagcauuggcacuauguuuaaagcacaggucaccccuggucguucugccccguagacucuggugugagccugacuuucagagauaagcagugcaugaagagcuacuggaaaccuuaauucccugcagcguucucuucuuguugcagaaugaguugauuggauuaaaugaacacacacacacacacacacacacacacacacacacaggaaaaugacucaucuguaagucagcccaucucugugagugggcgcuguuugcugcuagugaagacacuauuucuguucaauaaauaguccucuguaguagugucugguuuuguauguacacugccugccugccgaacuccauggcgugcauuucaggugucugagucacauaaucuguuguuguuguuggaauuuggaaggcauuaaaaacaaaaacaaacuacugcauuuucuguuuugugaacuuacaaauggcucugaagacaguaguuauucaagcuacagagaaggagcacguaugcuggcccguggcucugaacgaauggguuccagaccuuuuaacuucaguuucuaucaaagauaugaugauaaagaaauacagcuacaagguguguucuagaaaguagaaucguguaaagcaaacauaaugugaaaagaacucugcuaagcauuccugccugagagugaaccauucccuguggucacugcacaucaugauagaauuuugcuuuauagcguucuaucauuaauacuauaauguuaauguuguuaaauacuauuauuuauugacucgaauguaaagauggagagcauugaaguuuaaaggauaugaaauguguaagaaaugaaaagugaaaguguaggcagguuaaagacuuuauuacuguuuguugcuuuuuuuuagaaaagauuuuauuuauuuauuuuuuauauauaugacgaguacacuguucagaaacaccagaagaaggccccagaucccauuacagaugguugugagccaccaugugguugcugggauuugaacucaggaccucuggaagagcagucaaugcucuuaccgcugagccaucucuccagccccuuguuucuguuuuuugaaacaauaucucaagcaguuccaacugguccggaguggaauucuccugcuucuaacuugacaaauucugggauuacagcaauauuauagcauuaaaucuauguccccacauugaucauggagauauauugaacgucuuuuuuuuucaacucuauaaccugaguccuuggaacaauccuauuucuuuaugccagaagcaaucaucuagcaccagcuaaugcugagcuaguuaaucuggcaaagagcuaaagaugccuucuguacagagaaugaaaguacugucaucauuacuuuugcuuuuaugacuucuacugcaguugauaaguuacagugucaccuagaaacaucuauguguucuguccaggaaaguucagagaaauuacaauguuucguuggcacagaauccaagggaaaugucuuaguugugugugugugugugugugugugugugugugugugugugugugugcgcgccaagcccagcaucaaauguaucuuaaauacaaauaaaccuuaguauauagcuucugagugagagagagugggagaugaauauauuuuuguugagauaguuuuaauguuuuucuuaaaaaaaaaaagggggggggauauaaaagaguuccucugacauuguugcauuuucuacuuaaaaauucuuaaauguguguuuuaaaaagcagcagauuguuuuccuuuggaugauuaaauaguaucauucucuguguuuuaauaaauuauucauuuuuaacccagaucucucuggcgcucuuuaagcuucaucugaaauggguagugaaccuuuccacccuuuauuguuacacaguccagcccuaaacuuuuauauuaguuuuuuauaaagaaaaggggccaucauguuuucucuaguucaaacgaaagcuugaaauccuuuuuguaccaacaaagaacaugauagauuauuuaugcagcagcuucaagccuacacuaucuucuguagcuuccuucuuuaaauauuaauauaagugaaagaauccuuggaaauuauguuuaauugaacagacauuuauugagcacuugcugugugccgugcugucuccugcguggugcagguuacacagugccgggccuugggagcaugucuggacuuuugucuggauuuccuccccacuacucugucaguucagcucacucguaacaguuuccugccuacugcuugucuccaguagaguaugauugacaucuccgccaaggccaguaccagucugcuccggcagacuccagggccaauaaauagaaucugagcugaucccacuaccuaccccacuuuacugccccugucuccuagaguuucuuccucaagacauuccagccuccccugcacuuuggagccuauccuaugugacuccucugccugcacuacccagcucuguuggacaaagcccccuauauuuuccucugacuucuugugaagaucagcaccccgucagauguccuguucauuacuccuguggccuguggguauuuucccuggaaagcaacuuggcuaauuguuacuguguuucauuuauugccaauccaguguguauguaccuucucuggaaugcagcacauagcaacuaucaaaugcaugcuuuagugucccuaauuguauuuacuaugauaccauaguauucauauugucauuuuacaucuuugacugaauucauauuuugcuccaagauugaaaagcaaagcuaccauuaaucaccuuaggaaauagacucaagaguccacaaccuuccaaaacugugucacuuguuggagaccaacccgucugggaacgcuagacauaaaccuuaagaucugaguaugagugcuugcauuaguagugaugagcagugcucucuggguagagcacuaggccugaggcagcgaggagagauggcuaucaguuuccauuuucuccucaucuuugguuauauagaaucuccugcuagguauuuagccagccaggauggcuagcuaguccccagucuaccuucuuggcaaguauagccacugcuguuagcgugucagguguuagaaacggauuccauaccucuugcuacccugcccggcaaaacacagguaaugcugcucugggccacagauccaagguggcagaaggggagagguagggccugggcucuguggcuaauugggaaaccuaugcaaacacaagcauuccaggauaaccuaugcaaacuucugcaugacugagacaauuugugugucuacccauuuaccaagaguuuucuucugcauuugaaucuaacuagaauuuacaucuuaaguucaguagcauguuuuaugacucuggacaucauagaucucucuggcauggucagguauuuguuugauuuuauuuuaaaguacuuucuuggcuagggguacaguaguucaacaguaacaugccuggcaagcaugcaugauguccuguguuuggucucuucaugaauguuuguaugcauacacguguacuugugcgcgcgcgcacgcacgcacacacacacacacacacacacacacacacacacacacaccccuaaaauggagugaguuucaggacagccagggcuacacagaguaacccuguccuaaaaaacaaacaaaacagaaaaagggaaaaaagauaauucuaaauggagugagcgaagguucuguguugcugucuaacauuuuaaaauucuuuucugucaugaguaugaaauuuagguagauaagcaugguugccuguuugucuauugggguuucauuccaagacuucugggacauaacugaagcccgcaagugguucucagcugucuggauguuguuuauuuccuacauguauaaacuuaugauacagguuacuuuaucaggcaggcguagcaagagcuuagcaguaagaacagaacauuuagaaccauacacuguggcuaaaguuaccuagcauuuaugaauuguacauuucugggauuuuccauguaggcuuuuuuuggaucaaggcugaccauggguaauugaagccacgaaaacgaaaccacagauaaggaaagaaaggaccacuuugucuuuaagagagacuucuacaggagaguggcucgauguucagcgcuuugaagugguuaccuucuguccuucuccugucauguauuuagcuuucccuacauugaaaacaauacacuuuuucuguccaucaacaccauugacgaucaucaauacaucauguuuucauuucuugagcuuuucuuuuugagacugccuuacgacauaguccagccuagccuucaccuugcaauauuccugcaccagcuucccugaugcucaauuacaggucaaaauuuguuguuggaugucuuccuaaacugcuucuauuuuuuuaagauaggguuucucacuggaccuggcacucaguguuuccagcuagacuggcugcccagugaguccccguggccuguuuuuguccccuagcucugggguuuuagguguguaccaccaugucuggauuuauuuuugcaugagucuguccccacagugacacucacuuccucuaacaaugccucaccuccucauaaugugccccauggccaagcauucaagcacaguagucuauggggccauagccuaaucaaucuaccacaccucuguagcuuagaucucaggccuuuuugccugagaagugcuugcuucugaacugggaagacugcuucucugucuuccagacuuagaggcgagccuuugauacuugauccuuugucuuuguugcuggaguuuauuuagcucaccaguuaaaaaaaggagcacaaaaccaugcuuagccuuacuccagucugggcagcucuaccaggucuuuccucaauguguaauuauccuuucuuccucccucccucccuaaaaccaagguaucacuauuuagcuuugacuagccucaaacucgcccaagccguccccaaauucauggcaguccacuugcuucaaccuccugagugcugggaguauagguauggaccaccacauccaucuagaccaucaguguugauguugaagacugguuugugaauaauggagaacuucacagaauguacucagaauagcucuuugagccacauauuggcucacacuguucauucuuuuucuugaguuuuaaagcauuauaaugacagaccuuugaguccaccaggugcaauucagauuucaugauuuauaucaggauuuaagcugggaaugggucuuuuccuaaauuaaauggaauggcgugagcaucugucuaugcucauggagaaaggguggaaugaguaaugacuaaggaucuacuguauccaguauaaaauugugagcugugggaccuuggagacccaggacacggugaaguuggggcaucauaaagacauuaauagggaggauuggacuuacaugaagccauugagauggauggggcagauacccuuguuuuauuggugaagggcagucuccuuugguccuggguguguucucccguaugguauuuuacagagacuuaaccaccaucaacuauaacuuggguucuuguccuuaaacuucauggcuauuuagaguuuuuuuucugggaguuuuucuuucuucuucuuuuuuuuuuuuuuuucuucuucuucaguucuauggucuuugggaccugugcccaacuugaacaggucaacacaucuucaguaaacagggucuuaauucucacacuuaagcgugggucuuucaaguaguccuggaacucgcucuguagaacaggauggccuccagcucagaucugccugccuguacuuccugaguguugggauuagaggcaugcucgaucacugaugggguaguuuuuuguuuguuuguuuguuuguuuguuuacaaagaucucaguguauaauuugagguuuacaguuuacauaauugauaggcuuuauaaaauuggaaaacaaauuugguacagauuuugauuuuuuaaaaaaaaucuacuguaucagauuguugaggugauauuuuauggagguaaauauuacuuaugagagaacugagccaugcugaggugcacuguaauaguaacuucucugagucaaaaaauagaaacaaaaccagaagaaucguacauuuugaugauuguuaaguguagcuggugacuagugccgaugugugacccauuacgccaguccaggguuaugcacacugucuucuuggugccaauaugcccccuaucuuuuugguaaguuguuuuaguagggacacucagacacauucccuuggauauuaucuuauuaucuacagcuauuuuuuauucuacaagagcuggguugagugaacaaauuccagauuguguauuuuacaaaaccuaaaaguacucccacuuugucuuuauagaacuuguuugccaaccuuugaacuaguuaacauggggagacuucucaaacaaaccuggggaagauuuaauaccaggaaaggaguagggagguuguucugcauguagggacucauuucaauaaacugcuggccucuaugaugaaaauacauagaaauuccuuuuuuuuuuuuuuaggcuaucuuagaaacucuuugcuucuuugcuugacugucugaacaccuucuuuguucacaaacaaggaaguuagacuucuccucugucauuuagucaaccaccaaggaauuacugauccaauaguuuuuuuuuccuauuaggcaaguauuaauuuauaaagucuucaucuaguaaaaaauaaaaauaaaaaagaaugacuagagugaccaaagcaacaguauuaucagaauauaaucuaugguaucugugccaaugauauaacagcaaagcgcgcuuacacauacacacacacacacacacacacacauauauauauauauauauacacacacacacacauauauauauaugcacacacacacacauauacacacacacauacacacauacacacucacacaaaaacauacauacacucacauucacaugcauacauacuuauacgcacaaacauacauucacacaauaacacacaaacacauauucguucauacacauacguacacucacucacauacauauacucauacacacauacauucauacaaacauacacacacucauauacaaacacauaaacacauacauucacacacacauauucacaaacauacacauacucauauacauaauacccacucauauauacacacacaaacauacauacacacacacagaggaaaaagucauuuuccaauacaucauuacuugauugcucauuuacugaggcugauguuuugugauuggccauugauccuccagucacugaaguggggaucugggccucccccauucauggucccggcaucuuaccaugcugacacacaagggucucacuuuguucaucugugucaagcccugugggagggaaggagaaugugaaggauucugaguguuauggcgcaagccugggggugggcguguauguaauguccacuuagcucuugucuagaaugcacagcauucacaagaaauggaauacaguaaggaagaggaaaugggcuaaguauccagccagacagccccauuagucaugaaauccacuuuguuuucgagugacaagcaggagccugcccucccuucccauucgguucuccuuuuauucucaggaagcucugaaucccuaaaugacacuggcugaaaggcuguccuucaagacagguauugguauccaucuuaauuugguaucaugugcuauguacaugacauaauucguacgagaaugcuucccuuacucccuuaagucuuuggacaacuguuucuaguucuuccauuccugcguagaagggaaguuugugaccuccugauuugacugauacuggcuaugguuccacagugagcuguuagaagaaguggccuuggcagaccugggucacuguuuuaccagugagcgccuauuuuguggaguucaacuacugcugugagucguguguuguucaaaaguagacaggaaaagauagacgggaaagguagagaggagcaugccugcuccuagguaugaaaaaaagcuuuuaaggaaacugauuuuaugauuuuuuuauaaacuauaauuccgaacugucuuuuuguauuuauauacauuaaaauauggcagcucggguuggagagaugguucaggaguuaagagcacugacugcccauccaaagguccugaguucaauccccagcaaccacaugguggcucacaaccuucuguaaugggaucugauguccucuucuggugugucugaagacagcaacaguguacucauauacauaaaauaaaucuuaaaaauuaaaaaaaaagacaucucauacaugaauagguauaaaauuaaguccuguauggccauaaaauagugaagcuagccuuuguuugaccuacgcaaacacauuucauuuuaaaauuaccacaggaugaauuaaauuggagugguaggaauagacuuggugggcaagaggaauaaagcgugggcugacagcaaagcauccccuggacuuguaggcuaguuagugaaauaccgcacacaaccaagaguugucuaaccugauaagagauucacucacagcugauuagcagcguuggcauuaagauuaagcaguuugaguuggaucucuaaaauuccuuccaggauuaagaaugucagcagucauuaguucaauuacgugauggugguucaaguuuuggggcauuuuuacucuuaguguguaugcacggucuugugucugaguguagccacaccuguacuacugugugcacgcuggaggucagaggacagccugaguguuggugcuugucuucuacuuugggacagggucuccucuucuccaguguguauaccgggcuagcugaccuacgcugacguccguuguacuauagagggucugggaguauaggcaugugcuucugggucugguugacauggguucuggggaauccgaacucuuuacccacugagccaaccgaguuaacccuuuuaaagcugagguuucgaauauaauuaucgcuguuuuccaguucuugauuguuuuguuguuauuugcaagacaagaucacagugcguagucauacuugaaugcacaguccuccugccuagugguuagucaacucuugaccuuaaaaaucuuaagaauauguauuuauuuuugaaaaauacuggaugaacugccuauuguauugccaaauccauaaugagugaggaauuuguuguguccuucccaaguugugcucagagaucucuccuuucagauaauucucuuuccaaagggaacuugaucauugugcuuugcucugcuagacagcgcgacugaaugaaccugagaccgguccccuggguguaagaaugguuugcucccaagguuuggucuugucuuuucugcucuguuuuaauucuguuaaaauucauuuuaacguuaaaaaaaauguuuucaagacaguaacuuugaggcuucuuuaaacuugaggcagauccuauuguaaugguaggaauaugaagacuauuugagucaggugagaugaagucauagacuaugugacuagcacguagucggugaccuuuggguagaauucuuaaaaguaaggaggaaugaaauugguccagagacaguaugcuugugugcauguguauauguaugugugccugugugccuguguuagugagccugcauaugugugugugugugugcacgugccugauauacuugcauguuuuuccucagucacuuuuauuuuuguuuguuuguuguuguugguuuuuaaacucaaaacgagcuagggcucuuacuggccuggaacuccucuucuauuaggccaaacugacuagauauuuaaugggucccucccucccucccuuuccagagccacaccuugcccuccccuucucuccccuccccccaggcucuccccacugcuccuuuuuaaaaaaauuagugucuguguauuugcaugacaccacacacuuuauggacugagcugccuuccacuuuuaacuaccucccgagggaaggaugguuaaccuuuuccuguucauggcuuuaucuucacagucaagguacuucauucacauuguguccuauaaugaauagugucagaugacauuaaacaaaaugcacaggucaguuccuaugucugugauuuauacuuguuaauauguguauugcagagaauacugacacuggguggugguggcagcauacacgccuuuaaacccagaacugaagaggcagaggcacguagaucucuugaguucaagggcagcuggucuacagagcaagcucaggauagccaaggguacacagagaaacccugucuugaaaaaacaaaaauaaauaaauaaaaaagugccagcagcccugggggccgaaacacaacgucugguuuuguuauagccgaguucuuugacuuuaauauuacuuuaauuuucagaggagcugaugagaagucaaagauggcaaugacaucucauuuagugccaugcuagaagagaaaaacuggcagccauuuaaauaacauacaacgugagaauggcgccguggcuucuccagugaugcaucuuuucagaauaaccuaauuuggccauuuauuaaguacauaucuucuaaaaauauuuuuaugcaaucaucuuuuauguacuuuggaaaagagugauggggugauaaaaauucuauuaguugaauuuagugacccuguucauguaggcacauaacuucuauaaucaugcuaaugagcaguuuuguuuacaucuacauauuacagauucucucgaucccuccaggaauuguucuuauaguccccuccugccuaggcaggcauuuccuuuucuuucuuuguucuuucuuuucucauuagcauaagaaacaauggguuuucuuguggcauuuucauacuguaucauacugucuguauccuacuuguuuaucuuugccaccucugucacccccucacccccugcucuuucucuuucaccuccgaugguuugaaugaacugugcccauagguuuaaacauuugaacacuuuguccucccgugguggcacuguuuggagaaaguugaugagcuuuaaggagauguagaucucuguuggaggugccacagggagugagaugagggggaggguguugacauugagaguguguguccucaccccacuuccaguucacucucucugcuuccuauguguagcaaaguuuuuucccucaguuuccaacuccagcugcccgcugccaggcccucccagucauuauggccccuuccuguagaauuuuaagucacaauaaaccuuccuuagguuguuuuuggucaugguauuuuaucacagcaacagaaaaguaacuaaaggagcuggcgagauggcucagaagauaagagcacugacugcucuuccaaaaguccugaguucaaaucccagcaaccacaugguggcucacaacuacccguaaugagaucugacaccugcuucugauacaucugaagacagcuacaauguacuuacauacaauauauaaaucuuugggguagagcgagcagggacugagcgagcagaguggaccagagagagcagagguccuaaaaauucaauucccaucaaccacaugaaggcucacaaccaucuaucuguacaucuacaguguacucauauacguacaauaauaauaaauaaauaaaucuuuaaaaaaauaaaaguaacuaaaaugugacucccucgugucacauuuucuucaacaaucacuacccuucaggaagcccaaagguacaucauuuccugcuucugaaaauggauaaacguuuuugauuucaaaaguuagcuuaaauguauuuuauaacggguugagaaugcuaaucugugggauugauuagcaagaugacucgccaccgagcuugaugacagcuugaaguuugaaagcugguucgcaugugguggaaggagagaagcaacugucacaaguugcccucugaacuguaggaagugcugaggcauacaguacacuccagccugcacgcacacacaguaaacccauguaauaaaaugauaauuuguacuuaauaaaaacuuuaaagaucuuaauaaaaaucccuuuagugaucucuuuuaacuaagaguuagugaaggacuuggcuaauuuacaguaaauauauaaauuauucaguuuccguugugggauucagagcucugaguaugugaguuuagguuaugugugucuguguggaugcaucuguaugugcacacauguugucaaugcauaucuaugugcacacuugcuguugagauaaauacuccuccuugccucugcacgaguagaugcuaacuucaggaugcaugaucagagcacucaaaacuguuggugacaauaccagggccauuggauacugcuucaugguuccuauucugacuuuuuuuuuuuuuuuuugguuuuccgagacaggguuucucuguauagcccuggcuguccuggaacucacuuugaagaucaggcuggccuugaacucagaaauccaccugccccugccucccaagugcugggauuaaaggcaugcgccaccaccgcccugccuauucugacuuuuauacucgggucucuggaguuugaauuuggagcaauaaagauuacaaaguagggaaaucagaucugcucuuaauucagaauuuuauagaucacucagugcccuugucccuaucagauauuucacucacaauucagcaccaugacauuagaagguuuauugcuucuuacaguucuagacagagaguccacaagggcugaaagggccuggccgugggugggcagcuggaguuggaaacugagagggagcacuuugccacacacaggaagcagaaagagugagcuggaaauggggugaggacacacccucucaaauucuccauauuagacuuuuaaucaaaugaauaaaaaaaaaaaagccuggauuuuaaaucuuuaaauuuuaaaagagcgaggggaagaggguaugaagauggggaaagaggggaagagggugugccccccugucccgugcaugcaugccuaaggagagcuugagaaguccguccucuccuuccaccuuaacgugggcucugggcccugagcuccaguccaccagcaaacaacuuuaccuucuuagccaucuucacagccuagauuugagcucuuucuggacaucuuaaaaguuugcuacuaauuauagaauugaguuauuuugaguuuguuuaugguagugugaaacuaggagcaaaauuaguuuagaacauuuuguuaccccccccccaaauugucuccucuguccuuugcccccuaaaacauuggccccucuguccuuucccacacaaacccccaguguacuuugucugugguuuccugguucuggacauuuuuguauaaauaguaaucuuuuuguuuguuuuguuuuucgaggaaggguuucucuauauagcccuggcaguccuggaacucauucuguugaccagguuggccuugaacucagaaaucugccugccucugccucccaagagcugggauuaaaggcgugcgccaccacugcccugccauaaauaguuauguuaauagauagucuuuugaauaacuucuuucucuuaguguaauauuuuccuguugcaacacuguauccauguagcuaaugaaacuuuuuuguuuucauuuugagugugugugcuaaagaguauugugauauaaaaauggacaaguuuuuuuguuguuguuuuugguuuuuuguuuguuuguuuuuguuguuuuuuaaauaucuacuuaccagucgauggacuuggguuuccccuacccuuauuuuucagcuuuugugaauaguguuucuguuaagauuguggguuuguuuuuucuguacucuaagcgggaggggaggaccuucagguaucucuucucagaaggguagcaacucugguggguaagcccucuucccuuaugcuguuauuuaacccuucucaugucuuuaaugaccuaucuccagacucagucuccaguauauagucaaaccugagggaugggguuggcuucaauguaugcauuuauuuggaacuguuacacagcacauagugacuuuguuuauauuuugaggaaccucuaacagaggcuauuuaacucucuuugcuuguuuguuuuucaaggcaagguuucucuguauaugccuagcuguugaggaacuugcucuguaaaucagguugaccucgaacucacagagauccacuugacuccggagugcugggauuaaagaugugugacaucuccgcuuggcuuacuucaaaucuuaguaucguucucccccccccccccauacacacacacuugggaagggcacaugguuaagauaggaaugauuuagaaugacuagagaaaugcaaauucuccaagucuguuuaacucauuuguggggccuggauggucuccccggcaaccuugcagaguaggagcccuucugacagugagagggacacguaggaauuuugcugggacaguggacauaaauugggauugccaagggaaauuaggaugaauguuuuuaccguugagcaguaagaaggaaagaugguugcacacugagcuaguucccuucucuaagaagucucugggagucgaagaugucagcccgugacaucaguaggaaacuuuaucugcauuuccaaaccaaaccaucacgcuccauuccuucacacaucaaaaggcuucuuugaaagagagugguaauuagacguuguuguuaaacuaauuaaggagugagcuguaaauuuuucuaacauuuauuugaguuuacuguuuugcuucuuccagggaacgacaagucauuucagcuuuggagcaucucagacuacaguuguggaagccggcugaaagcaauagaaaggggaggagcuggaccauuuuucauuuacucucauuaaaaaggaauuugaagagaagauaaaauggcagaguuuugagguuaauauucaggaugaaugaugauaauucagauaggacagaagauggaucgcguuauguauuuauccgagauaaaaacucgaauccaucugaauacuaccaaacaucgcuaucugcccagugcccuucagugagucacggggauuggaacucugacaacccagaugccaugguggucgauuaugaaauggauccugcgguggacaguagugaaaguguaucuuuaagccaucaguguguugaagaacuugcuuacccagagccuucaagugauuucauggggaagcaugaguuuacaauguacagugagcuuaccugccagucuccugcacuugugaacacagggaagccccaagaccugcacaguaacugugacucccuagaggcaauccaggaugagaaguuugauccccuuaagcccugugagugcaggucugaugacgauuaugcuuguggagauuccccugaaguuuuggagcuaaaacaaacauauggcaugaaaguggacacggcuaacuacaccuuuauagcacgccaugauauugaacagggucagccuuugcaugcuccuggagguuugcagacaacagugagagacagaaaugcuuuguccuccugcggucggacaccaccccauuccucuaagauguaugugagagggguuaauuauaaucgagagaacuuugaaaaccuccaagccacaccauccaagacccuaaacacaaccuuuacagugaucucugaugugcugaugcaaacugacaguccagacguuggaguucagggucagaauucuuuaggaaaugucaccaaagaguacacagaugggacaaggcgaggacucauuggagaaaaagagauacaagcugugacacugguuucggauggcauggagguccccaacggaucugcaucacaggaguucuauuguguaucugaagaugacccaaacagugagacacauucacacggcccguaugcucaacaggaaaugggccaaaauuuaagaggaacacugcccaacugucaugucgauggugaaugcccaguacuggugccagcuuuugagaagaguaaaaccagaguccugggcucugaguguaaagucacugugacugaagacccacacaucgauucccacgacaaugacucagacauccaaaguaguacugaagagcugacccugagaaguguuucagggcagagggguucaccuuaugaaauggguuggggcgagaacggcggagccauuugcacagauaaagcagguugcaugucaacaccaguugagcaaccccccaaucugagcuucagacuugaaccugcugaagugaagaaguacaauaauguggagaauggaccaagagaugcuaaacgugcaccaaacuugaaaggggaaccaacaaauaugccaaaaccuaauuugggaaaaucagcuaccaaaacaaauaccacuguaggcaguaaagucaggaagacagaaauuauaaguuauccuacaccaaacuucaaaaacauuaaagccaaaguuauauccagaucaguguugcaacccaaagacacuuccauaaugaaggacacacccagcccucagguaacagggggcucuucaccaucaccagggccuucuaaacacuugacaaugaugaacaaagcaccaagaucugacuuuaaagccagcaaaaaagcagaaaucccaauuaacaagacacacaagcaacaguuuaauaaacucauuaccagccaggcugcgcaaguuacaacucauucuaaaaaugcuucacucgggguuccaagaacaacaucugccacgaaaucgaaucaggagaauguugacaagacagguucuccucaugcagggagugagaccgggucuguagcugccuucuuccagaagaucaaaggcauucuccccgugaaaaugaaaagcucagaguguuuggaagugacuuacguuucccacaucgaucagauuagcccugaaaagggugagcaggacggugaggcucccauggaaaagcaagagcugggaaaacaagccacgaaugagauuuuugaauccaagucucuauuggugguaagugaacucugcaguuugcuuuuaggaccggugaagaaaaccacuguauuagcaaugaguggccuguaauugcuaauaauaucccugaacuugguucguaauuuguagucagcuguucuuuguucugccaggcaguauagagugugaaugagucaaaauauaacuaacuugcauauuaaaaaaaacccucagauuugguauuuucuugaacguggguguuccuucugauaggguuuuaaaagaguaaauuaauauuuuuaugauauuuugauauuugcauugaaauaacugacacgauuagguuguguguuguuuuccugaaauuaaaaaaaaaaaagagcuuuaagcauucaaacauauugagacacauuuuagaaauggcuagguagugccuguaaacauagcauagcaacauggaaauccaggaagccaagacgcuuuucaaagcuugaguguacuucugaccagcucugugacauggggucagguaacuuugccacagccagaagggaaaggauugugcagugggucuguaaggucaccuguaggucaccugcagugacuucuaaugcaugaaagaaacaaaaguccuuacauaguaaacaaagcaguaugucugcagcaguaccugacgaauccugaggaugagggacuagguagagucacuuaaaaaaaaaaagaagcaauauucgcaguucaaggguuauuuuucuuuaaacaugugcaugucuuuugacaauuguaugauaagauguuuucaaaacauucucggggcugcuguuggcacugccuguguguucucagcucuauuuuuggcaguggagacuaagguguauuuucagccccacacagauugcccuugaaaugcuuguccucuggacccggaauggaucugcugcagaggcggaagacagaugcagugcacacagccugucuuucggggacgcuuguguaggaggaauaaaacagagcauagucaaguacacgagaccuuuuuuuuuuccagguaacauaguaggucacauaggugugugcucaaugauaagaaaacacuggagauacguuugaccugggucauuuuacagauagauguuuuggcuuuaucaauaacuguuggcaaggaugaaauguuacaggguuuucuaaaaugggcuuguguauuguuucaugacacagaucuuucaaguucuuuuuuaugucugaggaagcugauaauuuagaaucuaaauauuuuaccaaauacaauuacaauaaacucuucauuguaaucaauagccuuagguguuuauagaccuacacagaaucaagauauucuuuucauuacuuuaugggaaguuguucuugcugugagacaggguauccacauucagccagccuggcuuugaauucagcacacaguagccuaggccggccuugaaucugagguccucuugcuucgcacccuuagugcuaagaauaguuuuguacugccaugucuaguuuuaugagagacguguccuggcugucacccuucaguaucgggaaaaccagcaugaagucccuugagcacuggucuugaaaauaaguugcuuguguaguucugagacuggagaguuucaguuuuauuuuguuuccuuauauuuccaacuugguagcugugggcccaugauguguauguacuauugaagguaaggccauggaaucguuggguaagguggauuccaacaguuugcaccuagcaguguugcaguaagagcugagaauuagauaugaagugcuuuguaaggcuguaaggaccaucccaagggucccacggugucaucacuggcgauuuuacuuaucagcuagaguauagagcuaugcuucugugaccaugucuuuaauacagcagaguauuugucuaauuuguccaauuugucuaauucaacuaccacccuuuuuuuucuaucuugaggggggguaaagaggcuagcguaaccaucauagccacaggcuaugacuuaguguaggauacuaaaccggugaccucacauugcauuuucuauugaucacuucaguaguaccuaagagcucuaucugccauagaagaauggcuguuuuguuuguuuucuuguguacuccguaggucuuaguccuuaauuaaauuaauuuaucaagacugccgaccaccuuauggcuaugugguggucccaguuuaccugaaacuuuaagaaaggauuuuauuugggagaagugauuuugacuuggauugcuguuagggugagaaguaacugcuuacugcaaagguuauguggucaggauagcaagaugaaggagcugguacugaaaggaaccauggcuuaggugcuuucuuauaggcugucauuaaauuguuacaguaacgcucagggcuuauacauuguauuuauuuguuugcaauuguuauccacacacucaugcuucagaguauuuauuuaaaaacucacacagggggcuggagagauggcucaggaguuaggagcacugacugcccuuucagagguccugaguucaauccccagcaaccacauggugacucacaaccaucuaugaugagaucugaugcccucuucuggcaugcaaauguacaugcagauugagcacuuauaaauaaaauaaaucuuaaaaaaauaaaagaaaauaaaauaaaacgcacacagcuguuggauguucaaacucaggucccacaggucucacagacuucaaauuuuucaguaugugggcacuggagguaaaacaagugauuugugggagauucacuucuauaaguugauguuugauuuacuuuuuucaagaaaguuuuucuagaagauucuguuuugcuuuagugucauugugaccugcagcaguucucuuggaaacacuagcuauuggaauaguauaugaauucaauagauacugguguuagggauauacacaauaauauauaaaacaauaacuaaacaaaggagcacacagaagggcauaugcaagcgugaacauggauuuuggauaacuuuaaauguguggcuuuaccacucacugcaaaguggccucucucugaggcucaguuguucucuuuguaaagagagaagguaauuguacuuuauaguguuagaagcugguuguacuuggagucagagccaggcuccuguucccuuaugucuacaguggaaacaauuguugggcaucuacuguguaugccacagaugguaguacuuguuaggguaucaagaaagacagcuaugguccaauguuuuaucuaaugcaguguuacugucagaaaauaagccauaagggcaugcuaaguacugagucaggaguguggauggcgugcuguguacuggaggaaaggcugguagcaguugggagggcuaucaagagaagaaagcuucugaugacgaggccauuuagucucuggcuguagcuuacagggcuugugugcugggcugagaaaacaccaaguguuaagaugaagagcacagggauguauucugaugcaagcaugccagguucagguagagguugugaugggagaggggaaugcaaggagacaaugacaguggauuugcugugacuuuaaaagaguugaguuuuuggaagauuuuuguaguaggggaguagaagaagcagaggcuggggagaccagacaagccucaaggacaugauuucagcaaucauuuugagaaaugaggcuggcuuuuuuauaugaaggcagguagaaaaauggguucaagagccaagaaaagcagcaaagacacaugucuuaguuaggguuuuacugcugugaacagacaccaugaccaaggcaagucuuauaaaaaacauuuaauuggggcuggcuuacagguucagagguucaguccaagaucauuaaggugggagcauggcagcguucaggcaggcauggugcaggaggagcugagaguucuaagucuucauccaaaggcugcuaguggaagacugauuuccagguaacuagggugaggaucuuaagcccacacccacagugacacaccuacuccaaccaagucacaccuauuccaacaaggccacaccuccaaauggugccacacccuaguccaagaauauacaaacccaucagaacacacaacagcuuuccuuguuuaaguuggguagcuggauauguuaauaggagacagguguaaauugugaacuugauuuuuuuuuaaaguguuuuaaugcuauuccuuaaaaugggguaugaccaauaaucuuacuagguuaaaaacagauuuaaagccgggccugguggcgcacgccuuuaaucccagcacuugggaggcagaggcaggcguauuucugaggccagccuggucuacaaagugaguuccaggacagccagggcuauacaaagaaacccugucucaaaaaaccaaaccaaaacaaaccccccccccaaaacagauuuaaauuaguugaugcacauguuuagauuuuaaauuaguugaugcacauguuuagauuuuagaauggagagccaccauagaccuaucuguacuucuggggugaugguugaaggaaugcaagucagccugaccacagagagaaccacagcauguuuacugcuucaauauucacagugcccaucuagggaaccagcccagauguggaucagcagaugagcugauuggagcagugguacaggugcacaaagcaacuuaacucuucuguaaaaauuaaugaaauugugucauuuauaggagaauuaauggaacuugaaaucgcacuaaguaagucagacucaaaccacauauguuucuuucauaugcagaaucagucucuuucugccuuuaauuuguuuguguguguguauguguguguguguauauauguguguguguaugcguguauguguguguguguguguacacauauaaauauguguguauucaggaguguacaucuugaaaauagagugacugugacauagaagagagaucuaagaaaaggaaaaaucaggagcaaaagggaugauaaagaagaccagaaaagaaaaaaaucccauguuuugucucauaugugcuaggucaaguaucuauauggaggcguauguauacauaugcacacauaaaugugacauaaaaguagaaggcacggggcugaccagauggcucagcggguaagagcacugacucuuauauacauaaaauaaauaaaucuuuuuuuuaaaguagaaggcauauuuugauguaggaggaaagaguugggaagauggauaagggcuagugaaugauugaauagaaagaaaauaaaaacuguauaugugaugggcaugguggugcacgccuuuaaaccuagcacuugggaggcagaggcagguggauuucuggguuugaggccagccuggucuacagagugaguuucaugacagccagggcuacgcagagaaacccugucucaaaaacaaaacaacaacaacaacaacaacaaaaaacuguauaugugcaaaacugccacauuuuguaugaccuacaauaucauuauuuuguaagcuagcuaaaaaucaaaauuuagaauggcuuuuuauguaguguaagggcucuguguuagugagugccaauaauaauaggguaauuguuauugaguagaaagaucucaguggggauauucaggggcaacugaagggggagaguguuggcuuggaaauaugacuuuugagugcaucauucaugguugaaauacaagacaagcuaugaagggcgagcucauggggagggaagauaacaagaccaaguugaagcccuggcucagacuaaccuugaaagguaucaaagaaugaggccuagggaagaaauaaccagacagcuacugggccuaaagguauaucagggccauugaagucagcuucaaggagucuuacucuuuuuuuuuuuuuuuaacauuuauuuauuauuauaucuaaguacacuguagcugucuucagacacaccagaagagggcaucagaucucauuacggaugguugugagccaccaugugguugcugggauuugaacucaggauguuuggaagagcagucagugcucuuaaccacugagccaucucuccagcuccucaaggagucuuaauuguugguaaagccaccaagacagaggguuugucucauagagcugucgccucagggauggaauugggggggaaagugugaugagacugaaaucuuaacugguuuguuuccucacagggcucugcacccaaaacuuccaccacgccaggaaggagcaguuccaagccagacucgcggagccugaggaaaacaccaggucuaaaagccaaagugggucccacugcugccugccugaggaggaagagugagaguagaacccuaggcuccgacagggccuuaucgccucagaggaucaggcgcguguccggcucugguaaggcaaaaguaacucaaguauucucauuauguagcacgggauggauguuuugcaaucagaaauuaggcuuggcagaaagcagaaaggccaucugguuuuagagccaaugcauuaugucgcuaaagcagcgagcuuauugugguccaacaggagagaagggccgucugaggagacagcacagccucuuuccuuugagcagugcaaagcgucucuggcgaguggcugaugugccucaacuuccaggcucucccaaagcgugcguauuauaacugugcaguuggcuaguguagcaaaccuugugaugaucuugauugucaguuugcaccugggaagaaggaaccucaauuaagcaauugcguucaucagugggcuugagggcaugucuagagcuuuuucuuggcugcuaauugaugugggagggaccaguacacugugggcagagccacacugaggcaggaggggccuagucugggaaagaaagguagcuaaacagcaaacugggagcagacuggaagccaguccucccucggucccucugccucacuucccgccuugaguuuuuuuguuuuuuguuuuguuuuuuuguuuuuaaagauuuauuuauuuuauguaugugaguacacuguugcugucuucagacacaccagaagagggcauuagaucccauuacagaugguugugagccaccaugugguuucugggaauugaacuuaggaccucuggaagagcagucagugcucuuaaccacucagucaucucuccaguccaagaggguuuuuuguuuuuuguuuugucuuuuucgagacaggguuucucuauguaacccuggcuguccuagaacucacucaguagaccaggcuggccuucaacucagaaauucgcugccucugccucccaagugcugcgauuaaaggcgugugccaccaugccuggcuccugccuuggguucuuaucuugacuuuccuccauuacagacugugauguggaaguuuacaaggaaauacaucuuuaccuccucaaguugcuuuuggucaugguguuuaucauagcuacaggaagcaagcaagaacacaagagcgguuuuauuuuuuaacugaguguggugggcaccuguauaaucuauuuggaaaguagaggcaggaggguugcaugguuaagccccaccuggaauggauauguguauguguguauguauauaucuauauauguacacauguauauguauauguguguacauguauaaauauaugucuauguguauguacauacauacauacauacauaugcaugcauguaagaugacucaggguguugguugccaagccugaugacccgaguuguguagaaagagagaacggacucccacaaguuaucuucuggcugucacacauggucucguucucuuacacacauauauuaaauaaauaaauuuaauaaaacuaagcuaagcacuuaacauacuguaaugguuuuuuaaagguucauaaugugcccccaucacauaggaagagauuuuuuucuuuugaauuguaaugaaagacaguuuagggggcuagaacagcaacugaaaaguuaaaacuuuccuaaugugaacuuucguuuaccuuggcugggauuucagaaguucuaguuuuaaagccgaaucaggcugaaauuugauagcagcaccaagaacggcuguuaagggccuuacucaguuuggcagaugugcacauugcuuuguguaaugagcuggaacagcaagugcaaaauucgccccuuucauagacugagacgaaaagccuguuuagucaccccagugaaccgagagagcucuccgcagggaacaccccuuauuucugcagguacagccuugagcaaauuaaagacauauuggauagaucacguguaaaaaaaauagugacuaguauugaauguuuaaaaaaugugccccuaacgacgauguuuuugcaugugagaugcuucacagagccuauagagccagccgaaucccggaggaccucuuuacugcacugcaauuagcauuuuuagguuuguuuugcaggguucuaucuaucucaaagcugcuagguccaggcaugugcuguuuagauucuugguuaauaucaggcucauaaggguggagaagcagaccccagaugacguggagagagaucgguagcuaaugcccauccccaggggaacuaaauggacagaaacucggggccccauuaaaugucaucauuugggaggaaaauggggaagcuaagaugugucugaaagcaguaguucuuguuuuccauauugccaccacugggcgcagaccaggaaggagaucugaguucuggucuuccuugcugcugccugguguggcucuuggaagucaccagggcuggagagcuccauuccugcuuugauguuuggagcaccugggccuuggugccacguggagcuguggucacuggcacccuggccugauugauguuagggguccuguguucugauuucagucuggcaccagcgagcugccagguucuggcaaauauuuccccuccguuggcauggacacuuaucaagaguaaggguuucagaaucuuggaauccaauaguuuuugcaggcuuguuuuacuagggaugaaauggaauucaccuaguuucuuugagaaauggcugcuccucgcaugauuaucugagcaauacgaugcuugcacucucucucucucucucucucucacacacacacacacacaaacacacacacacacacaaacacacacggcuuuagaaauugggucccugcccaagaucuauuuaagcagauggaacucuuuauggagacgaucaguccuuuuuaaaagucccuuuaccauguguuauaucuauaagagaaauguggaucuguuuaaaaaaaauuguuuuuauuuuuaugugggugcuggaaauugaauccaggucaccuuggacguauuuaaauuuucagucugauuuuauaaaacuaaaucaucuuuuacuuguuuuauuguuguugagacagaguuuuauucuguuucacuggcucaucuggaacuugcuguguagccuggcuguccuugaucuugcagcaauccuccugccucugccuucugagcgccuaggguacaggcaugugucaucaugccuauuuacacauaguuuucuacacaugacuaggagaaaaugugacugccaccauuauuaucuauuugaauuuaaguuuuacuucuguaugguuagaagacuucuguggacuggaggcuugugucaccccgaauuuaaaaguggaagcccuaacuuuggagcuagggccugugagaaggucucacaauuaagauaaagauaagacccuaggcuaaaccaacuuacaggaagaguaagaaugccagcgcuguaucucugcuuugugagaugcaggagcaacggggugucuugggaagagacucaggcuggcaagcaacuuagcugagaucuugaucuuggacaccucagugucuagaaauaagagaagauaaauuccugauguuugggcuguccagucugugguguuugugguggcuagcugagguaagacagaagacaauucagcugugcaguguuauguuuaaaaauuagcagcuucucuggagaaucuccaugaauugggagguauuuggagaggggggacaggaaaugugacaccgcugaguugaagaggggagagaaccucgggagucucugcuguacaaugaaguguuugugcgucugcaaccgaaaccaaauggaggccccugcccccccccccagucuugcuggcggaaagguaacuggcugcagucguccaaccaagguggggcuuucaaucaaucuuuuuagaaaaccaagcagagagacccggagucaaaauaacaguucuuuaaaaaagcuuuaagcugacuaucagacuacaguuacaauugggguaccuccauuucacguguugucaaauauggaaauuuauauaugaucacagaauauaaaguaagucacacccaaguacuuugcucuuucagaguguggguuuuguuguugauggcggugguaaggaucgaacuccggaacacuggcugggccuugagcaugcuaggcaagugcucuuccacuggacuagauccccggcucuguuuuguuuuuguuuuguuaaugaacucaauuaaauaugauuagauaaugaugggaauuuuccuagccaauuauuaccacgcugaugauaucagcuggcucaauuuaauguauguaugccaguuucucggcucuaacuuaaucaucugaccucuugaguuuauguaacacucacugugauuuucugaggcuuauuuccaucguaagaacuaggagcccaacaugggugaguucagugacauacauacacugagguuuugcugccgggaagagccgagguggauuugaagcaggccgugacgcuuuaagcucuuggccugaugcuaucacacagaagaagcgccaucggaccaucaguucugaacauagaaaaaaauuguuuuguccucagcuaaaugucugagggacuguaggcuucuuagguccugggcuuuaagccaucuucucaguuuucuaugacguaaauacuucuuucuauaggauuauugaaaacuaauggaacagaggaagugcucagccaggagguccauugugcuaugguccguccuggugucuacagagcgucacuagccacuccuuucaguugcacugauuugggcugcuaugguugugccucucuggguaguguaaaacuguccccucggcgacccgugugaaccacagggugaccaaggcaggauaggacacccucucuuccuuggaacauuuaucugcgcuagaaagucugaucaacccucuugcaccaaccaaaagcuacccaaagcgcugaguaagggcugcuugcgggggauggguuuugguuuuuacucuagagaaagagcguuugggagugaguugacccaccauauuuauuugacuuuuuguggguuaauaaaucccuuccuaguacauccagaacuaguaacgaccugucuguuguugugaguuuuucuuuucauucaguuguacagcuucuugguuuguauacacccccuuuuuucccuuacucagcauuugaaauaauuuaaaaucuauaaaaauuguauaguguuuccuacauuugagggaggugguaaaaauauacauuuccucuuuuauguccauuaguuauuaaaaacuagaaauuaucaguauguuaguaagucuuucagaguuaguaacagauauuccuggaucuguaacuaccuacaacacauguucgugugugucuggggacuucugcugcaguauuaacaggaacugaugggcuggggaggagcacaguuauaguguggcaggccguaucccaagcuuucuuguguguacagucucacagcuggugagggguaagugcagugguuaucccgucuccacaugaaguaucugaagguuugcaaacucaaguaacuaccgaaauuacacagcuaauaaugaguggagucuggcaauagggcuacacugaugaccuaaguuuuguuguugggccuuguccauacacuuguucaucaccuaacaugacugcauuaaagggaauauaaaucugacaauggccuagugacugcuuauucaugcugacuugugugcuugguauuagagauaaagaacuccaaaagaagaaaauauccccacagacagcuggaguugaacauucguagaaucuuggugcucagaggcuuaccagcagaagaauuauuaacucuaggccagccugggcuaucgugugagauccgugccaaacuccacuauccguccuuacaugaauacacaggaaagagacaggcaacuucugcccaagugauucuuauacucaaaugagggaaacuagaaaacaagugaaugaaauguucaguagacaauccagugagcgauaaguguaggagagagaauagcucagagcuagauuauacaucauugucaagaaagaucucacugggagaacugagcacaagcuggaaaugacaggaaagcacguuggugagagacuuccuaggccgacucaucaggcaguucagcaaagcuugugugugggucccagggaacugugcaguaacaaccguuuauaaagggggcuggagaagggacagaggcugaagcuggagcaaguagggcuugaaggcacagggaaagcauguaccuuccuccccaacauugucacugugaauuuagucuuucuugacaugucccaugguucucagcacuaauugggagaugauuguuuagagagggacaugugacgugucacucugcagccuauuagccaauaagaguaccuguuauguguuuggcaguccacuagauucugaggcuacaaauaugauuaagucagcauccuuuaagaauuggggauagcgacuggagagaggcuuguccaagccgagcauucucacugaugucccggccaccuagacuguguacuaugcuggguggugauuuucuuacauacccgucuccugccaaacucacauccauaggacagaguccagggaugaguuauuuuuauauuccccaguacucagcacgauguaccuguuauauaacaggcauuuaaaauguccuuuagcuggcuuugauggaggacuuagacaaagcacugaguagcuacaguacagagaggaaaccaacucagccuaagggaagacuggaggagaaugggggcauuaucagcugaucuuccaguguguccaugggagugugucaguagacaagguugcuggcaucagcagggccucugaaaggcugugguguaucuggcagguucuagacuagacuguguuuugagaucagugagaguugaccuucuguuucaagggagcuggaguuagaugaguucuagucaccuagaugcaaauccugagacucuuccaguguucggggaauaggaaauagaacauguauuuaaaauaucauggauguccugauuugccugcuuaguagagaauggucucaaggguaugccuacggauuuguauuugagauaguucuauguauccagggagaggucauaagucaaaauuaggaagagagcaagaaaagguuuucagaaaauacaugcugugaugguugguauaugcuuggccaaugauuggcacgauuagguggucugaaccugugagccagccccaaauauauguuguccuuuauaagacuugccuuggucauggugucuguucacagcaguaagacccuaacccaagacacaugccuccaaaguacuuccaaagguagaugcauguuuccgacuuaagaugauguuaagcaagccucuuccaaaagagccgggaggcuugagugagaccaguggucgggcauugaaaaagucacaguggggcggcuugcaaaggguuuaucuuugagguagaggggaugcgggaguguguggauauuagauuagugagacuagauagaggucagaagugagggagagagcuuugcucuacuuugcauuucacuuugggcagagaugauucaccccaagaguuugcagagauuuuaauugcgcauucauuuuucuuguaacccuaggaaaggaaaaacucaggacggugaucaauguccaagucuuaguaagcuaccuguucagaggaguucucuugugaacuugccuucuaaugagccuggaagcugucuucggugguugugguuuugaugcugggguuguccccaagaccugugugugcuaauugaaugguuguccuacugagcccugccccagucucuuccuccauuccuuuuuggauccucaguguaagugcuggaugcuaaacaaauucccugguaaccguagaaagaccccguccaucuuuuucuggaaagcuggggaaggaugcacucaugccccuccgagucuuuuuuuuuuuuuuaaauuacauucugaauuuugaauguucucucagguucccaggcccaugacuaaggaaguuauuuuugcuuaauccccacucugaaacagccgauccuugugaaagugcucucagagacagguaccgacagcacuaccaucaacaccacgcuucugugggauucaaggcaucgugagaaaguugccuuguagauguucuuguuucucugucaaauuaccccucuugggacugggaguguuuguguugugacucaccgguguugcuguggcuucgugaugucagcuuaccuuugaaucuaagcaagcuguggucguuacgccaaggguaguuucuuaugcccugccuacuaggagaacauuauuguggcuaaauccugaagucacauuuagcaguaaauaagcauagaguggagcagaaacccuguguucuggaaaguuaguuaguuaacaucugguuggacagcgacuggucauaugucauaauccaaaccuagaaaagugguggggugcacaccaugguuccuaauagccgagucagggaggcgagggguucuucucauuucauuuguucuucuaacagaaaagaagguaacuagcagcacuuguacaaauaacagcaugggaacugagacauuggcuugcacccuuacuuggcuuaaaggucaaccuuaauugauguuggugcuuucugaugcuuaaaacccccgguaggguagguguggugguuugugccuguaacugaagcucuugguagguagagacaaggagauugccccagauuggagcuacagagacaccaucucaaaaaccaagccuagcaaacaaacaaaagccagaaacaaaaaugaggccacacauagacagaagagauuguaaagguuagggacaagaucagggcagagagacuggaaacacagagggagguggauggucagugaguguucuaguguucuauggaacgguguucuggcugccaaccagaaaagucaggaaacacagaagcuaggucuguaauauagaacauaggggaaguguucaagcaaagcuagccgggaugguuugacuuccuuaaugcuuugcauuuuaauugguugauuuggguagcuuuucaguuuucuacucuucccauuuuaguaguuauuuuaaagguggguggcauuuugaguggaaagucggggcaggggacucuuucagcucacuaccacucauaauaacaaccucugguguccaaauauauggcuaguacuccuaugcauuguauagagcuguuuacaggcauauuauauaccaccuacuuauagaaauccauugugaaggaucagcagucaccuaguuacuggauggcacuuuuuguuaacaagguaccugaugaaccugcuguuucaagauugauuuacuuacauauuuuauauaugugaauacuuaucugcaugcacacugcaucccauuauagcuggcugugagccaccaugcgcaccauguggaugcugggaauugaacgcaagcccucugggagagcagccagugcucuuaacugagacccauuucuccagccccauguuuacaauuucuaaauuuuauuagugccacgguuuucagugacuacauuuucugcauguacuguuuauucauagugugguucuaguauauguagcaugguauaagagaauaccacaggauguguaaucuguaaacaauagaaauuaauuuggcauguagucugaaggauggggaguccaagaauaugguccugguguuauccccugcaaaagacacagagcaagggaguaugggagaauaaacaugccagaggggaucaaacucgccugcagaaagagccugcuguccagucaccacgcacuagcaggacagccuuauucuacuaugaagucaaauuucaaccuguggggcgugaccccuuugggaguuguauaucagauauccugcauuacgauucauauuagauauucacauuaccauuccucacaguagcaaaauuacaguuaugaaguagugaugagauaauuuuauggcuggucaccacaacaugaggagcugaauuaaagggucacagcauugggaagacugagagccacugcauuucugagaauucucagaauucucccagcccaucuccucaugaggcugcauuggcuuguuuuguuuuuuucaacacauauucugggagacauguucaauccauaacagcugucuuccaugguuuuggccauuuccagagguuuccaggucuccaccacucugcuccauuaaacagcccuccacagaagaacuucgugcaggcauaccuauucuggucaggcauuucugaauacauuccucuggguggacccaaggguguggacauuguuaacgcuuuggguacacuuuauugaguugccauucagaaaaagcaugcaagcccaugcagcaccucugaugacagaagacuuuuuuccaaagcucuugccaguauuuuguuguuucugaaguucuuuccagagagucaccuuuaggaagggugugaaaugguauuuuaauuggccuauaacuugguacuuaaauauuuauugaguacauguagauucacuuaugugcuagagaacagugaauacaagaucaaaacaggcccugaauauugucaugcuguguaacauggguuauauaugaaugaaguguaaaguauuuuggguacugauaaucuaagaagauugaaaaacugcuaaaagagagaaguggagauaugaggugaauguguguguaagggggggggaggcaugaaauuuuaguguaguagggagggguugugaguucuggccugaaggagcaagugcucugaauagcagauggaaacagagugaacagcaggaggcacuugggaucugugcucugggaauggagggcacaaguagccaccagaaaccgagaaggcagaggcaugcagagcuggguuauauguagucuuaaaguucauaaggacguugucuuugagccugagugacuuaagcauuuguaggaucacuguguugagaguagacugaaugcaagugagguugggaacuggagaggaagugguacugaugcaguuauagcaaaagguauucuuuuagcaccaggacuguggcggguucuggcuguagaccgauacauggauguuagaaggaaagcugauggguugaaugagggaugaggaacagagggguggugccuuuucacugagcuagaaagauugaagggguggaggucaggagcuguuauagagauacuaaguugaguagauauaagacagauauggaguagugccuguaaguguguagucuggaggagcucggucgaggguuacaaauuucagauucagcagccuguagguacugaggacaccaaggcacacacagcacguggaaauguggccaagggcaccugucuggaacuuccaagcuuaaaauagaggcugaggagaaaucuuaaagaagggucaacgagggauagccagagauagaggagggaaggcagucaggagagacaacagaagagucaguuaccuacaucaaccacuacagacagguuaguagggccaguaagagcaguuugaagcagguaguagcaauugccuuaacacacaaggcuauacaucuaauuuaaaggaggccuggacaaaggccauucuauguuuggugauuaaauaaugucaccuccugcuucuugucuguccacccuuccugcucagccuauugucuuaaugacaaaaaucaguuaaaacauggucgccaaaaguuccacccaccacaaacucuugcuacuguucucaaaggcuggaagccaagggcaguguccuaggguaguggcucugccuucacaugccugccuggccguguugcuuggggaggaaaucuaguugugcacagcauuauucuucucagaucuucuuggccccaagcagagaugauguucacuccuuauagcagaagaggucaggaaacaaggauucagcuucaauuuuucuucucuaugggaguccuggggauagagaguaaaacuagcagcuggguagucaaaaaagguauuagagacaggagcacagccuuacauguuguacugacuuugcuuacccguuagggcuuuuguugacuuguguuuuggaguuggcccugccauuugucccauugcuacuaccugacuguuaauuuuguagcuagugauuuuuuuuuuuuuuacgaugucaggaguucccuuuuacguuuccaauuucuguauauaauaacgagaccaccuuaaacuggaaagugacauauacucaguuaauaauuuuaugguuucauuucaaaugucuugcuuuuuuauacaauguauguuggcgaccagucagagaaaggagcuaguauucacaugccacucuuuaccagauacauuucuaagacauuuguuuggcgagugagaggcccugugaaaugacgcagcuauaaucaugcucagacacaaggaggcaagaagcccagagugguuaaguaaccugcccccagccaugucugguggagauggacguaaagagagcgguuggauucuagauugugucuuuuaaccaugcgccaugguacuguucaaauuuuaauuuguauaaagaucucaauacaaauggguacauuuuuuuuuggauugaaaucaccucccuugcccuacccugaauuuucuuucagauauucauauauaaauauauuaaucuguauagcugugugucaauuacaauauagaaagcuuugguuuuuaaugaugaaaaugcucugcauagauagauccuguaguguugaguacauucccauuagagcaguguggagccgccauuccuguuucucaaacauuugccugcucugauuaguccauuaaaaaucuaaaccuuacuuccuaagucucccuuucucccacccuuuggcaauuggccugauucuuucugucccuaugacuuuacauguuccacgaagcucaccgaaggcuaaucaugcgagaauuuuccuuugugauuaacuuaaugaggcuuagcaucaugucgucaaccuaauucacauuguguccuugucaacauuuccuugcuuucuaaggcugaauaauaaucccuccuaugucugucuacaccagaugaacacaucugcccaugaauacuuugguggcuuccgcauuuggguuaccaugacuauuccugcugcuaacauggguguuacauaugguaaauccccggcuuucaccucuucuggguucucaucuagauaugagguugcaggaugguaugguaaauagauuuaauguuuuugaggaacucuucaugcuauggugcacaguggcuaccaugguguuacauaugguaaauccccggcuuucaccucuucuggguucucaucuagauaugagguugcaggaugguaugguaaauagauuuaauguuuuuugaggaacucuucaugcuaugcugugcaguggcuacucccugguuuguauucacaaagguaauagcucuacaugcucaccaguguuugauguuuuauccuggucauccuagugggugugaggcuguuucucaguguuugcauuugcauuucuccagugcauaaggaugcugaguggcuugcaucuuggugcaugccuauugaccacccguguaccuucuguggagaugucucuaaguccuuugccuaucuuuaaauuuaauugcuuggaugauuugcgguugagucauggucuuuucucucucucucucucucucucucucucucuucuagaauuuuaaagcuauuuggaccuuaauuauuaaaauuuaaaaaauuuuuucuuagcaccauuuuaaaaauagaucacuuuaaaauagcauuagaguauaauauuaauuuuggggaaaguuagccuguauucacauucaaaucuaucuugggugaauuuggaaagaacaggguauauguauauauuuguccauguguauaacuuuuguugcuaaaagaccuuuuuuuguuuuguuuggggggguuggguuuuuuuuuuguuuguuuguuuuuuuguuuuuucgagacaggguuucucuguauagccuuggcuguccuggaacucacucuguagaccaggcuggccucgaacucagaaauucaccugccucugccucccaaguacugggauuaaaggugugcaccaccaccgcccggcucuaaaagaccauuuaaaaagguuuuuuccaacaaacacaaaaacuguucuuuaguuuauaaguuuauuuauaaguagccuauuguuuuuauuugaagaacauuuaauauuacaguacucuccaaugaaacuaauuuauuagauguacauugcuaaugaaagcauuuggcccauuagaguuaauugcaauugaauauacagcugucauuuugagaauaguacaauuuguuacugcuuuggguuuuacuuuaauuuucuaauuccuaguuacuguagauaauuucuauaaaggucuuuuuauguaguugcauguaaagagcugacauuauaaccauagcuauaacaggguuaucuuuuguuugaaccccacauucauuuagcacuuuaucuuccugagugucccugcugauugcccaccuuauuaauaauuaaauguuaccaagugaccucagucaccuccucauggucuagagaaaauucccauacccuuugcucaggcaaguaugccugccuccuaaucucuacuccauuucucuacucuucccuuuggacaaggccugucuucuaccaugugaucaaaauucuaauucaaauacugagagccauccaugccucucuccaucucuccacuauauucacuaccaaaguucagguuuaaaguucccaucuggcguuuaguggcaucucuuucccaguugugaaauaaccacaucuccaacauuguugcucuuuucuuuacccugccaucugcggucccacuaagaauggacccuccagagcaccaggcgcugugucaugggccacagugacuuuccuaguuacacuuuucuuugcaaacuuuugucagauguuucagauacacaggccugugcuuuugugaucgcuuuuuuuuuuuugcaaguuaccuuccuggcucagcaaguaaacacuuguauaauacacacucccaugugauuucauagcccagauauuuuuaaaagaguggucuguguuguccauuuuagguaacauuguaguagauucucauucuuucuaccuuucuuucuucuucccccaaucucguucucuccugccuccccugaucucucucucucucucucucucucauauaacugaaucucauuuaugcaagccauacauuuuaucaaaugugaacugugauaugcuuuaugaugauguugaaaagccucucacagcuuuguuaagucccuguucaugucugcuugauaguucagagaugggaaaucacuuuggcugguagauguuuuguggcuccgggaauugcugucauuccuuugaaggugcuucucucuugcaguguggacucacuuaccuuucccaggccuuuccuuagaguaggcugagucagcacugggagacuggcaaugcaccgucaaaggcccuggagcuuucucuuggagaauaaaguauuucauagaaggggaagacaaaggagggccauuggggagcucauucuuuggcuuucauuuccagcccuaggaaacauaccucuuaggaaaucaugacuuuccacuaguaaaauggcugucuucauaauaaccagauacaagcuaugaauguaggcauugacuuaguguccuucuugagugaaauaaaaggguggaugaugagcuacugcuugcagauggacucacacagcuacuggaaucuaccuugucuguccaguuucuccuuucuugguugccggauccacuuuguacugggagucgugcguuugaaugugguccccauugacuucugcauuuaugacuuuucauuguuaacugugcucgccaucuagagaaaauccauaccaauaaauguuuaaaugcuaaugaugagggaauggagaucuucucacccacgccuuuucuaguacacucaaucuuggcagaccccacgauacucccauuauacugcaguauguuuuucugcaacuguuuuauuauaaauuuaaacuuccugugugauauuuuucuucuuucgcgcucuugaacuugaacuaauauuguguaaacgguuauaauuacaaaagugaauguacauauguaucguaauagccaucaaaauuccaauguccuauuucacaggcuaagaauuaaauagccauaauucauuuggaacuuaaaaaagaccacgaauaaccaaagcaacccaaaggagccaaggaacauggcuggaagugucaugaucuuaaccucaaauuauaaagcggagcuagaaugacaaagacagcucaguaugagaauaugcccuuaaacuaacggaauaggaccgaggaucuguaaauaagcagggaggguggagccuaauuuuuguugaaggaaucacaaaaacacugcaguggaaaaaaagccuuuucaacaaaugauguugacaaaucuuaagaugcccaucugccgaagagugacguuaggucuguacaaaaaucaacccaaaguagaucaaaagcucuuaauucauaaugugaaguugucagagaaaagacauaggggugagccacccauuucugaacagagcgcgguaacacaggaaccagggccaagaaucaacaaaugggauuucuugagauuaaaacguuuaugcacagugaaagaagccaucgacugugggucaaacagcucacagaaugggaggauaucuuuaccaccuacacucuagacaggaggcuuaucucuaaugaacugcaaaaauuaaacaccggggaaauaauacugcuaauuugacaggaugaacacuucuuagaagacacacagaagacuaauuauuuaaguguucaauaucccuaaucaucagaagaauaucaauuaagacuacucugagauacagucuuacuucagucagaauggcuggugugaagaaaccuguuaaguguugguggggauuuggagaaauucccacuuauuguaugugggaccgcaaaucaauacauuauuuggaaaucaguuuggaaguuuguaaaaauaauaauagaacugcccugugucccagcuauuccacuccugggcacauacuuggagaauuccacacucuacuagagagaccauguuuuauuaccgcgcuauucacaacagcgaggaaggagaaucaaccuagauaugucuaucaacagacagauaaggaaagugugguacuauauauuauugaauauuauucagcuguaaagaaaagugaaaucuugaaacucccagaaaaauggauggagucacaaaauauacugaggucacccaaacucagaaaagaaucacacgaacuuccucauaugcaaaucccagccuacagugcauaugaaaauugugugugugugugugaagcaggaggauugcuugagcccaggaagcugggcaacagagcaagacucugcuuuucaaaguuaagcuuuuggugaaauagguggaagggagaggguggguggguugggagaucaagaguucccuuggaaccuuccuaaggaaugcgggcuagggcagguaaggggcuggugaccgaguaugggcgcgugugcuucugggcaggcugugcguuagugagcaugguguaggucucuggaggcacacuugaaagaucuggaagucuaugguguuuccagaggcaguaccaggaagcacaccuuuccaaggaauccuguaucuccuaagcuugcuagguuuugacuucauuguagcugugacccagaaaauuugauccccggaccuuugauuuuggaguugacuccaucuggaugguuuuuuuuuuuuuuuuuuuuuccgacaggguagcaguuugauaaauuuguauucuaaagaucugcuuuuccauuccaccuaaagccagugaaaaggguuggcacgagaagugaaagcggaauggguguuugaacauguaacacuugcugugccuguuaguaaggacuuguauuuaauuaauagacuuaaagagucaaauugccuuguaaaaugggcgauuaaaugucuugguauagauggagagagagaguguuuuaacaaaaugagucauuuacucauggcaugggaaggacacugauuucagcagacaccuguugcagcuccuugcuuuguaaaguccaaggaacagaguuggauugggaaugccucugcucucggagucuccacccagaucaaucaagcucaggaagccaguaggagguaugagcaaaagccagaccagcaagggggaagccugaccuggcagggguggcuugagaagaagccagaauucugaacagcuuagcuuagauuuaauggauuuuuuuuuuucaagguaccgggccuugaacccagggccucgugcaugcuagguaaguguucugucaugugcuggggacaaaccagugaacguaacauuuugccaccgucaccuuauuugucugccauugguaaaaugugacagcaucauuuuugucaaaggucuuuccaacccuugaugcacucuagggcagugaugcuaccagcauagcucgcauagggccacucggugccaggauauccggagaugauacaggcauggucccagugauuugaagauugccuaaugaaagggaagcgagaggaagccagagcacccacguuguugaaacacaaugaggaauucagugugaguggaucuggucuucagaaagaggauggggcggagcuuguggaauugagguucagucuccacuaaguccuugaguagagcauaaagcacaucaaauagacugcucaagaggugagcgaguuugaagaguucugaccaaaacaauuguuuggcaaguauguaugccuuuguuuguuuguuuguuuccagcaacgcaguuuuagaaauuugagugaacagcauuccucacaucaaguuuggcaaaucaacuggaaagaugaaacaggaacgggguggggaaaaaaaugagcauagcgccaccugcuguucagcuccgagcauuuuuuuuauuuagugaaagcuuucucccaaccgugauuuuuuugcuuugagugcuuuuaaauuuucgucuauuucuuuuuaaauauggccaccucaugugcuaacagagcagucugcuuauuuuaguguuaaagggaaagguaucacaucugaucguuucugcuuugaucacgguuuuaccaaaggcuucuuucuuaauguuuuuuuucuuuucccucauccuucuugcacaucagagaugugugaguuaauuacuugaggccacacuucucauagccuaauugcuucaucauuuccucucuucugcuucugaauuauucaaaagaaguaagugugugugcggcuuuugugucucucucaucugaagcaucauagcguugaacauuaauuuugcauucugacaacuccauggucgguagagaaguuugaauguaccagcuuaaaguacaaguuuucacgauagauagaaaccuuuuuuuuuuuuuuuuuuaaucccaaggaaagccuccgugcuugaaaacugcacucucuucuugggugaauuugccuagaccacuuccuauauccgaagcauccuugauaugcagggcaggaagcacccggucaguggccagcacccacagcgaccugagcgccuacagcagugacuguaagucagacugaugucaccuuuugugggugguugagacaguagacauaggcaaagccaaugguccacaaauaauuaauuuugucucuguaucuuagugggaauuuuacauauuguuucuuuguaauuacucagaauguuugacauggaaacaaguuuuuaggaauagauuucuuugaacgaaccuccagggaacccugaaaugguuacguauuacuggcaggugcuauauaaaggaacuuaaaguacauuauuccagcugacauguuugcagggcuguuuggaaaagaauaguagcuggggcucuuccagcuugagauccagaaaaccaucacugguuuaguuugguuugguuuucgaaagagugucuuguggaagugcuuuguaaacuucugcuuuagaugccagccacagggugguacaaauuauacagcuuuaagcuuaaucauaaauaaguuaaacucaggggaauacucugaaagguuuugugcauuccauuuucuucaugccgagugagcaaagaagcuaagcucuuuuuuccccccaaaaagacuucucccccuuuauucaaaagaugcauucagaagagagcuuuuuguuuuguuccccccuuucuucucaaauuuccucacgaaauaauccaugaaugaguuaagacaaacaacuuuggagggcccacugugccuaggaucauaauagguacagggagggauauaggugacagagaaauagccuuaugaauaauaaaaagcagauuaggagaaagagacagauuauauacauuugugaggaagaguuggagaugugagcucuuugcuuuaacgacaaaugcaugucauuuguguggggggugggguggggugguguggggggccagagucaucaaacucuuuagguguagaccagcaacagagcuaccauacacguacacgcuccgcuacuccacugcuuccaccccaauaccuuggucuuuaccuuggacuuuuaggagacuuaacugaggcucagagacuauuaccagaucaaagucacacagcaaguaugugacaggauggauuauagacaauaggcauugaguuaauggcaaaggacccauuucagacaggucacugaaugcagaggcuggucucauaggcacauaguauuaguauguuaauuaaaauuaaagaggguuauuauuuuuguauguauucauuguuuaaaauuuuaaaggggugggggaaaaccccaaaggguuuaugcuaacagguaauuaauucucugugaaccugaaaauaugacuagcauuuguuauuauugugaauucgucucccaucuagacuucuuuguccuacugugcaaauuaaaagaacaaaaacaaaaacagaacaaaacaaaacaaaccacccugauagaaucaccagaaaacccugaaagccauaaugauggaguuugugacacucggagcagacacauuccauaauaucacacccuggguuuucuaucgaacagccauguugaacuggccacugccccaguagccugucugacccugccaaggagguuucgaaaugcuuuuguccuuucuuuuugucuguuaacaaaaggguuuccccguguacccgcagagccugucuaguggccaugcgucccccuuacagauuaagcgugcacgucugccagucuuucuuagucugucgugcagcugguuuaaucuguuccguguagugccuggcggcuuacagcucucccccuccccauucuaauugacugggagcaagcaugagggaugcaugaacauggcugcagcuuuuccugccugagcuugcuuuguuccuuuuuaaaugacuauaccaggaggauuucgcaguuguacagaaacugauauuucuucaacgaucuuuaucaauucuacacucacacccccggccggcucagaaaggcaguaugaugcuaccuuacuggcacugcuugucgugggauccuacagccuuuguauaauuccuuuguuagccacgcuuacuaggaaaaaaaguaggucgacgguuucucaucugauucuuugcuuuguaagcaugcuuaaauuuuuauuaaauaaauugauuuuuuaggcccgcuugguuauuagcuuuguuguugcuugcaauuuauguugacugugguguuucgugauuguauuuauauauauuuaagaugugaauggaucuguugggaacaaauuuuauuguguguuuucugggguugggugcuuaaaccaauuauaauucagcuuaucaauguucuugguaugauguuauccuauuaccaaagaccauuugaugauuuaauuucugauuaaaaggcuguuugaugauuuaauuucugacuaaauacuaaguuuugagugugugacuggcagauguagaaaaauauuuccuuaggauuuaaaugaaagggucagauuuuuuuuuuguugucuucaguuauaauuaauauacaauucacauaauaguguuaaauguguaugcguuuuuuuuuaaacugccuuaagauauaaaaaaaaucauuuugaaccaaaaucaucuugcugcuguuauggaggggucacuuaaucuuuagcuggcauaucaugacugacagcuccaacacuggagccucugugaggggccacacuugccuccuuugcuuccuuuugcuuugugauguuguauuguuaguggugucuguuaagaaauccacugcacagugcuguugggaaauuggcaccugguccuugguacuuggggauccuuagaaacaauguuuucgaguuauaaguugguugaaaggaggcguauaaggcaauuuuucuuauaucugaggguuucucagguuuuauuuuuuuuuuaaugaguacauaggaaaaauuaguaugaagauauccguguaaagauugugcagugguuuuucuauaccaaaugagagagaucauugugcaauuuggaagcaggucuugagaaaguaguuuugccacauuagcaggacuauggagaccagagauuuccuuccccuuucccuuuggccacaaaagcauguuuauuuuugaggacagacagaugguguggggcaauggcagagaugccaaccaaagcuguuugcuugcacuccauccgcaauaggagauccaaaagauuaauaaagaaaugggccauccucuccugcacuuggguggcagccuggcugacaggaagugacaggaaaggguacuacucaccuggggcuuguucugguuucuauuaauccacggcaaaucuuaaaccugaugaacgggaagggagaccuggaccacggucagcauccuuccagccguaugcaccugacuccuuuucuucaccgcaguaccauggugccgcccugucucuuggaaggaaagcgcuucgguuugcccaacuaagugggcagaaaggaugagucuuccugacacucaguuuuguuucucuuguggcaaaagugguuagugaguauggucauaucugucaacacugggcagucgauaagaaccaauugacucuuuuggcugccuccagguucagagaaaaaggguauuugauuagugaugucugucacaggugaauagagagaggugggcagcggauagugcugucuccaucuucugaggcauguuagagugcauaccgucugaagggauuacuucaugaggaaauauucagauaacucuuagucuugccuguucucuuuuaguaucucuauguggggcauaugagacauucuugugauuuuuuuugcuuuugaacuuuagaugucagugauuugucuuaaagccagguaggcagacgaucggcgcagagcagagcguuaagcugauguacaaagaguuucagaaaucggaguuuuuauuucugugcagauacagggaguuuaauaaaaacaaaaacucauuuaacuagaugccagaauguauuaagacaugcuagcucacaagccaacguugagaccgaagagagaaacucuuuagagugggcaaauuccuucuucugccuagaauuuucugaaacguucaacgcauucucucuccacguccugucuucuccgcuucuuauuccacuugcaacauucccuggucuggggauaugaaaauagggauuuuagaaaaacccauuguagcauaaccaagagaccauuguaauaggcagcucugagugaggcaacaguuggaaaucgacaggauucugggccaaccacaaugcuaggagcugaguaggaaggaaggagaaacgcuucgagggccuccugccucauuguaguagucaguuuucuucuucuucuuuuuuuauuagauauuuucuuuauuuacauuucaaaugcuaucacaaaaguucccuauacucucccccugcccugcuccccuacccacucacucccacuucuuggcccuggcguagucagucuucaaguuggaacuuagugaaaagcagugugccagccaagaggaaugugcuuagaaaacggagagaaugcuuauguguuaggucauaaaaguguguucagcuuauuacagcugguaaaguugggugaucauacaauggauaaucauggaguaugaauauuuaacacauauuucauauaaauauguaauuaugucuaagaauguaaauauauacauauauauguguguauacacacacauacauauguaucugagcccagugucuuuuauccuugagauauggauauugacucugguguguucagaaguugauggaaucuggugcuagaucuguugccauagugagcccucgagagaaccacucagguagauuucuuccaagucagugucuccugugguaugaggccaguagcugggggccuccuucgugucagugaggaauucgaucacuaaguucuuugugagcgagaacccugugugaguaagguucagaaagugaagcaugcauccagacuucggggcaaucuuauguccuguucauaaacugagcuggguuuaauuuuucaaaguuagaacaauugacuuaccucgcugcugaguauaaccaaaguugcucuaagaagagcaagucuaaaauccaacuguaauaacaaaaggaacucccuuggauuggauucaagucuguuaagcaccuacugcaauccaaugcccacaucucaugaguaucuuaaaauacacacucugaaagguugacaccguugucccauguguccuuuagaaugugaugucgaauauuagaccaucaugucagcuaacgugcugccaaguuuggaaagcccuguucccuuaguucuaagcaaggugagaaucagaaaugaggacaggaacuggguagaagcuugcuagcaggaggguggauuuguguugaucuaauauuaggaaaauuguccagguauaaggggaguuaacagauggcucagugcacagaugcugggugagggccaggaaagccugugugugugugugugugugugugugugugugugugugugugugugugcaguguugguggggaugaggucauuuagccuagugaaaaacaucuauguucacguugauaauuugugaacaagaggcauguaugaaguugguaauuuauacucuugcuucacagugcauagacuaaaaucaaagcaauacagggaugcuaacauggcuccugaaccagagugacacauaauucauucauguggggcauucuguaccagaaagaaauuaugauuuauuuauuauaugguagauuaaaaguggauaccuagaauuauguguuggcaggaucuuagagaaaauaggucagguucuuuagugucuuuaggaaacuuuguguuuucuuauaggugguuuucauugcuuaggugagacucuuucuguguuuuuucaguuugagguugaguaccuguauaacacaguggaugcugacagucuagcucugaaauaccagaucuuacucuugaagccacugaggauuuucucugauuauucuucucuucucuucucuucucuucucuucucuucucuucucuucucuucucuucucuucucuucucuucucuucucuucucuucucuucucuucucuucucuucucuucucuucucuucauuagcauuggcugcuuacagucuguauugucuuccgugagagaaaugcuuaccuguguauguacuaggaauguuuauuaggcagcauggguggccauuuaucuuccaccucucugggauaaaaugccaagcuggaaaugugcauaaauugcccaggaacaaaauguauuauuuuguuuguguuugcuuuugcauucugggaacauuuauuuuucauacuugaggccaguaacugccucugcauucuuggcacuugguaauuguuaucaaauuguagucucuuuggaacaaauauuaggggcugcuauuguauuucuguacuaaauaagauguucuuuuccauuuuguuauagguggucaugcugccaucaacaaauaugaagagaaaccucccaaacaagcauuucagaaugggucaggacccuuguaucugaagccuuugguacccagagcucacucgcacuugcucaaaacuucuccaaaagguauugucuuuguugugauuagaaggaauacuuuuaaacucauuggcuuucaggagguuaaauuuugacaacuaggcuuaugguacauuuaacaauuauauauuuaaacacugggugugaguaagaaaauaaaauaaauguuaacaaugagauguucucauuccccaagaauuccaaauucuauagacagauggagcccaauaguaaaaaucaacauguagagaggcuagagaggugacucagcgguuaagaacacugacuggucucgcaaaggacccagguucaauuuugagcacccauauaguggcuaacaaccaccuguaauuccaguucuggggagucugaugcucuuucuguugggcugcacagguacccccccacccccccacacacacacgcaaaacacccaucucauaaaauaagaaauaaaucucagaaaauagcugguagagcagagauguccggagacacuaacaagaagaacugguguucagguugcugggauuugaacucggaaccucugggagagcaaucagugcucuuaacccccgagccgauucuccagcccacuuuuuucuuucuacuggguuaaaggagaaaagcaaaaauacaggguggaucgaauccuguugggggaaaauuauuuacugugccauuagggucuuauuugucuuacacacagcucugaagcaucagauuauccccugcuaagauggcgguaauaucugaaacugagguuuuuaaucaugauuuuuaaaaccccauacuacccccacaguaacuaaaaauaaacccccguucauggagcuuugaucuugaggugauuuucagagaacuagagacccccaccaaugacugcaaaacaggacaugccgaacuccugaaagcccuaagguugacauaugcaucuuguggaggucucuuuaugauggcuacauacuuguaaagggagaugaucuucuuccuaaaguccugcagauggucucuggcuguuccaaccagccgccuucuucuucuccuucuucuucucccucuucuucuucuucuucuuuuuuuuuuuaauauuuuacuuauuuauuuauuauauguaaguacacugucuucagacacuccagaagagggcaucagauuucguuacggaugguugugagccaccaugugguugcugggauuugaacucaggaccuuugaaagagcagucggcgcucuuaaccacugagccaccucaccaguccuccaaccagucuucuacagaugguuagucacuugaugaguauuggaugucgagcacgggugcuuauagcucuuccaaugucuaccuguaugguuccuggcugcauuuuauauugcaucagcuuggagaaacaucucuaguguauucuccuucacagccuugggagggcacacaccagcaucccucuuucacaaaguguagccuguuuccugugugcagaagaagagugaaagcacaagcuaagagaugggccuccuuuuggcuggaguauaguucaaugguggaguuuucuccccaaucugugggcccuggauucagacacuagaauaaacaauaaauaaauuaauuaaaauuuaaaaugagcuuuaauugcccucgacuacaaaauauaccacgcuuugucuuuuuaaaauugaugcuguguuuugaugauuaauucuuaccagucuuacuacgaauuagauacuauauugucuauauuugaaaaaguguacuugaucaaguuguuuauauguuggaauuuucucaguggauagcuguaaccuaaaauuuagagguuaaaggagggcuuuuagaaaaugaaaucacugcuauuuacaagauaacuagagauuugccuagcauuuccaauaaaguguguguuuauauuucugucccauucuagguccuucaaggaagagucuguuuacagcuuuuaauucagguaaguggccacuuuaugaauauauuaaaauauuuuuauuugaaaaguaaugauuaaacauacugaaauuuauuuguaauuacuuuugcugguauaguucuaagucgaaauucaggauuuaagguguaacuagcugcuaugacaugggcauuugggcagcaugauuuguugagccaucuaacacagaggaugacaucuuguuauacagaucaaauuaacuuaaacugauuuuuaaaauaugguucaugugaaauaaaacuggauacuucuccaaauguguuauuuuaaaucagaucaucuuuaauuguaaaauggucuuaagguauaacuuuuaacuucuuguacuaacucaacaguuaguucuauguuucugacuucccccauacacauucuuggucggacauuucuaagacagccuauaacuuaaagccauucaacuacacugucuaauacuuccuuugggggaucuaaagaucuuguaaaauguauucauugacguuucucuguaugacacgcaggacuguaugcagccagccaugcacugccuacagguucucauuuuuuauuacagugcuaguauaagucacauggcucccauugcacaucacagcagaaagccagaaaaaagaaaggccacguuacagcguguaaagucucuguuauacaggaucucacauugucagcacagaauucaaccaugagcuguggguuccuacccggcuguacgcaugucaguuaguuucacaacucaaggugggccuggaauuaguuugagccuacugaggaaaacuuccccuguguggcuuuugaagcaacccugcuuggaacuauugacauuccuuuuuguuacaugccguggagugaucagcuuuaaugggucacccaguguaagugugauagcauugagccucuuggcuauucgaguugguucucugucacauucacagugauugcauuaugaguuguuuugcaaucauuucugucaacguuugcgaaguuuucuugugacggcuacuucagaguggagcgcacaugcguuguauaguugcuuggauaaucauauuauuuucaaaaagcuucauacuaguuucugauaugauccacaauauagaagcacuggccauaugcuggccaaucgcugauugauugauugauugauugauugauugauugauuuuuaagauauuuuauguauuuuauuuaauguuguaaagacuauuuuuuuuaauguguguuuugccugaaugucugccaguguaccacaugcauucaguacccuggaaggccaaagaacagugucacauccccuggaucugaaguuaguugugagcucccauguagguucugggaacugaacccuguuccccaguaaugcguuuaaucugugagccaucucuccagccccugauugagggguuuuuuuuuuuuuucgggagugggugaggggggaguguaugaaauaauauuugaaaauuuccaucauuauuuuaguuuaacaguuauuguaaagaaauucuguuaccuccgaagacaaugaagaagcugugaccuugugcggcucggacguugguguaaaucuugauucuccuccucucuauuuccguccugaccucuggcuacuugcuaagccucuccagggcuugaguuucucgucuggcugcacgggaauguucaggagauaaaucccagugugggaauggguuugaccguguagacuauuuucaucccuagcucucacaugguagcugccccugcugcuacugcuaucgaggcuaacaguacuucuuguugaucgcuuuucauggcuuuacauugaaggcgccuccccaaucccacccugauguguucuaggaaacccucaaagcaaguggggaaacccacugaggcuaugaaccaccuuccagaggucuagccggugugguuuauuuaaaggguauuacacuauggaauucuaggcaacacuggcucuaaauaaaacgugccugcuguuuaugaggaaguugucauacccacagcauuuaccguggcuccgacacucauaguugcucuuggggauaucucaggcaucccaaguuguguuuacccaguccguggacuccuuuauagaucaucccugccaggugccauggugucugcccugggagcaggaacacaccugcuccaucugugccauuucauaaacauggccuggggucguguggcuuucuacaucuccuuucuccaaugucgggaggugguugagagcugcagaccuacucuggggaggagaugagaugccgccacacugugcaccugcugucuuuccuucuuaugcauuggugaucucaacuuugcucucguguugaaagggccgauaccaucuggauacauggaaaauuugguacugagcguuacgaagaauggaucacuuggugaaucccacugcaacaguggcuaccuuuuuggcugagaacuagaucucuucacccagggcacaugaauguguucuacauagaaaaguuguaaguguagaaaugaaaaaaaagcaccaugaauauagaccugaguauagaaggccuuccaguaacaugcauauaacaauagagauuaauaauugugacagcacaugguuugagcuuccuuuuguuaaaucaugacaaacaguaguaagaacaaagccagacaauguuacuacauuugcucuguguagcacucucgaaaacuagcaagacagaaccagccucagaguagaugcuaaaagggccuauugucuugagucaccucugucaacauccuuauugcauuuuuuuuaacugagaaagagaagucacuaugugaaauucauggggaaccaaauaagaguccaagguagccaaaaacaaucuugugggcggaaaaacaaaggcgaugguaccauaauucuugcuuucaagucuguaauuaaaacagucugaaauggguaugaagguagauacauagaccagugcaaugaaugggacagcccagaaacaaaccuguggacuuacaguccgcugaaccuggcaagacugacgaaaauaccaagcagaaccguccucucuccaagagauagcgugaggagaauuagaugucugugggugcagcgaacuccagccuucaucucaccucauacacaguaaacaacucaaaaugaauuaaaauaagacucgaagcccaaaaaccucaggaggagaggcagaaggggagcguuucauggcuuugucguuguccgugauuucuuagauugauacagaagccuguggcaagcaaaauuggacaugugggacuccccaacucuucugcuuagccagggugaccgucgguagcaugguagguggccuacgagaugaagggacugucuagaagccauaucccaaugagggcugacuuaccaaagaggagucaggguguggaaggagcuuugaucugccagguaugcagcauucucaccauaacugauguaagaauagcuuacauaucuguagguaaagaaaaugugauguaucuaugcaauggaauauuagucacaguacgauacaaacaaaguaaauggggccaaggagauggcugggugguaaagguacuugcugugaaaccauaggacaagguacuucggguuaucuguaaucugcuguugggggauggaaauugggaggggagacgcagagucucugcagacucggggccaagguacccugguggacgcagccaaaagggugacagacuaucccaaacaauagaugucaaaagucugauaacugauggucguccccuagccucuccacgcacaguguggcacauguggcacucacaggcacgaucgcacggacauaacaagcacagaagggagaaaggagucuugcugacuccgauuacuuuugguaaucuaaagcugugagacucguagcagcguaauauguaauggcuucucggcacuggugcugcuggccaggaaaugggaagcugcuguugagagauugcaguuuugaaagaucaggacguuguuacaacacguacaguuacggcauaguuaacaguaaguagcauaggcuuaaauuuuguugaggguagauauuguguucuugcuauaaugaacagagaugacacacacaacaaacaacaacaacaacaacaacacaaaaccaaaagacucaacacuaccaaaagccaacuaaagucuauuccuuuugaacggcuccuccuuauguaaccaaccaaacuuugcuucacugguuuucuguggucuuugccuuaugcugauccuuaggacguuacaaaguaacagcagacaccuuuccucuuuguugcacucaugccagguggccaccagggggcagaugaugcuugggaaagaacugaagcugagccguuugaagcuuguaccuaagcacaguuuguugguugggaggaguuuuuuguuguuguuguuguuuuuuuguuuuuuuguuuuuuuguuuuguuuuucaaacaggagcuacauuugguuuuccuuuacacugguauuauuugcauuauuucagcuucuuucugcacuuagggaaaacggcuaauauuuaaugugcaugggauagguaaugauaguggaguucaaauaaacuuuucuuaucuuaaauuuauuuauuuuuuuaauuguaaauuuauuuuauucuauguguguggguguuuugcuuacaugcaugucuguuuaucacaugcgugcaugaaagggugggacuggagaugauuguaagcugucaaguaggugcugggaacugaacacggguccucuggaagucuagcuguuaccugccaagccuucucuuaagcccguuaaaaugaaauuuuuaguaaacguaccugauuggugacuggauugguuauuucuuccuuuggguaguguaagcuaguggauuucuuugugacagaauaguuuacuguuaacaaaaacaaccccaaccccugaaaaaagagcccacccagaaaccaaaaucggacuauguggacaguggugugucuauuugugacaccaaucuuauuucucauucaguuuauaauuuugagucucacugauaccuuuuuaaccguaauuuugauagcauagggagagcuugugguuuuuuguuuuuaauauucagaauuuggggacagguguuuuuaacaguuuuaaaaauaacaaccugugaucuaacagaggaaaucaaagcuggaacgucuguuucuuugacucuuaauucaguggugugacccucugacggggaucgccaaagaccaugggaaaauguuaagauucauaacaguagcaaaauuacaguuaucaaguagcaaugaaaacaguuuuaugguuuggggggcccagcaugaggaacuguaucaagcuauaguaauuccauuguuguugcugguucuguuagcagggagguguucauucaggagguugguugggugugggugugcucgcucagccccacagugacccucuguggguugccauccucugacaggacaaggcauggggugugagcaagggggugaguugcuucaguucuccucuucuccuguccccucggauucucggaugcugugugggauuucugaauggguuuuuaacaucuagugagcuguuaauggaguaagguuuguugccuugugauauuguuuaccgagucucagaagcagcagaccugguacagggcuaacuuuucguuuuuaguguggcucucaauacaugagaauuagaguugacaauuugacaaccugucauuagcacaguaaaaaaaaaaaaaugcuguuuauuuuaaagauuggaaguauuuguugcuugaggguuucgcucuguuggcguguuuuucauccaaguaaugagguuuauguauaucuagguaaagcaccugggaaagugcccagggauaauagugugacccugugcaguuaaaaagcaauggaaucgguucaccgauugcucuaaugaagucuuauuucuuucuuucuuuauuuagccuagcuaauaaauagacauuaggcaugugaggugguuuauuucauuucgccccguuccaaauagugacaggaccugcgacaucauuggcuguuacauaaagcucccgagaccacccacuuucuccuccccuuuccaucccagucgggaaccacaacaacccgcggcaugcacagugugauguaauucaggcugcuugcuuccugagcugcuccucacagaucuugcucagacgaagggcauuguuuguuagcaacaucuggaagagcaaacggaagccuggagcucugggauagcuaacucuagcuacccccccccccacgcaccccccaaucuggguggccuggcauuagcauguaagcuuguuuuucucuggcuguaucucuuggccuggaagaaccccgaguugccaagagacacaguaugugauggucccuggaaaagcugcuuccccugcgaaguucucccacuggcuucgaagacaugcuguugucucccaaauucuccuuauccaccauccacguccgccuaaccgccaaaggacugcuucgaaaccuccggcuuccuucggggcucaggaaaaacacugucauuuuccacacagguugguccugcacaggucugcucagcaccgcgcgcggggaggggaggucggagauaugcugaugaacuugcucaugcuucucagguuucuauggagacauaauugggcacuaaagcccucuuuaaggagaggcuugacugguuacaaggagcgguaaucuccuguguugggcaggaggguacuuuaguugugugccggcagcuguaggcuugucuguguuuaccgaugcaggaugguugccuuggaacuuucuggcgcucuccucugccaccaaaucuguaaaaaaaaaaaccaaacaaaaacugaacaccuguuaauucacaccuaucuucaacugauuuuuggaaauaggcuaugagcacauugagacaggauuucucuuugcacugagaaaggagccgguuguuucugugguuuuguuuuacaguuuuucagauucucacuagaauggauagggaauaggaaaagagccccacauuacaaacaucccuaaaaucaccccaaugcuuguggagggccgguaaguggaccacacacuuaguuuucuaagucuuccuagcgcaaacacuuguggucauagacuauugcugcugauguuugugugcgacgcugcugcugcugccaccuuucauucugugcccaacgugagacauuccuggugugucugucccuucggcaucuguaagccugccugcucaagcucaggugcuacggauugcaaugguggugaguuaggucgaucucacugugugauggccuaagucuccuuaugcuugauuggggcugcuguguguugccuucaacaggcuugcuucguggucaugcgugauuuuucugugucacgcauguguuuccugugcaccucuuguuuuucaguuggcucuucacugucccugcugauuuuuuuuuuuuaauucagcugacagcuuuucauuuucccagaggcaucugccuucccugcaggauaaccuggauauauauauauauauauauauauauauauauauauauauauauauauauauuuuuuuuuuuuucuccccagcuucccuuccucauuucauaacucgccuuggccuggcauuugcguuggcuggccuuuccuucuagcucucauggcugaagguaaaugaacagagcuggggcuaugcccaauccaaaugccacugugauucccuucaguccuaaaauaaaaguugagggccaaugggggagcucaguggaugcugaggccuuggcuuuaauugcccguacccucaaaauaaaaauauauuacaaauauauaaaaagguaaaaaaagugugcucuauuauuauuacuauucuuauuaauuuuuuucauacaauuuucacccuauuauuucucagccuccccaguucaucccaccucccuauguauacaagcaagagugcuuuauguuaauaauuuccacguuccaaaauacaagcaacucucaauauuaauuuuuaaaacuaacgcagggccugcucuaagguagaagacaggugacauuucugaagaauagauuuucauaauaaagucagaaaaaaagaaggucugagggcacugugucauccaaaaguggcucuuucugccccggacccugcccucucucacuguuguggagucuugguuaccuuuccgaugguagguuagccagacgcaaaccuacggaagucuuugauagccucacacugacuugggagguugguaucuguuuuaguugcuggccuuuguaagguuaaugcaucuuugaguuucaugguucccuacuuccuccuccucuggguggaggaggugcugggggaggaacugggucugcugcauguuuggcuggugcucuacacacccagccuuuauuccagucgucuuaacagugcgaaccauugcugagucaacagugguuucguuguuccacuggcugauggcuuaacauuugauugucuguaguauuuuugugaagcagguaguuugagcaaaagaccuaaggcuuuaaagaccagaguuuaucuaauagugguguuuucaucacauauuauuuucugaguuuauauaaguauucuaaaauccuuuugcugagagucauaauguuuagaccuagaacacacuuagcagugagcgugcaccguauuuuacaccgggaagucugcggccuggacacaugaacuaacuugcccaagagcacacaguaaguagagaugggaacacaaccugugaccucuguuuagauuuuuuaccuuaaagauuuuuuuuucuccagcugcgacugcugcucugacucucagcaccagaaacuaggggugaaggugaaacaaguuaaguuucucgaaagagucugaggcugaggaauggacucgcucaguuccugcaguguuucccacacaaacauaaagaucaggcuuccaucccuagcacccauauaaaaguuagguguagugggguggccugugcccccagggcuggggaggcuggugcaggaggauuccugggguuggcuggucagccaguggagccaaauuggugagcuuuaaccucagggagaaacccuguuuacaaaaauaagguggagagguaaugcaaaaggcuugugagggcgacaucuggccucuauaccacaaagcucacuagugcaugcaugcacacauaggcacauagggcagaacaaaguauuguaaaaacaauaauuggcauuuuuuaaaaagacuacuuaaagaauuuaauucuaauaauuuucauuaccccuaguaagacucuuuagaguucaucagcguccuaucauuuuaaggucagagacauuuucuaaaacuugguugaagaccucauugcgcuuggcuuuaucuaauuagccuugugagcacugacauguuuauaucccuagucaaggaaguuccguugguugccuuagugauggggcuccugaccuggauuccaagaguagcaggaaaagauggcguuggcucuaccaguaacuuggccuaugauugucuucgcuucccagggccauaaaacggcagccccauguucuguucuccagucucugggccucagaugccacgaaccuccccagcacugggcugcacuacugcacuuggaaauuaaucuuaacuaccucccucccaagucccauuaacccucuuggcuuauuucucuuuaugacaucauguucuuaucuggucaccaaauaugacuaauuuuauuauucauccucagugauccacgacaacugguuauaaaaacucgagaccccacccuuggaggugauccuuguuuucacucgaccgcccucccucagaaacuuagggugaagcuugcucuucuguggggugaggauggagcuugggaugggaccugggaccaccugcauccuaggcaggugccucaccauugagcugcuaucccacacuggcucccguuagugagacaguagcaaaagacuugacagugaccgguccaugcagcuaacgaggggugggagcuuucuggaaggcuuccuauuggcuuaaugccaccagcuuuuccucugacucuaaccugcuucucacaucacaagaucaauucguucaugucucauauaaguaucuguugggcacgugccauaugccagacucaaggcuuggugcugagaagauagccaggacuaagucccaccacggccuuccucaaacccauaauugggcaggaggcagcuaaccaugcuaggguguggccugggcccucaggcagcucuuggcaccuuuauccugguguuucaugagugccuuccauauaaagagaauagcgugaaaaccugagagaggugaggacagguggcuccuucaaaggaaaaaaagugcaauauuucugagcaaacagugagagcaaauaggugagagagggaggcugggaaaggagccguguucagagccugggacaagggcacaggccacuaugcauugugguacauuguuacugacaggugugucacugaaucaagaugucacuguuuuccguaagggcuggaagaaggaaggccguccuguagcgaucuuguguggcacauaggugaagacugucaggaggaucaggaagcaauccugaaagucugguaugaucucgcuaguugucucgaguuucugucaagaguuauuucuugacaagaguauuaagcuaagccaaguguauuuucaguuuuuuaucacggcacaccaggucggucccaguuuuaugauggcgcagagaggguaagggaaauacacuucugaguauaaguacuccuccccucucagucagcuuuccuucuaagcuggaaguaaacugauguguuuauaaaaagauuacgagaggggggaaauguucuauggugguguaguccggcgugggggaaaggggaugccucugugggcccauggugaagcaccccuuucccccgccccccagggaccagccacaggaagauauaguauagaauaggguuuauuaaggacauggggaguggacuuaagaggguaguagaggcagagaaagagagggagggaggaaggaagagagagagagagagaaaagagagaaguagaggcgggccaugagcaaguggagagagagggagaaagggacaagaggcaagagagcaagaaggggucaaacagccccuuuuauagugagucaggcauaccuggauauugccagguaacuguggggcggggcuuagacugaaugcuagcagaaauccauauuaauuauuccagguuguauaucuuaauccucaaauacucugacuggaguaaaagcaguuaauuacccuaaggauuuuggguuguuugggcugagcuagggagauuaaaagugauuguuguaccaguagcaguuuccuucccauugaaacacucccuccagcggggaagcucuuuaagacucaggaagucccugaaacugaccagauggcacuaggcuccccccaccccccagcaguuaggacuccucagacccucucagaaaagcagagcugccagaaagagagguugagcugccugcuggccaggcaaugagccucugguugccagcuuuuaucagcuuuuauuuggagugggcuuuugguaauguggcugucuuugagucauuucugcuccuguaaauagcuccuuucacccauacuccuguaaguaaccccaauaaaacucaucugugcacugaguuggacauuggugguggucucaauuugauccauuguuggugcccugucugggguaaguagaugcuuguucacgucuccccaggaauaaugccuuacaacauuuaggcaagucugagagugugguuguaguaguaugccugccuaaugugcaaagcccugaguuugaucccagaaucugagauagcuuagcaacggaaggaaguacuggagacccaagcaguauuagaacaacgugccugaagcaguagcauagagcuguuugugaaugugaauucaccgcacgugaaugaaaucuauucaauuacaguaaaauucaucaaacuacauucuuauauuuggagguuacuucggagacuccuuuuagaauugcucuaggccugaaaaccagacaguguaagaagugacacacuuccucccgaggcagaauugugcugucuguggcucugaagccaggaugggcggcucugcuuuuuccuuagcucccuuccuaugggugccggccucaggcugaaagcaaaggaaacaggguggggugggguggggguggggggcaaguccuuuaagcuccagucucagucacauggcuaagaucuuagaaagagagaggcugagaaacugagugucugauuucuguaguuucguaagugugucuguccuccaaagaggccgggcaguuaucccucagaggcugucacuggagauuuaggaaugacagcgagaguauuuucuaacaaauggagucuauaacagaccuugcgguuuugguuuuuguuuucuuuuuaaaucugaaauaagacaaauuaguuuuggugcugauuauaaauacuuguaauaauuccacuuguuuuaguuugcuuuucuguuagcguaauaaaacggaucaaaaccaaccuaggaaggcagugguuuguugacuuacaagucacaguccaucauggagggaagccuggcagaaguccggaggcaagaacugaugcagagaccauggagaaacaccgcugacuugccuacccucguaugcucagcuaccguucuugacaagggacggcacugcugacagugaacugggcuccuugcaucaauuagcaauuaagaaaaugcaccuaggccaaugugauggcaccaauuucuuaauuaaggggcccucuucccagguaucuccaguuugugccaaguugaccaaaacuaguuucaacuuuuaagcuaguuuauuacuggacaaaauguuaauaccugacuguaguuacuuaaaauacuuuuaacuuuccauuuuaaaaauaaugcauuaaggaaaguauuguguauuucagaucugucuuuuauuuaguauuuuauuaguagaacauuuaugguguuuauucuauucaugugcuauaaauguguuuuucucaaacaccaacauaauaggugucaaugaagccauuauagcuaguucccauaauauauacauguauauuauguguauauauguauacacaucaauuuauauguaaaaacagaguugguuguucguaaaauacauaaagggccagauugaaggauaaccgaaaaguaauauauaucuaccacacuuuacuguccuaauguauauuuacaaccuuuuugcuuccuugaggaagccaccuugaagaccucacuggccucugaccccagugacagugguuacauaucaagagcaucagagaaucacuauaauuaaacacauauuauuuccagguguugugguacaugccuuuaauccuggcaccccgcagacagaggcagguaggaaauuuaagguuaccuugucuguauaccaagggccagaauacccagagaaacggacaaaacaccccaacaauauguauugugacacuuuagguuagcuuuaaagaugucuuagggcuagcaguguguacagagcuaagcauagugucaggcaugugugaucuuaacacuugagaggcuggggcaguauggagagagagaaaggucggcuguacuguaccaagaccuucucucucucccaacccaaauaagaagaguguaugcacauugcuugcgaucuuggguaaaaagacaguaguugggguuucugaugcccuuuucugcauucccauuaucccuacuuucauuuauuucagaaguacuuuuuucuuugauuuuuguugcucuggggaaaaguagggcuuaaaaauguuuuugggacuauauuaauuacuuuuuuauugcugugauaaaauaccacgaccaaggcaaacuuuauuuugaaaguuugucuccuuuauucauugcuuuacaaauuccacggcucugaauucgguuugucccaugacagaugagaaaaugcugauuuuuaaaacuauaagacuucauacuacaauguuagccauccuaagucuuaagucuaugaaaauguaggaacaucaaacguuuugaaauucaaaaucuauuuuuuaauuaauuuaauuuuuuuuaacuuauucacuuuacauauuucuugcuguucccucccggucacccccucccagucaccuccucccacaacccuuccucacccuggcacuucaagucucugugagucuaggcacuuccucucccauugaggccagacaaggcagcccagcuaggagaacauacccaaggacaggcagcagcuuugacggaggcaacuuuuaaagaaaggguuuccuugggauuauggcugcagaagauuggagucuacagugacugggcauugaccugggggcagguggcugaagaacagcuaagaguucacgucuuguuccacaaguggcaagcagagagugcuaacugcaagucuuuugaaacuucagugcccacccccugcuaauacaccuacucacucuccccacccagccaccaacuggggacggaguauggaaagccaagauugauggugacuaucucauugaaaccagcauagaguugagagauuugcccuuucccccgugucucuccccuuuaaccugguucuagaagccucccacaucaagggcuaguauucugagaauggcauucucuuuuacuuuauuguuuacaaaaauacgaaguccuaacgucgaagucuuuaccuggcuaucugaaguuugguuucuuuuacaauauaaucuucugugcuucaucaucauaaugagguuuguuggguuugggggaggggacgguuguuuuguuuuggcuuggguuuugaacaacuuuugauacauuuuggagagccugcuaccucucaguguguuaugucugcaagugucuacacucagaaguauccuuuuaugauaaauaauggcaacauaauccuagcacuggagguaccaucugaggcuacacagcgcccacccgcgggguauggccuuagagguggaagugacauuugagcuggcuuagcuuaggaugcaaaaaaucacaggagacaugcuauuuaccagcuuuaauuacuuuggaggaguaacuacaagaagaccccggcaagcugcuaugccuugcuugggagaucaguuccuaguggugacaggacauugagguacuauuuccuuccauguguuuaauuagaaaggacacauuguuagugcauguugucauuggcaaaaauuaaaaagacacuccuggcauaagcagacuuuguuauugaguaguguuuuaagucucuaguaaaauuggcaaguugaaaggauuaagauaaaaacaaaccaaaaggcccauaaaaaacuacaguuaagguagcgauggcaucguggggcgugcuuuaauccuggcaguggggaugcugaagcagacguaugucugugaguucaagcccagccugguauucuuagcagauucuaggacaguuagaaguuauguacagagauacugucucaaaaccaucaccaccaccaauaccaacaaacaagauugagauauaccucagccaguugacagaacuagaauguguguguccagacuccugcguguugcaggcaaucuuuaggcucuauagcaccuugagaaaguuacaaggcaggugacuauucugaagagcaggugaguuuaggaugggcuauucuuggagacucugggagcagagugagagaagguucuaacgccuuccucacaagccauuccuaacuccugacuccugcccuugcccucauuucgccugucauucugaucgcucccagcuggaauccugcacugcaccagggccucuuaaucuaacuggcuaugugggccuccuguuccauccuguucuucuccugccuguucucacagucuugggccccaacuuuggugcccucaggccucccucccgaccucucugccucgauuuugccccuucagaucuuccuucccuuccccgggccccgcucaucguuguuuuguuuccuacaagauaaaaucuugcacagugcacauguccuugcuccuguuuauauuccuaucagcuuuauuuuacuuugggauugaggggccuuugagucucugccauuguguuuucuggcucugucuucaguuccuggcuaccuccuuaauguuucugucugccacaugggcaaauuccgucaagacucuaccuagaacauucucugccugcaccccaccccacuguguacaugacuccaguaucugauuacaauaccauuucacauucccaagcauggugacauaccucugucugcugcgcaaguuucuucuauaaaaaaacaaaacaaaacaaaacaggaccaguuuauuaggaugcauuguguagacagcuacagaacaagccgcagccauuuugauaaccguggcauaucugggugcucauuuauauuagaaaacgaucccguugacucucauguuaauacuuuagcuuucuggaguguugcaccacaaacauucccaucauucaaugcaaaggagaugccgacugcaaaagcaaguacaaggugcuccuguuagcacuugcagaugugggguugauaauagugcaggagacgggacucguccaucugucuaggcugguggagguucagguucucuuucuguaucacagagcaaugcuauccucggagacggccugcugggcccccagugucucucucuuuggcuuccccuguuaugguagauuguaucauaucaaaguuggacaugacccaacaggagaaagagagucacaagagcaggcacaagagucagagauccacucguucuuacagucaggaauucuauggaaauacuaagcuaacagcuaugaucuaaaugcugagggucuaguguagacucaucuaggccccacacuaguugcuucagucucugugaacuccuguguaccuuacuuacuugguugauucagacugccuuguucuccuagugucuuccaucccuucugacuccucuucccaaagguucccugagcugugagggaagggauuugaggcagaaaucccauguagauuaucucucuacauaauguccgacugugggucucugcaucuguuuccuccuccaggggaggcuucuccaaugaugaguggauaaagaacugaucuaugaauauagaagaauaucauuaggaguaauuuuaucgauacuuaaaaaaaaaaagaccagucauucauauuugauuuuaccguaggucucugggucuuugguucuuagguucuuagguucuuaguuccuuuccuugaguaagcgucaagucaaaucagauauugguugguuccucccaaaaguucugugccaccauugcccuagcaaaguuugugggcagaauggaugguaagccaaagguuguuaucuauguuuaucuuucuguagucugcagggcaccuuucugccccaaaagacgcuagcauguagggucaaagcaucugugugagcacuagcuuuacauccccauguucagugacuuguguggguguuguccucgguaauggggccccacuguuggucuuuggagagcaaccauuuaucuuaccaauagccuguguuguuuuggaauuuccaugggacccucuucaacaacucaaaugaaugcagcucagucccaucacuggcaacugagagcucauuuucccuauuacaaggagccccaacuaagauucccuucaucaccccaggaaguuugcacugcacuagguucccaaaugucucgauuccaggccucucucucccuccacuccaucuccccacaacuugaucuccauuuuccuguccccaucagcccccaaucugccauaaaaaucgauuguuuucccccucccagggaaaucuauguacccucccagcccccacugggcucaugccucauaccuaaccugauucuacagauuguggcuugguguuaucaucuacuuaaugucuaauauccauuuauaagcaaguuuauaucauauuucucuuucucguuccagaugagcucuucuuucucugguucauuagccugcaaaucccaugauagcauuuuuuuucaauagcugaguaauucucuauugugauauguaccacauuugguuuauccauucuucuguugagugacaucuaggcuguuuccaguuuauggaucuauucacauguauuacauacauuauacaugcacacauccaguuagacuagcaccauuuguugacgaugcugucuuuuuuacaguguguauuucaggcuuuaccuaauaucaggagucgauauggguguuggaucaaugucuagaucuuaaguucaaucccauugaucaacgugucuguuuuucugccaguaccaugaagguuuuauuaccaaugcucuguaguauggcuugaaaucaggcauggugagaacgccaguucuuuuauuguucaguguuguuguaacuauuucuggguuuuuuguuuuuccauaugaagcggagaauuguccuuucaagaccuguuaagaaugguguuggaguuuugauggggauugcauugaauguguagauugcuuuugcuaagauagccauuuuuacugcuuuaauuauacugaucuaugaucaugggagaucuuuucaucuacuuauaucucuucagcuauuuucuuuaaagacuugaaguuuuuauuauaugugucuuucacuugguuuagagcuaacccaagguauuuuauacuauuugaggcuauugugaaagguguugguuuuccugacucuuuuuuucuaaguucacuugucauuuguauauaggaggguuucugguuguuuuuauuuuuuuguaugcagcuacuuugcugcaaguguguuucagcugagcucccugguggaauucuuggggccacuuauguauacuaucauaucaucuacaaaaacaaaacaaaacaaaacaaaacaaaacaaaacaaaacaaaauacuuugacuucuuccuuuccaaucuguauccucuugaucuccuucaguugucuuauagcucuagcuaaaacuucagguaauauauugaauagauacggacagagugaagaaccuuguccugucccugaugugguggaauugugagcagauauuuuuaguuaaagcuuucuggaggcccgcaccaagccugaggugacucagcagguaaaagcaccugccaccaagccugaagaccugggcucaauuccagaacccacaucuuguucaaaucugugcacaaacaguuuuguuuucugguuugugcuuuaaaauuacuaaagcuauaguacauauggaccagaaguggcaguggcaguuuguugauaauuuauuuuuuugauuuuuuaauccuuuacucuuauaguucaaaaaauuuaaacacaaucuuugugcaaauuuagauuacauuuuuguauuucuaugacauaccuuuagcauuuacauauagcuauuucuuuucuuaauaggaauuugaauuuggcaacugaauguauagugaugucuuaagaaaaauuaaucagugaauauugaacugauagauuuauauacuagauaagcaccaggcacagaugacaacacuaauauaaugcuuauauaacuagauauucaaaaaugcaaauacaagaaguacuuuccuaaauauauauauuggcaauucugagcuuaauugaguuaccauuguaaguacauuguuuuaucaaugccuucauguagcaaauacccuggcuagaagauaaauaaggcaagcaagaaauaguuuuaauaauucacaaaguucacaauauaauguuucucaacugagauaacuauucaggguuuuuuuaauuuuuuauuuuauuuagucuuuuuuuacaguccagauuuuaucccccuccugguucaccugacuguuccacauccaauaccuuccccucccuaccucccgcccccaucuccaugagaauguccccaccccaccagaccucuccacucccugggcccuccagucucuugaggguuagaugcaccuucucugacuaaguccagaucugguaguccucugcuguauguguguugggggucucguguaagcucauguaugcugccuaguuguugugcagugucugagagaucuugggguccagguuaguugagacugaugguccuccuacagggucgcccuccuccucagcuucuuccagcuuuacccuaauucaaccacaggggucagcagcuucuguccauugguuggguguacauaucugcaucugacucuuucagcugcuuauugggucuuccauagugaggucaugcuaggccccuuuuuguuagcccuuuuugugagccuuaguaauagugucaggacuuggggccuccccuugagcuggaucccaauuugggccuguugcuggaccucccaucccucacuugaugcccugacaaucccaucccucacuugaugcccugucuuucugccggaggugggcuuuacaaguucccucgccccacuguagggcucuccccauuuaaggucccaccuuuugaguuuaaugucucaaauuaaauggauucauugaagucagaucuuguucuguuaauacauuacauagauaugauaaaccaaaaaagguuuaucuuuuuaaaauacagccauauuacuaaaacaguaacuuccauagucugauaaacauguaagggcguggaaggagagauggccagagauugcuccauauuaugcuaaauuuguuguguaaacaguaaagcccgcagggcucaggggaaacccuuggcuuuucauguugcagaguaaccaacccaucuaugugagcuuugagcaucacuggagauuuucguauucucucugauccucaggaaugaggacagggaaagacgugugaacugggucaucggcugccuugcaggauugcucuccugagggaguacaguauguggagcgacgauugaggccaccgcgugcuuguccagccccaaacacagggcacagcgcaugcacaauggaaagcgugguacucucggaaaacaagucgcaguccuugucguuuccaccuuaguugucaguuuuguucaagcccuuaacagcaugugucuuuaaucucuugucuacauugcccugggaaagacucugaguagacuauacucucuugcuggccacguguugaguaaagauuuaagugcuuauagcagagaugcauuuuuaaaagagcaaaagacaugaaaaugacuugaaaugucuuaucauugugacuucuaguccuuagcccaaggagguuaaucacugcuaguaguuuuauaugcgguacuuucaugagguauuuauaaguccccaggaauauuagcgaguauuuucucuagaauguuaacauaaaagauuggccucagacuggagauguagcuuagugguggagggccgaguaugcauaaggccccagucugaucccggacauuguggggggggaagggggcgcaguugagagcuaccguuuaaacuaacagucaucuguuaguuucaaaagucugguaaguuugcuacauuuuguuucuaaguauguaacaauguaguauguaacaauuuacauugcuauucgguccaguuuccagagugugugaggauagcagacugucgguguucuggauuuuaaaugucuguccagaguuguuuacacucaccugaacuagccuuacccacccuacaaagguaccagaaggaucaggauaggggauagccuggguggcacgugccuguagucacagcugcucuggaagcuacagcagggaaccaaauuccugagcccaggaauuugaagcuagccugggcuacagagagaucaaagcucaaagaagagaggaaaaagaggaaauacucugaacuguaaaugcugacauuguucuuaucuauucuguggcaaauauaauuucuuaguacauuauaccggcuaauuuuaugucaacuugauaccggcuacacucaucugagacaagggagccucaacugagaaaaugccuccauaagaucaggcuguugggcauuuucauaauucauucuuaauuagugggagggcccggcccauugugggguaguaagcagcacucccccaggacacucaggcuucugcccaauuugaguuccuguccugacuucccucagugauaaacuguuagaucagcaucugaauggaaauaaacccuuuccucccuggguugcuuuggucaugguguuucaucacagcaauaguaacccuaaaaggccacuguuaaggaacggguacauggaaaauguagaucugcuguuaaauauuuauguuuuugucauuaauauagaaagugauucauaauuuauuuuucuggacuauuuuuauggcaauaucaagcuuaauauauagucuguaucuagagaaguggcgguuagugacaaacaacuugaaaaccccaucccguaaagaaugaggaauguuuuccuggucucuugaguacuguaagacaacgggaaucuuagucaguuuaaaagugaggcuuaucaaaucuuagggacuguuucaccacauaaaggagccacaggaaacgagggcgcuuuuaucugauacuuaaaauauuguuuugccaggugugguggcacacaccuuuaauuccagcacuugggaggcagaggcaggcagauuucugaguucuagaacagccuggucuauagagugaguuccaggacagccagggcuacacagagaaacccuguccugaaaaaccaaauauauauaguuuugaauguaacguauauuuaaauauuauuuuuaguguaagcaagagcaagaguaaccccagagcucuucaauccagaagucucuuuccuguuucccaagcauucuuggaugauaguuuguggauccuuuaaaaaugagaggaaaaccuugcugcuuaaaaaguucugucaaaaauacagaaguggaugcucacagcuauccauuggacagagcacaggguccccaaugaaggagcuagagaaaguacccaaggagcugaagugguuugcagcccccuaggaggaacaacaauaugaaccaaccaguaaccccagaguucccugggacuaaaucaccaaccaaagaaaauacauggugggacacguggcucuagcuacauauguagcagaggauggccuagucggucaucagugggaggagaggcccuugguccugugaaggcucuaugucccaguguaguggaaugccagggccaugaagcagaagugggaggguuggugagcaggggaaggggagagggauaggggguuuucagaagugaaaccaggaaaggggauaacauuugaaauguaaauaaagaaaauaucuaauaaaaaaaagaaaaguucugucaaauuugucagugcagaauguggauggacggcgccaugggggcugguugucacaauaaggaaacauuuauuuuacuuuuuuuuuuuuuuuuuuuuuuaguuucaugugccuuuuuuuuuccauauuuauauuuguuuugauugcugggccuguuuauuuccagacaccaagcaguaggcuuccuguuuuacccagagcaacuugacguuuggaaugcuuccaaaacugcaagaaagauuuucauuuaaaaccgguuguucccagaacacagcaugggaagugagcaaucucuccaaacguagaugaaucuggaauaguagcaugcauuugagaacauuuuuacacucuuuuuuuuuuuuuuuuuuuuacuacacggggaacgaaguuugcgcuuguugaaaaaugaggcaguguauccaggcgcacaggcacacgcugcuuuucccaguaaccucggaggagcaaagugcaggaucuccaguguauaugcugggucauuagauuucggugacaucugcagaguagacugugacaaugaccagaaagacagcggggaagacagcucugugggagguguuuguggaaaggguacagggggcagugagguaaaggaggaaggguuuccugggaaaaugggagggcuuuaggguggaggaggcagaccagcaagcaacugugaagaacuuacuaaaacuuaaacaaaucaucuaugaaauacuauaaugaagccuauuacuuagcaugcugacaaacaaacaaaaauaacacauguacucauuuauuugguggcagggucucagugcgccuccucaguuggccuacaaaaccucuguagaccaggcugucuuggaacucagagauccaccugccuccccacccccagcccccaagcaauuaaauuaaaagugugugucaccaugcccagucuaacaaauuuuuuaaaaaggagccuucgagaggaaagaaaagcauuucaaguccaauaaucagaauuuuccucagugcuuaucccaugauuucuuuuuucuuuucuuuucuuuuuuuuuuuaaaucucugcuuuuuaaucauacccuuucaucgucuguuugaagacacaaggggauuuaaaccgcauccuagauuuaagugcacuaccggcuagcuucagcauuucuccaaaaugggaaaccguuugaauagugugucuuaguucugccuacuguauaauuguacuuuguucagccugugucaugagugcagugccacucuuguuccuuuucgucaccugguauaauuuacugcgucacugugauagcagacucacauucguucucucucccccugcccccuuacauacacaugcgcguaugcacacacaaacggacucaaggacagaaaucgcgggacuaccccaacagacacaggaaaggacuuucagauuugucaacuuaacuggaagaguaaaaacuaugaaguggaguuggagggauggcucagcaggugaaagugcuugccaugcaagccuagugaccugcgcuugauccuggaacucauaguaaaaggaaaccagcucuaggaggugguccucugaccgccacaggaccgcaguagucuuugagaaccuguacucucaugcacauaacaucaugaacacagacaacaauggugaauuaaaaauaaaggccacgaagucacuauuuugccucuucccugccuccaguguuuuauguuucugaguugcuaaaucuguuuggcucaugugcauaacuccccauuaaaucuucacagugagaacuaaagccauuggcccuguugacgaguuccacccauccugauccccgaucuacuccagccugccaccauguguacgucccaacguaaaacaugguucagaugcucugguguggcggcaguaggcugguugugagccccauguggugguggugguuauaaaaauuaguuaaccucacgcgcaucuucuuugugcuuuucuuuccuuccucuugcaguugaaaagggcaggcagaagaaucccaggagccuaugcauccagacccagacagcuccagaugugcuguccuccgagagaacgcuugaguuggcccaauacaagacaaaaugugaaagccaaaguggauucauccugcaccucagacagcuucuuucccgugguaacaccaaguuugaagcgcugaccguugugauccagcaccuccugucugagguaaggacgucuaucaacccucacuggugggcggcggggaugcuuguccuacaaaugugcuuaacuuagugacugcaagagcuagaacucuauuucucugcuccccgucucucugcgccccaauuccugugugugugugugugugugugcgcacguguacucguguguuuacccaugugcguuuauggugaagacuagagaaaaaucucauuuauuuccagggagccaucuaccuucuucucgagacaggguuucucacuagcacgaaacucuacucguuggucucucuggcucgcaagcaaaucccagaaaucugccuguccccacacccccaauacuccagcccucaaaacugccuggcuuuuuuaaaacugaggguccuagagauuaaacugaggaauuuguguuuaugaccaagcuaaccccaugccaugccccaaacuauaauuuuaucacccacuuucuacuugugccagucucuagauggauuuggaguuacaauaacuuucuguuaucgucccucccuccuuuucuuugugugguggacaagccuguggacaagccuguguacaugcgggugcuggugcccaagcaugcagaggcuagagcaggaugcugguccucuaguguuaguuucugagacacgguuccucacugaaccuuuaacuggaaauuucagccaggcuggcugcuggccuagaggauucccaggacccaccugacuucaucuccgaaggcugugguuauggacacucacgaccaugcuuagcuuuagggcauuggagauuugaacucagguccccuugcuuugacagcaagaacuccuaacugcugagccaucuccugcaaauagguucuuuuuuuuuuuuaauuuuauuuuauuuuucuuuuuacacuccguauuccauucccugccccacacccccauccacccuccgacugcucuauaucccaugacuccucacccuccugucucccuguggauguucccacccuccaccccaccugaccucuaaacucccugggguuuccagucucuugaguguuagguucgucgucucugaaugaacgcagacucggaaguccucuacuauauguguauugggguccucaugucagcugguguuugguguccagugucugacaaauccggcuuaagugacacugcuuguucuccuauaggaucggccuucucugaaaauaugcucuuaugucccuuucccucccagucucuucacuggaaagaugguaguaaaaugauaauuggccuaugcuauuuuauagaacuccagauuuacaauaguaugaaagucucauuccacucguuuuuucuuuuuuuuggucuaaauuacauacacuuucccucaugguuaaugcuuuggaaucucccaucugacucucuuagucucucaaaggaccucuuuuagaaagaguauccuacagaauagauacauguaguguuaauaagagacuuuuuagcuggguguggccuuuaaucccagcacuugagaggcagaggcagguggauuucugaguucgaggccagccuggucuacagagugaguuccaggcagccagggcuacacagaaaaacccugucucaaccccccacccccccccaaaaaaagagagagagacuuuugggcccagaagaagugguuccuaaacccaauccauguaguucaucaggggcucuguggaggaacaaauagauguagcccugaauuaaaguggcccuggguuugguauacugaaugauacacaauauacaauauacccuuaaggaguuucaagagccuuuuuguaaagauccauguuuuuuuuuuuuuuuuuuugggguccauugcuuuugggugaggcagaacauccugacaggaagcaagugauggagauagugacucacgccaucauagacaagagaaagagagcaagagcaagagagagugagagagagagagagagagagagagagagagagagagagagaaacagcaagauaauaaaacagagagaaaccgaaagagacacagagagacagagagacagacagacaaagagagaaagaaaaagagaaaggaagaggccagacacaaacuguacccuuuaaaaccccacuuccaaucauguucuaccuccuaacagcccauucagcucugacaccuugagaaaacuaauccacugaugaaguuagcguacucaugauccaugucucucaacaggaccagcaugcuggggugucaagcuuucagugcccgaguguuucuuuccaauccacagcagaauggcuguguaacagugaccuuaacgaauaucaagcccaugggcccccuccuuaaggagaccccgggggcuucuagcucuaucuuuacccacccucuggacuccaggaucuuauacuuccuuucuauaugauaacuccucacucugugcuugcuucugcuuuuaaaagaaauagcauauuuuauuauuuuagguguuugucacguguaugucuuugcaccacuuacaugcggugcccacagaagccagaagagaggguacuggacuuucagacaguuguaagcuguccuuaguugcugagaauugaacuugaccccaggguucucuggaagagcaagccagugcucuuaaccacugacucauugcuccagccucuguuuuggcuccuuacgaugaaaguucauugauagcagagucugcuuccaguuccuucuuguaaaaccaccccaagaauugaaguugacaauucagacaguaccugaguggacgagcgaagggcgaggguggaacugcagaaacaucuuacaagagcacacagaauccccauguuggauguucuccaccccuucucuguuuuauaauccaucagugaauguucgcuaguugccuaguguguacaaggcacucacuguuaggaaacagcugaaagggaaaggguaaguugagcaauuaaaaauccccuuaacccuuuacagagaucucuuguacccacuguugaaacauuuggauccuauuaaccagcauugcuguuaguaacccuagaguccucaucaaagggucucuaggcauauuucuugguaagguaaaacaagaccagauagguuuuuuuuuuuuugcauauagaaucuaaccuaggcuaguaccucccccccccaaaggguuuuaaauuaugcuaauagucuacaucucagauuuaaagggguggggugggggugggagcaggcaggaugagggagugggugggaaggaaguguccacaaugauaaaaguaugaacucucugcagcucuuuccuguaauaguuccuguguugcugaugccauucaguagccugcagaagucaggcacacuggcgggacgacagccagccacuaagugcuugcaucccagagacccuaauuaaauuacggagaaucccguuguuguugaguuuuuuuuuuuuuuccuuaaagcgcuucauauauuuaaugcaugaguuugaaagcaucuucguguggauuuccaccuuucucucuagucucacuguguguguaugucuguggggcgagggugggguugcauguuauaguacaaagauaaucaaauaaaccucuucucuggauuauaaaugguuuaucaucuaugacagagacacuaaucuaagcagcuggaaaaaaaaaucggucucuaacugccagaauguauuuuaucaucuugaguaaauaagaaguacauuuaaagggcaggcaacccagacagucaugcagaaacuaauaguaugucuguuggagucugggcucuguggucugcauuuuugaguagaucauauuaaagccccggguuucccauaguccugcgcugcuucgccucagaugaugucaucugcuuugauugaugaccaaagaauugguccuggacauugcccuccuaaguaccaggcuccuugaaggcaggagcuaugucuuaauuuucuuacauaucauuaugguauaggauauaaaaugugcuuagcuauaugaguaauaacucauaauucagaaagauaaaugucccuucugggcauuuggggggaggggauguuggcuuuccagaaaguguauaaaaugagucagguuaagaaagcccgucaucccaagaggguagcauggauucugggaaggauagcuuuugacuuggauggaagaucucgggaugcuaaacaggagcuaggcaauucuaguccaugggagcgcacacaagcacacaggcuagcacccacucaugcuugcuacacguauguauguaugcuguauuugcuggaggaagaaauuccgccucauguaugggugcuaccugagcuccaccuucagucccagugucauuuguaacauacucaaaagagaagggaguuuauacacagaaaauauugaauaacagcccucuaggguauaaagaaaccccuucuaugcuugcguacugggcucuaaagaaccaggacuagaagcaaaggugacaccaagggcaaaaagccauugugaaggaagagugggcuggcuuucccccacccccacuuccggccauugagacacagugacaacugaccuugauguccucacgcuggaucuugcuggagaaggcugagugugguuuagggaagugaguuaggacagaugucaacacucacugaaaucuguugccuccugaaguccacuaauaagcuaaccaccccucccucggguguuucuggagggagggagguguggcuuuccagaguccuuuagagauaagcaucaguagcgucagcuuuugccaucuuccuuuccguuuucuugugcaagugguaagauuuccuuguccuuuuacccccuuuuguuugcaacuuggcugcugugggaaaggggacucugaagcguggucacaguuucaugucuaauagagcuguccccgcuuuucucucacgccacugacagacucugccauuuauccaaagcauuugaauaaaauuaaggcuugacgugacaguacucgaauagucaggcuguaguggcacgugccuguaaucccagaacuugggagacuggggcaaaggaaagcaaguaugagacccguaagaaggggagaaaagagaaaaacauuguaucuguggguuauuauuuuguuguucucaaacuuuaguuuuugcauuacaaaagcaaucguuuauuuuugaaauuuggaauuccugacuggugauuucaaauauauguaauccccaauacccauguauuaucaaugaacuauacucuauuguaauauuauuuaaaguucuaaaucacagcagggcccccugggugcccuucaccaugagguucaucaugccuuuaguauauggguucugaagagcaaacccccuuuuucuauuagugagugcgauaaucuaaugaccucaauuagagagcggaguaaaaaggcucacacaucuaaaaauaacuccauuauccacgcagagagggucccguuucuguuuccucugcccccgcugauauuaaguaagugccaaucgaucaggauaaugucuggcucucguuucucauaaaugaagggcuguggcuuuaaguaaucauccguugcuugugccagagacagaagcugcaguaucagcuucagagaggagagagaggagucugaggcaguaaccugcgggacaggcggggaggccaccagggccaauggcgcuccucccuguggagcuuugaauguaggcagacccggacggacggaugggugggaggcguggccaccugugcgcuucuuggacagugcagggggugggggaguuggagagaccggagcuggaaaaugggcugcccuagcagcaaaaugugccucucuccucccugugcagcaacaaggguaauuaguauuuguuuacagggcuuuucuagaagggugucagggacuacguacugcagacccugucuggaaccagggggaagugcuuugagugagaagcaagucuagacugcagagaccagucucgugcucucugccauacugcaacccagaugccggcuggagucccacaucuaaggucaucucaggaagugcccuuccugaaagccuggacauucucucacuuccuaguuucacccuggcgccagggacucuccgucuugaggaacugugucuaaugauuguguuuguauaaguauguguggaugugugccugcuacagaccugaagguaacgugaaaauuauuccuuaccgcaagacugauacuuguuauucuuuaaacccugaaacacccuccugauuucuuucacuucacuucucucaagccuauuuagaauuauaguugcuucaugauguaagaguccuuggaaacugcuguguagcugggugaaaucaacuugauuucaucuuuaagagauuaauuuuuuuauuuguccuagcuuaaaagcaaacuuuuuuuuccucuuguucagaauauaggcuuggccuuguaacaaaacuuuuuuauuugcggacaugggacaaagucuaucuaaaugccuauguuuagaacauuaaauauuuaucuugaacugauuaggcccuuauugcccuuggaggggagagugcauuacaucuuaaguacaguaugcauuagcuucaagggucuauggaucuccaguaagugcauggcgcaaagcaaauauuuuuaaauagccucucuuguuccucaaaggaaaguuucaacaggaccugggaaaauacagauuuucuuuuuugaaacaugaaauuccuucacagcaaagggacaucuggguuuugcuuuguuuuuaacaacacaaacuguuagcuuagugauucguaucucggccucucaacucugggucucauuuucccagcagugguaaguguguacuuuacugaaagggaacccucuuuaaacaaacaaacaaaacaaaacaaaaaacguuaguaacuugguguguguuuucugcagcgggaggaagcacugaagcaacacaaaacccucucucaagaacuugucagccuccggggagagcuagguaagagccuguuuuccugccccugccccugcccuggguaaaguuuacugaaccugagcaaugugcucuaaccuccugcucuguggcuggaguuacacagcggacagcuggucuuucucccucucucguaucugugcagacacuuacuaucgacacugcuuuugaaucuuggcagugugaccucaagcucacaaaauuccuggcacugcucugagugagcuaacacucacuuucugaugaccaaggcauaaagcauugcuucguauggaguagacagagacagaaugguuucuguauugugugcauucccauugaauaauuauguuugucugucugucugucuguuaucugucucucuuucucugucucucucucucucuguuucuuucuuuuucuuucuggaacgacuuuuuauauuaaagaguguuaagaaaaagcuauucucugauagaagugauuacguuacacauccccgcugugguacagcguaccugugaguguacagugagucuacaauuaaaggaauacugcuuguuagggccacccaugcucugugcuccuuaaguagucgggaugagcuggggaggagugucuaccaacucgaggagcggugugcucuguagcauucucuaggaagucuugcuguuugaucuuuugaguucuuggugccucugaggaucccuagauuugaaggacaaagacaguugcccuuucuaccuggauuaccuguaggagagaucggucugcugugccccccuccccuugcccugucuguggggaccacucacccuaagaauuggcuucccgauuuagcuucaacuagaucuggaguuguucagcaaaugucaccugccuuguccuuggcuuugcuugcugauaggcuguguuagaagcauguguagcauaaguucuucaaagggaacagcuaaagauagaauaaguuuuguucguuuaauucucaaagaauccuguuuuucucugagaaccagacuguaguuuaaauaccgccauucugauuugcuggacaagaauauuagucagcaacugcacuggcccagucaagacaaaggucaugggccaguucauguggaggcaagauugugcccuucccuacuccuuggccugccaguugaagucaaggccaauuccucgcuaacccuugagauccacaacaguagagaagccaccagugcuggcuggcaucagguaacagaaaggacgaacccuuguggaacaauaauuuuaagacagaugauaaaguacagaagcccagugaugggugagcucuuucgaaccgggacagaaggcacagcuugggugaccccgaucccagacaccaugaagaccuuccacuucuaauucagucuggcugccucccuuuugguuacccaaugaccagcucgaguuguuucugugccuuaaguacgguaauggauacagaauaaggagacaagggagaagguauuuuugugugaguuucaguguucaucggaacacaguggaaguggagaugagccugccuaaugauucagguuucuauucuccgagagaaggcaggaccaagacagaggaggacacugagcccauugacucugauugaauggugauccucuucagcauuaagcaguuuaaauuggagccgagguccaccacacuugcuguuauugugcagccugucaggaaacagccagccuuugucgucucaccucucuguccaugauaaggagaacguggccugguguguuuuuccugcugcugucaaagugucaggauguuacagguggccuguccacauuguuuugucacccuaggacuggacuugggaaauggugucauuucuguuaacuacugaaucagacaggcuugcucaaggaccagugcuugcuuaagggccagcgaaggcauuugggaaaagguugguuuggccagcgaauagaagaagaaaaccuucaaacaaguauaaugaagcuggcuccaaagaaaauucuuguagcuuucagcuggauuuguguuuugggccagaguggaaaaaagauauaaguuuauauaugucaaaaccguuuuccuauuugagggaauaaaaugugucgcacuguggucucacagucuccagguuugaauccuugguuugggagcuggguggcucagagcccaucaugucacaucucuucugucccaguuuuauuuucucuaaagugacagugugcaugugugccccaaggaugaucaugaaggucauauuagguaaaacuuugcaaagcggccauaccagguguuaacugcuauucgccauacauacacgaauguaucugguauuaaguuaaugucguggugugugucuguaaucccaguaacuccagaggucaagacaagaggauugcuaccagucccaggccagcauagugagugaaagguuagucugacuacauagugagggccuaugccaaacacacacacacacacacacacacacacacacacacacacacacacacacaaauacacacucacagauucaguuuugcaggcguguagugauuggugaaaugccuucuuaugaaagcauaaacuauaccgugggaaggacuagucaguagaugggauacuauuagagaucccucgggacagggagacccgaccuucgcugcuauuggcauuuaauguagguuagaggaaugggggauuugguuuggucuggucuggucuggaacucagucuguauaccagguuggccucaaacugggagauccuucuaccucugccucuugaaugcuggaauuaaaggugugcacucucacugcccggauagagauacaggcuuuuaugcauacacucccaguuaggaguuacuuauuuuugaguacacaguuuucccuuugaugaugugucuguguauuuugcugaauuaguguagagucugagguaaaguauaugaggugguagggccuaacccccgaugcuuuuuauaggcgacuuagagaucugaucuuccauccaucacuugcaccauccaaguguccaacuugucccuuggacuaaccaggggcugucagagucacuggucagcugugaucuuuacugugucccugaaaacugggacaagagucucacccuugaagaacuaugaagggugaaagagacucaggcccaggaacccugcaacugcaaucgucuguaccucugcccuucacaaucuaauggcuuccacccaucuuccccauuggcagacuuucuggaugcccucauuucguccucuaauagucucuucuuuuugucuggcacacaaccagcauguuucuccuaucugacccacaucccuucguggaaagcccuuugcuugggcgaaccucuuugagaaaccccucugucucaucagaaucaaaccacaaggcuccccuacaccagugacccuccuaccuugcacugauguauuuaauauauccuguguucuucuguuaucuccagacuguauggucuucacaaugaggagagucucuccuacuuccucuuugaggaaaaaaucguaaugaacucuccauuugcauagcguaguggcuuauguuuauuggcauuugagaguuuaaaccuuaaagaucaguguauaaacaagaaauacucuauaguucuucuauuuuggcauacuuuugcauagcccugugccuuuguuuauagaacauguauaacuuuguaccauuauuauuucaggaaagccuauuuuauauacaguaauaucuauuguaccaucacauuuuugcuuauuugaaacagggcagcaauguguagacuuggcuggcucuaaacuagaucuuugugccuuugucugauccaugauauuuuuaaaaauuacauuuauuugcauguguuacccacaugugugugccacagcagcuucguggaagucaggggacagcuuucaggauugaguucuucccuuccacccuaugggucccacccacgaacucugguucuucgguuugguggaaagccuuggucccucccugagcuaucaagccaguccauuaguuuuauauaaucagauuccuauaaucuccccuugcauugaacauuucuguaauuccagaaaacucccuuaagccuccccucccuuagaagcaaauaaugaucugguuucaggaccaaguaccaauguugucucuccuugaguuuuguauaaaugaaaguauagucuguagucucguucacgucuggcgucuucagcagaggggcauacuucugggguguuuucucaucagucuuuggauucuuugaacaagcccagugcuuuuccagggcaccuuggagccuccacugaggacguuuuuaaugauuguggagcaucucuagaaugcuauggcaauaagacagcccauaugaucaugacucagagguguaguuuuuuuaagucuuuccuucccuccugcaggggugugccuccuuagaggcccugccuucucggugagccugcugauccagugugaugacgcuuucuccugcguggcccugcguuuccagaguccucugugcuauuccucuacucuggacucucagauuuauuuacuuguucauucauuguuuuccaguuuuccauucuguugaaaauaucuugucuucaguugaguuucacccaaaucuuucaaacgaguuaguuuuacuuuuucuaccuuucugguuacuggguacacauuaagacuuugcacuuggagcuauuugcuuaugagccucuuccugccauuuagagcucaacuacccucugucagguguguaggccuggggcacacgggugcauagagagcaggaaaagaauagauuuuguagccuaagauggagacaaggaaggugaucuucucccuguagugugcaaacguuugaaggguucugugcacaaacauuuccuaugaacugccuuaaaagguaauaauucugucuuucagaauaccguauaauaauggugauguguaacucuguugugggugcuagguuucaccaugacagcgguucaccagagaaucuugaaugucagucuuugcaaguaguuuacuguuacauuucauggucaacauccaaagcaagcuuuugaaacugagaaagccguugugguucuuucugcagucagguugaaauaaaaguguuguauggaggccucuuacuguaaucuuugagacuucuguuguccuuaaaauuacacuucuauauaaagagaaagauuugguuguugugguguuggggaucaaacccaaggcauuguacauauuguacgugguagacaaauccucuacauugagccauaccucuagccccaaggaaauaaaugugaacccagcaaccaugggaaggauagaaaaaguaacauuaacuuguuugaaaguuggguaacacucagauaagauauuguguguguguguguguguguguguguguguguguguguguauguguucucaagaagguagagcuaacucacacagcuuuuuauuaaggagccccaguuguuuauuucauugaaccaaaugagauuuuuaucccuugauacacuaaacauuguuaaaaaucuuuaggauaaauauguaaaagcuuuauuacuuuccccuccguauauagaaauucauagguuuuggggacauucucuggguucuguucauuccuaaacagagcaauauucagguauacuguaguuuauauuguauaaaagagaagaaauugagacucaaggccuagugugauuuccugcugcuaaccugcucaggagccaaaguguuuggauaagaagccaaagcagccaggauaccacauuugucagcccggaaagaaagugcuugguguaacuuuguaaaccagugcaaaaucauuugacuccacuguaagcaugcauugaccacuaacagcuuguugggacccuucuccaauugaagcagggaagacaacuuauacuauugcuaagucugaauaucuucuuaacuacuuaaaaaucaaguugucaacagcagaauaugagccaccucaucagcgcuuacccagugaacccuacguagacuggcucacaucuugugaaacgugugaaugugugcaccacccagcucugguguaacaagccugugucuaaagauauuuagacauucuguauaacuaauuucaagccugccugccugccucccucccucccucucuccuucccucccucccucccugucucccucccuuccucccucccucucucccucccucccuuccuauagaaucuaaugagauagcauaaggaaacccuaccuagagcucuuuaacuaggugagauguuugaagggcuaguugauagcuaccucagacuugggccauucucuuguuaucugugucuuuccuaaauuuggacuuuggcuggcuccacugauauccaaaagcccaugcucuuuugcccacagauaagcaaaauacugccaacagcacccugcuaugagagcccaugagauuucuuucuuguccuggucucuugcuaacucuaaauuuccaaauguuccucaccccaggucacuuguccagaacacagauucacaaacgucacggugagaugagacagauuuccuguucucacacccaccaauuccaacucauucaaguuugggauggaguccagaaaucuaauaucauccaggugauuuggacaccagagcaccugagacuacacccagacaccgcacuaucuagaguguuccuuaugugugaaaaagugugugugucuauuagcacacuaacgauaaauagcuccaagaguccauuccuauaugucgaaagucuaugcacuucugaggucuuguacgagcacuuuuugauucuucugcccuaaaagcaacugaucuggauggaaggcggcaugacggaauaguuaauaccugacugggguucacuguauuguuuugauugaagaaaccugguacuuuacacagggacucguauuucucaggcuugagucuuagaacacaccgacaguuauugagccacacuucugucucugacccaccuucauugcuagauuuuucccccccacguauguguggagugugcacugugagcagcuuucugcagccugacacaggcuagggcauaagauggaaaccgcacccuggaagcccagcuggccaccucugucuggaagguggaagacaggccaauggggccagauuacaaacuaccugaucaacacaggaaagagagaggaaccggggaagcauuguucuccacuuaucuuucagucucugcggcuccagaggagacaugagcuagagcauucuuuggugcacacuggccaccugaacugacuccgcccuuuggauccugaaucacggaaguagccagugagauccaguaccgaguuccacgccuggaacacggggccuucaagggucaugauugauucaggucugcccucccaguuccauuugguuaaaugagacuuaggguggcuggcaccuacuugucagcucagagcccugcaugaaaaucugaacccaagagccucucgcaaggucugcagccagugugacagguagcgugguauuguuuaugguaaaguggauucaaugguaccgacgguuuuguacaaagucgguuccccaaagguuuacaauuggugggagauuuugaaauuguucauauagacugacucaagggcgucgugcauaagaacaaagucacuaacugcugauuuuugaaauuuagaggagacccuugucuaccacgugucucccagguuacuuggcucugaaagguuaccuuuaaagaaacaaacucugaaggucgugaugcuaggcgaccaccuuccugcaugcugccuccgcccuuuggcacucucaaggccccuccugccccgucuuucuguaccgucuauaacaacuccaaauuugccguuaucugucaucccuaacugagaggccagcagaacacagagcuguuuccucacucugcaaaucaggacuuagagguccagaaagucagaaaugccuuuuggucagacagucugggcccuaccuuucuggguuaguuuucucauggacaccuuugaucuuuuaaaaaaacagauuagauuuuaccugaaaguguaucaugauaagaucuuguggaguaauguuauagaguaaucaugggggaagggcccuguccuaugguaugguucuggagcuggggaccaggagaagugagagaaaguucuuaauaagguacugaagaaaggcaugaaaaguacaagcaggugacugguuccacguggccagagagagagacugggaaggagaaccaagucgguaaggcaagguggacgcaauggcuccccccauuuuccucauaugugaaguggaggggagcuccgaaggcuucccacagacagcuggcuucccagaacccuaucagcagagucacaugauuacagaaguccucccguuuuccaguuugucaccgucucuuacaaggcaccaaaugugccucacuuuccauuugaccucgccucucccacgaucccuugucauucuugauugcguuuuaggucuguuuauagaacacaggcagaucuccaggaagcuggggaaguucuguugucuagaauauaaaaguacaguagcuguaguagauuuagaagaggagacuccagaagcacccuacuguguguguguguguguguguguauguacagguauuauauagggaagguaggugcuggaguucaaacucaauaaccauuaguuuguuuggaccuucuagcaugucuccaagaaaacuacagucagguuugauuccucuagaauaacaacaguaacacauaucacacauuuaaauggucaagcacagggcgaggcgcuucccccuccuaaucauuaauaaucauuaauucaauagggcaagcaccaguguggccucuauuuucgagaugaggaaaugcaagcacugacugcuagccaucccccugcgaagccugcuauucacauacuagaagaaggcagcucuguaucacuuccaagaacauugacauuuuucagaccaugggugugcuauguuuucuuccauaacagaacacucauuagucagcgagcaaagggaaauuuaucucugugagauggaaacaaccaguccaaccauucccccaccuuacaaaaaaaaaaaaaaaaaagccacucuggggacuaauuaaguaauggcuucucuuccucuccauuccuaacugccaaagggccugagaguaauaggauuguguuuucccaaggucagauugggcuguauaguggagccuuuucuagacgucauccaagugauuguuugggaaacaacaccagccuucccuuacuucuuaugcaguggcuuuuccuugcucaaauagcugugauuuagacagggcaaggcuuccugguuuucccgcucuggccuuggccugauagucucggggccagugcaucucucucuacuaucuuuaacaugacuuagaacuuuagacauaguuuuguaaaugagucuaugucuauguacuugugcaugcuacauauguugucuaccacucagcuacaucugcagcccaugguuuugggagaagagacaccuguugugcggcucacacuagcuuuguacucccauuuagcccaggcugguguugaacucucucuccuccugccccagaucccugaauaucaggauauuguguguccacugucaugucuaaccauacuucuuuucccuucuuuuucacaaggucucacucuguagcucuggucguccugaaacucacuguaucgugaggcuggccucacuguaacuuaaacucacaaagaccugccugucucugcugcccacgugcugggauuaaaggugugcaccacuaugccagguucuggcuguauuaaacuagauugcuggaacuagcuuuucaagcuugaaaguauuuuaugugugcuuaaucaugcacaagcuuuuaaacucgacuaauggggugcuuaaaaacaaaggcuuaugccgagaguagcagugcacgccuuuaaucccaguguucugggaugggagugggugggugggugggugggguucucugugaguuuaaggaaagccagagcuacacggugagaacuugucuugggaguuggggugaguuuuucuauacauguuguaacuucuauaagccaacuauaccucgaagcaugggguacuccacagucacucacucauucuuaguccuggaugaccuguuuuucuuuuggcuuugcugguugucagaugaagcgaccgauagcaguggacuugaggcaaagaagcaagaaggcaaaggauaggcagaagccagcacagguggcccugcaaccucuccaugcuaugagaagccaaaaauaaaucuauagccuaaaauugaggggugaaguccuuauucccccaccacacacauguaugucccgucagacaggaagcacccugagagcccuuaauacacuguuuacauucucagaaagaagucaggggucucucuaccaaaucacagccuccuuacgagcccaggccgguugauccaaacuaaagccauuugugagggugagacgcguagcccagcuguuguguacagcacuguaaacagcagaaggucccuugcacagcugcaggcugaugucaccuucuggagccuggccuggccuggccuuugguuguuggaaguaacaacaguaggccauccgaucccccaucugucucccuuucucuuuuccgguacccccuucccaucuacacccccacccccuucacugagcuuacaguagccagccaagcugcacacuguuugggcuacuggguuuuguguguauaaacaaagcaaacagcccuauccagugguuaauggagaggaucucuguguaucccacuugauuuuaaacauugaugcacuguaauuaacauaaucaaacugacaauaguuugauuaugagcagauguguaaaagucuggcagguguagccugcacuuagaagcccuuugugcccacaguagaugcugacugucucuuuucguuuauccugaguggcagguuugccaagaugccuguauaccaggggccucuguauaaggugcuuccguguggagauguuugugucuagcguggguuucuggaugagcucggucaugcuugcuugcuuguuaucugcugacguguaaaauucuaaaacuagcauuucccucucuagaaacggauccccuccucaucgauuggcuacaaagcauuuuuauagacuuugcccacagaaaggucuaacuugggauacacaggggaccuaaugggaagauguccauuguucuccuauuuauagguuggaaagucaguuggcaaaagcuaauauuguuugcuacuuagaguaccacuggaugucuuaaaucuuuuuucuuauaagcaguguaaggauguuuguuaguaauuaaggccuuucauuauguuuuacuaaauucuuugaaagaaagaaaaaaaguguaguauuuaaucccaaaugucuucugggauguccccugucauuuggcuuucaccugccauuuuggcucuuuccuccaacauuccugcuuugugaacugguuuguuuaugacuuuugucugucuguucaugguaggcuuuguuugucuugcuauguaucccaggauagacucaaaugcaaagauccuccugcuucagccucuacauuacuaggaauaaggcaugcagagcacacaccacagaacuuggcucuucuuuguggauuguuuuaguagucaaggaacacuauauacuguuagguauggaucaugugggaauaaaaauuucagccuucauacuacaauuuuauuaauguauuugugacucuacuuaaaaauccauugcucaaaccaaaauuauaauguaucuccccaugugcauuaagauuaauacaacuucaucauuuucccccugccuuuuccccccuccaacccuuacuacauaccccuccuuguguuguggguuuuguguuuguuuguuuguuuguuuuuuaaucauguuuuggugaggauguggagaaauugaaucuugccuauuacauuguaaaaccauuuuaacugaaagcggaauugcuauaugaaacagcaguuccucuuuuagauaagcaagaaaguugaaagcagggucacggagcacuuggguucccauggucuuagcagcauuguuccagguggacccgugguagaaguagcacgugccaucugugggucaguacaugauguguacggucaguggagucauagucagccugaaagggaggccagucucagcacaagccacagugcagagggacacugaggacaucauucuaaguggaagaaggaugcuuaccgaggugggagauaauggcagcaacagucaaaaugcaguguguguguauaugugugugugugugugagagagagagagagagagagagagagggagagagggagagagagagagagagaauuacagagaaugacaaagagaaaggauuuaucaagauaaacuguggcucaccauuuuggaggucucaggccaggaucuguugaccccgcuccuuugugcccaggugcaugucguguuagggcaagcacaugguugagaaaacaauguuuuuccucacguuaaagugaggaagggaaagauagcaucauggucucccucucggagguguguaccagugaccuaagguccaccaccauccuuuggcccugggagccuccuuugauggacguuucuuacuugaacugcagugcuggugaaacagugccauguguaugccuccagagucaucccagcgguguguaaauguggugugucucccgacaccugagcaaauguaaaaggcccucuccucuucuuucugcccauuucaguugcugcuucaagcgccugugagaagcuagaaaaggcuaggacugacuuacagacagcguaucaagaauuuguccagaaacuaaaccagcagcaucagacagaccggacggaacuggagaaccggcugaaggacuuauacaccgcagagugugagaagcuucagagcauuuacauugaggaggcagaaaaauauaaaacucaacugcaagagcaggucugugcggcugggcugcuccggcguggcugucugcugccguucuagaugcugucuacauucuucauaaguuaucccuugccuuuuuaguuuagcuggagaaagcuuuggggauugauggcuuucucuuaggaugaagcaguguugaguuaaagaagcgggaaguagccaggcacagugggacacacccagcaccccaacucucagaaaguugaagcagaaggaucgugguugagcccugccuuggcugcagagagagcucaaggccagcacagggaacuuuaagucccuggcucggaaguaacaacugccaacaggaccacauauguucucagugacacagaggccuguuagucucugaauucauccccagugcaggcaggcaggcagacagacagauagacagguaaaaaacaagcucugugaucccaccagcucuaguuacuuaggguuuuacugcuguaaacagauacugugaccaaggaaagucuucuaaggacagcauuuaacuggggccggcuuccagguucagagguucaguccauuaucaucaaggugggagcauggcagcguccaggcaggcguggugcaggagcagcugaagguuuuacuacuucaucugaaagcugcuaggagaagacugacuuccaggcagcuaggacaagagccuuaaaccuacuccaacgaggccacacccacuccaacaaggccacaccuccuaauagugccacacccccuggcccccauaucccugaccaccaucgcagaggcugagacaacuuuauaagauugucucaaaauaaaagcaaaggagguucagagcuauagcuuagaggugcagcaagagguugcaaaggauguccacagcucuggucaaucccuaggaguuugauaacaaguuuuuaauagaagggauaggaauaaccccaaacaauccacuuggaagcaucccaguguuuggcuucuaaaccauuggucuguacuuuguuuuuagaugccuuuucaauaaccacuuuucccauuaguaucauaaacuuggaauuucccuguuuccuauuuccuuuauuuuuaaguuuaguaucuucauagucucuacuacauguauauauauguauauguauauaugugugugucacacacacacgccagacacguacugggggcuaagaguagaguggucagugcuacagguguggggcugagguggaccugugaaguguagcccuacuccuugagguggacuugagugcuugggcuaucuuuguuccuggggagaauggguuugaguugugggagggggggcagggccagaguggguuguucuacacauguguuagguggcugcaacggaugacggaggucccuaguguaugcuccuucaucugacuuagcacuuuucuucuugcuagagaauaaucauucuguuuguuccuuacaguuugacaacuuaaacgccgcccaugagaccacuaagcuugagauugaagcuagccacucggagaagguggaauugcugaagaagaccuaugaaaccucccuuucaggcaagggugcuucuccugcuucaggagacaggcaguggaaacgcgugguauuuacuauaacgaaacugacucaugauucucccuugcacagaacacccuacagcauucacuuggcagaccucuugguuucuuugugcauuguucauugucaguggaugcccuuuucccuuaaggaugcaaauuauaguugguuauucgugccaggccuuuaggaaacagggugaacuuccaaagauucuaaaaaccucucugguggugguugugguuggcggcgguugcuacuuuaggucccgggaaaggcaaggugucagcuucuagcucagugcugcacggaauccacacguacgcauucuugcauucaugacugugguagagcacaggugggauuugacggacaaggacaggauaugcuguugugauuucaccagcacuggaaagcuugaugucaaaaggaaggaacagggagaaaccuccuugucuucuuugaggacaaagccagcaaugcaauauaggguguucaccacaagucagcuguggcuuacauaguagcagggggauguguggcuaaaauggcuaugaccuuugggagaaacuucucaugagauuacacuguggggagucagagaugauggcuggcuuauacacaauaaguauugucgucuuccuacugggagagggcuuaauuuuagauuucuguuuucuucuggaagagcaaauuucuucuaggaagaccgggccccuaauaaggaaucagaaaccugacuuuugaggcccuacccuucguuuugagauuuugaagguuuccuuggccucugugggcaucaggguuucuggucauuguaccauaaaucucuggccugccucauaaagcuauucugaggagaugccgcuuaauuuaaagaauugcaucucaugaauggaaaguaucauaagucauacuucaucagcacccgagucuauauacuccagguuggagaguagugaucucauaggguuguauuaccuuaaaagaaaaaaacccacaacaaaaccccugccuuccagaaaucaagaagagccaugagauggagaagaagucacuggaggaucugcuuaaugagaagcaggaaucgcuggaggugaguggcucgcuccuggcccccgcagccgccuuggacgaggccucuguauguaugccuccgguccuuuccuggcaucugacgcuccacguguuacuguuuguguuuuagaaacaaaucaaugaucugaagagugaaaacgaugcuuuaaacgaaagguugaaaucagaggagcaaaagcaacugucaagagagaaggcgaauucaguaaguuguguauuccggcugcugcuggguuucccuccugcuugcgugguucgguugaauuuccaucagaccaggagugggcuguggagauacuccacaguggugguaucacacuguccauuugggagagugaauguguucugugguaguguugccauggcgaagccaagguaaccaugaggagagcccagaggcucaggacauuaucgcucugugucauuucccagagcccugcauaugacacugucuuugcuuguguuucuccucagauacugacuuugcuuagagaaaacuacuguuuccuuuucucccuccagauacuaguuuagagcuggagaaagcucucucuccugagcucuguuuuuauguuguaagcaaugguuucuuguuccuaauaagagauccgaugaaaguaucuaccauacuaaauaacuggggaaagauaaauuuguuuucaauacugugaccaaagucuuugagauuagaagguucuuaauucuuuuuuacuucuuugacaaugauguaagaaguuaagcuaggcauggugacucaucuuucuaauucuggcacuugggaaccugagacaauagaauaaccacaaauucaaggccagauugagccgaaugagucccuggucagccugaugauagcaugaaaccuuguaugaaaaaaagacaaaagaaaaaaaaaaaagaaaacuuacuuacauuuagcuggccaugucaggggaugccuauaaucccagcaauaugggaagcugaggcaggagaacuacuauaaauaucaagacagucaaagcaugacccuguguuuaagacaaacaaacaaucaaagggaguaaguaauuuauugcuuguuucucuaagacuaaucagagaaaucaguacaucaagagguuagacuguauaauaugugauuaaagucagagcaguuaucuuagugguuguuuuugguuuuguuuuguuuuuucagaaaaacccucaggucauguaucuggagcaagaacuagaaagccugaaggcuguguuagagaucaagaaugagaagcugcaccagcaggacaugaagcuaaugaagauggaaaagcugguaugucuccugcaggaugggagugagcgccuaccgcacaugugccuccugcgcaugugcuguuugcauagcugugcguacggaguugccugugaaauagaauagcagagcuuagagaagcuauauagcagagcuaacuuguacucgaugauauuuggaaaguacacaaagggucagaguugcacuuuccuuuccagauuaguugcugcuuccuagaacauuuauuuauuuauuuauuuauuuauuuauuuauuuauuuauuuauuuauagagugcaugcaaagcagcaucuaguuuuggaaaaauuauaacaaaucagguucccauuucaguagucugugggucuucacuugccuaaugagaaaaauuacucuaaaaccaguauguuaaugcagcacccauucuagacagaaggacaguuggaucuauccaguaacuucacugguaccacacaaucuauuagcauucuguaucuuuuuaagaaugugacuaugaugaaaagaauuguguguugaucagcccaguuggaaaacagcaagcauuaaucagaauuuaaaccuacuccaggcuguguuugaggggugugcccggugugcacugucagccuugguccagcccugaaacucaggaucugcuggccaggacaugaaccaagauggaaggauuucucagcagcuuaaguggcccuagcuguugcuugcuguacuuugcucccaacugccagccauccagggcugcaugugucuccuccacccaguugugggugacucgcuacgccuugaagaaaagucucauucaaaguuaaacuagccuugaacaauagggagcauagagguuacucuuuaucuguucggcuuuucugguuugggggauuuggcuuaguuugguguuuugauuccuagagauaauuaacugcuuuuugagggaggcagugcuuaagggaacacacaggcauuacuucacuucaucaggaaauguggaagugggggaagaggacuccuuuuuuuuauacgcugcggaguuuggaucugccauaaugaagaaugaaauuaugucauuugcagcaguaauuggaggcagagauuauccuauuaagugaagaaagcccggcccagaaagacaaauaucauuuucucucguguguggaacugagaugauaaucgugcauacacugcagucuagucuagucuguugacaaacacaugaaggcgagggcucgcuggaguugauuugagugcagucacaguaaagacccccagaugacagugacaugaguguaggccagacauguuucuaggaauagaaccagccugaguucauccucauggcuuuuggucaucaugauuccgcuggguugguucaugauugcuuucuugcccaccaagaugcauaucgucuccuaagcuacuaaggaauuucucccaacuggcauuuuaaguccagcccaguuccaguuugagagaauacaucccaucugucaagugggugucacaaugauaguagauacauacagcugggacuccucaaucuacccaucuuggaggugccaggaguacaggaaguggauuuuuuuuuuaaacgaaugccugaaacuccuaguuguuaauaggcccaaccuaguacacacagcacuucuuggcaaaggucagccugcgccaccugcucagcaggcuggcaaugaugacucaggaaacccuguuaacaauguguugcuccaucucccguucagguaccuaaacuuaucagacaaucucaagugauacaaggcccugcuguaaaaguacaaacacauuuuaauuucuauugagucaugauaguucuguucugugccccgacugaacagugccaguuggcaucgcccuguuguuuuuacaggaauguagguugcuaagacgauggguacacuuguugccacugcuguguuguauacuuggcagcaccaggucuuuagagaagauagaacacuuaguguauuaggguucucuaaaggaacagagcugauacacugaucuauuaaaggaagauuugcuagacuggcuuccaugaugagcuuagacuaacuaguccagccguggcugcccacaagauugggcgccucugcaguuccgaucugguaccaaaggccagugggacuucugaagagccuuuugaucaccaguccacucuggaagcccugaagaagcugauucuaauaucagagacagaaucgucugcaguggcaacagggcacguagccuccccagugagaauaagggccaagcaagcaaagcgcagagucaaaagugccuuucgucugccuccucacggcugagucacuacuagguggugcuguucacauuuagacaaggggaucccccggaggcaugcccacagccagccugauauauagagucuuucauugguuuucuucucggguaauucuaagguggugucaaguuggcagauuaaccaucacacuuagcaugaggaaacuauccaaggaagacagguuugcuuugagagcuagcucugccagugggaagcucugugacaucaaagauggaguuuugaccucaguagagcaaagcuuugauagaauaaugguuugaggccaauugucauguuuuuguuuuuuuauuccaaguuuucccagguugugucuuaccuugaaaagcauuucaagguguuucuccccugcccaacucccccaccccucuuuuuuuucauccuguagauuuuuuuuuuuuuuuagaaaguuauuucaucugaauggcaugucaugaggauuuucuggacucaaggaugucuuaaaaacaagaauuucaccugggugcuguaauccaaacagaugcgccauagccagcugccaugacagggacuuggggguucauuuuugaccucauguuaaguucacucugagcuuugauguugccucuuaaagaagcaauaaaccauuccuuacggaagggagccaggaugggaucagugggucaccauguucagugacuuuaaaugccuauaaccacucaacugaucaguuuguguaaggcuggaaagagcacaagugucccuuggccugaacugagcagggaagccugcuuucuucaguuacuucuuuaccuaaccuugcuacauuguaucuccauagggccaccuggagguaaaugccaaaaccauccuggaauaaguuuaaggcuuuccucaguauggccaagaccuauaggcucccucccuuccucuucuccuuccuuccucugucuaguuucuuuuuuccuuccucccucucacccucccucugucccuaacucucccccuuccuccuccuccucuccccgcuuccuucuuugcguauguguacacgagugcuguagauacagggguugugugaacggagacaguuaaacugcaguguuuccuuuacugccuugaggaagagacccagcacccauggucaccuaggcaggacaccagcucccagcaggacaucucugaaagugucaccuagaauaaaaacauuacugccuagcucucuuauuucuguguuugaugaacacauguccucaccguggucgguguaugaagacaucagugugccacuauggcuccuccugaucaacuuguugauggugccguguauugggaauaugcuuaagaagugagagaguuuauuuauucauuucuuauauauauauauauaacuacaaaccuuguuuuauacuaagguggacaauaacacagcauugguugacaagcugaagcgauuccagcaggaaaacgaggaguuaaaagcucgcauggacaaacacauggcaauuucaagguaaaccuacaagagucuauuuccccuuuccucauccucggacaucuacggucccuucuggcuacgcuccaccaggcaccucccaggcaugugagagaagcaggagaaugguucaugcauuuaccaaggugcccuagaccucucaccuaacugcagcucacuaacuguaauggcgcugucagacaagggguaacaacacacgugaacagaaagaggccuugaguuaagacagaaauaaaacaagccuugugcaagugccccauugccuacugggaaaucucccaaagacuagaguugccagcaauuacucaggauuauuuauuugggucaggcuugaggcucugguauucgggaguuuugcuuuccuuuuugugguccacagaccuugagccagggggccucacacacauuaggcaaguccucuaacacucaucuauaugcuuccuuauuuguaguaguuggguuucucagcuuaaaaaaaaaucuaugacccauaugccaguggugacacaugccuuuugucccagcacucuggacugcuucaaacagguuaaguuaaaggccagccuggucaucagagugaguuccaggacagccagagcuacacagagaaacccugucacaaacaaacaaacaaacaaacaaccaaaccaaaaaaccccaaccaggaacccuauguuugguugauaguccugggaggccuguccuuuucugaagagaagugggaggagaggagggaggggaaaucguggugaggaugagcuauaugagagaaaaaucagaaaaaaaaaauugaugacccuggacaagaaccuguguauucccccagaagaaguuucuugaaccuucagauauaaacaguaguaguuccuuuuugacuuggauucauaugcucucuggguuuuguuuuccaggcaacuuuccaccgagcaggccgcgcugcaggagucccuugagaaggagucgaaggucaacaagagacuguccauggagaacgaggaacuucuguggaaacugcacaacggagaccugugcagccccaagagaucccccaccuccucggccaucccuuuccagucccccaggaauucugguuccuucuccagccccagcaucucacccagaugacggcuucugaacgcaggagacucucugaaggcacugaggugcgcuucugcgggacugacccgaaguucagaguucaugggaacucgaguugcugcguuagcucucuggaauauccccaggauaucgggagagcagccgccaaccguuucagcuacguacgaauagagagcuccaauaggagacuuuuaacuugguccaaaagccuccuccaaaaacagauuucggaacugaaguggacauaguugcacaaagcacuuacggaacgagggaaccuuguucuuugccuuccuucaccuaagcauaggggaaaacucucagggcccuauuaagauaaagauuuauaaccuuuauaauguucuucaccagagacaccuucuugugauuuuuauuucagucugacugugggcaaggggggugugugugugagugaaauggguguacuggcgugucacgugacugucauagccccgcccccugcuguguauuaaaagucaacagcuguauauagcuuggccuguauuaaccaagucauaaucggcacacgagcgucaacaaaagccauagaagagaaagcaauagugcuugaauuuccccccaacucaucucagcacugugccacggcagggcucgggcaagacaggaaaagccuuugguuucuugaugacuguacauuuauuucucuguuguuaguuuuuccauguucggcauuauccguugauagcaguuuuuuuuucccccuguagauuuucacgagccuaauugcuauacucugauucauuuucucaggcuaugagcaaauguaguucccuaauuuuucuaaauacaaaucuguauaaagaguaagggggcaguaccaauggauguuucugguuuauuuuuuucccuugaacccaagcuagcuucauagcgcuaauccuccgucuacccuccuguuguucuaaccuccgccuugccuucuccuccauguagagccacggaagcaaagcgcccuccuuccuacccacagagugugcuuuuccagggccaguuuaucuuggaggugcugaaccuguuucccaaauaagcuaagcucugguucugacacuacacaauuuuagaaaccccgggggggaaaccaguaaaggcauuuuagcauguacuaauccacaugagcacagaguuaagccaacaguucuguguugaguagauccaagagcgggaaugcugacuugggccccucugagcauucuuccagccacuggaauggaacagaguggccaaagagugagagguauggcuucugcagcuccuucacacugcauucaaaauucagaucuucgcuuaccaucucccuaggcuccaaggcucugugaaaguuagaaggauagcuguggcuccccaccacccaacccacaaacuucccugugcaugccggcauugcgaugucaguauuuacuaauucauggucaaugcugcucagauaaccccuauagcgaggacagauucaggauacuagaggugagucauccuagacuucugcacuacagagcuaacugauagucaugaugcaugcuuuuuauuagggguuguguuugaagucucuuaucuccaauaguuuaugauguauguaaccuaccauguuugcucccgauaaauaggaaugauugcagcuucacugccaccuccuggaauagcucugcuccuggucccaaguuguucucaaugauguuagccaaagucagguuugucauuuaugcccuaguuaugguaaagcucaaguguugaccugccaucccucauaccacguagaugucugggaagucaaaucuuacagcaauuaaaaugccuagagagcauuuaaggguuuuuuuguuuuguuuuuuaaaccaaacauuuuauguacaauacaaaauuguugacacaucguuuaaaaaaaaugugggugugugaacaacuguaguuuauagcaaugggaaaguguauuuuacuuugaucaaauaaauaaugcuggaauauucaauguaagaauggcagccucugacauacuuacucuucaaagcguuaaguuauaugcucccccuucucaucccuccuuaguuaaggcagccaggcgcccuaugcuauuauacagaacuuagaacccaaugccaaaauuuguuguggcugaaauuggcucacagagcuugaguuuaagauuaagcuuuucaaauucaaaauacaugugucagagaacgaaacuuuggcuaguuugaaugauucuucugcaaggcgaaaagaaaauuggaacagcuguggucuuaaguguuuuuucaagaccggucuuagccaaagcugaaucuucuucaguccauucaucuauguuauauuaaaggcuaagguguuaauaguguacaugcaguuauuuuugaauagagggguuuaaaucaguacucugaguguggcgauuucaauguaaaaagaugugauuuugauaccuuuauaaaugaacuugugcuagcuuugauaaagugacauaucuaagcauuugaaucuugaguccuugcuuuugaguaagccguugaacuuggcucaaacaucaaacagaauacuaagcaacacaaagaucacugucaagcccuucuggauguacaugcuaaaugacacaaguacuuagcucacuuuuuuuuuuuuuuauaaaaucuugcucauuuaauagaaacgauugauacaaaguuguugacauguuuucucaguauaaaaaguagaaacauggcugagucaaaauacauacuuuaguuaggaaaguuuauacuucuauuaauagacuagugacuuccuuuuaauucggaugucugucugacccacuggcagggguugguccuuggccuccuauaaagcaccuggaagcugugugugcagaugggcaucccauugguccacuacucuucacuuuccaaaucaggaaaacucaacaguggucgcuacuguggucuguccucggagauucugagcugugcauauguaguagcccgcaucaauggucucaaagucuuccacgauaaugacacucugggagauucuuguggugugucccaguccucugugaaucagucuccagguguccuggauggucacaggccuuucguccugguuaaagauggcacacagacuaaagucacauugacagcugcuucccucacucaguucccauccaccaggcccauucaguacaagcucacagaaggcugguugguaugcugagcucacaagcggaggguuuuuguuuuugauugcauaauuacucaaggcugccuuucccuuccuccacuccucccccaaguggggucuugaauuucaggaugcuguuuuugugauuucuuuuugcuuuuuuuauauguaaaaugaauuauuuugggccucuaugggggaccagcauaaacauaucuauaugagcagcaucuuuucccauugugucacccucacacugccaagugguucuuguuuauggaacuuaaggucaaaagcacugacucuguaagugaagaagaggcaggaaagcaauuaggcuaauguuccuugagacuacagagggaggccaguuguaccaaggaaggcuaagauaaugcccuaggcagcaugagcaucuauucuagaggacggugacuuguaagaucuauuucaggcaguugcagcaacgagaacaguguuuucuaaauucaauugauaagggugauuauaguaucacuuaaugcuuuuucuccuaauaacagcaauauaaagggucacucuauggaaaagcaagaaugucuaaguagaacaauguauuuaaaacaaccaaccuaacaucuagaugcuggaaagcucugcccuccugggauccuuauuuuccaccccucacaggcuaagcagagcacaggcuaccuagagugucuugggagugucuccucuggcaaccaaguugguagcagagcuguuuauuucagugagcagaccgugcacacagacuggggacuucuuuuauagaagacuauuuuuaaaugaaugaugcugaccucauaucaccuugugaacagggucuauguuucaaugccccccuuggagaaugucugcuccaaagcuuugugcaggcguuguguggggcuccauggccugcaggugcccgccuuucucccacuggugucuuugaaacuuugugcacugugaaagguuagagcagucuagaguggaccuagauggugauguugaaagcugaaguucagauguaaguagccuugccccgcuuccugcugcaaucccuaaggaggaacaaugaacacaccacauacaaaggccucuugagugauugccugauacagccauccacucuuuuuccuccucuuucuuuaaagcaagguauuuugaaguggacugaaauaucuuagaagacaaacguucccugguuccugucuuaucauaaaccuaguagggucucucuaagcgagagagcuagcugagugaggcuccaguguggcacuuaccuucugcccaggaaagagccaccugaauucaaccuccacaucaggcuccccgaggacagugcagagcacgcugaugucaucaccgccccucacuuuguuagaggaggccaagaugguuguugauggagggccacuaggaacugggaacaagcaggagacagaaaugagauccauaacugaugguaaagacaaagaugguacguucucucuggggagaggaaaccuuuucuauagcuucaugaggccaaugcuagacaucccuuuugauugccuuaggacagugguucucauccuucccaaugcuaugaccccuuacuacaguuccucauacuguggugacuucuaacca

SEQ ID NO: 4410 - RNA, 6989 nt, Mus musculus
agagaaaagcggggacagcucuauuagacaugaaacugugaccacgcuucagaguccccuuucccacagcagccaaguugcaaacaaaaggggguaaaaggacaaggaaaucuuaccacuugcacaagaaaacggaaaggaagauggcaaaagcugacgcuacugaugcuuaucucuaaaggacucuggaaagccacaccucccucccuccagaaacacccgagggaggggugguuagcuuauuaguggacuucaggaggcaacagauuucagugaguguugacaucuguccuaacucacuucccuaaaccacacucagccuucuccagcaagauccagcgugaggacaucaaggucaguugucacugugucucaauggccggaagugggggugggggaaagccagcccacucuuccuucacaauggcuuuuugcccuuggugucaccuuugcuucuaguccugguucuuuagagcccaguacgcaagcauagaagggguuucuuuauacccuagagggcuguuauucaauauuuucuguguauaaacucccuucucuuuugaguauguuacaaaugacacugggacugaagguggagcucagguagcacccauacaugaggcggaauuucuuccuccagcaaauacagcauacauacauacguguagcaagcaugagugggugcuagccugugugcuugugugcgcucccauggacuagaauugccuagcuccuguuuagcaucccgagaucuuccauccaagucaaaagcuauccuucccagaauccaugcuacccucuugggaugacgggcuuucuuaaccugacucauuuuauacacuuucuggaaagccaacauccccuccccccaaaugcccagaagggacauuuaucuuucugaauuaugaguuauuacucauauagcuaagcacauuuuauauccuauaccauaaugauauguaagaaaauuaagacauagcuccugccuucaaggagccugguacuuaggagggcaauguccaggaccaauucuuuggucaucaaucaaagcagaugacaucaucugaggcgaagcagcgcaggacuaugggaaacccggggcuuuaauaugaucuacucaaaaaugcagaccacagagcccagacuccaacagacauacuauuaguuucugcaugacugucuggguugccugcccuuuaaauguacuucuuauuuacucaagaugauaaaauacauucuggcaguuagagaccgauuuuuuuuuccagcugcuuagauuagugucucugucauagaugauaaaccauuuauaauccagagaagagguuuauuugauuaucuuuguacuauaacaugcaaccccacccucgccccacagacauacacacacagugagacuagagagaaagguggaaauccacacgaagaugcuuucaaacucaugcauuaaauauaugaagcgcuuuaaggaaaaaaaaaaaaaacucaacaacaacgggauucuccguaauuuaauuagggucucugggaugcaagcacuuaguggcuggcugucgucccgccagugugccugacuucugcaggcuacugaauggcaucagcaacacaggaacuauuacaggaaagagcugcagagaguucauacuuuuaucauuguggacacuuccuucccacccacucccucauccugccugcucccacccccaccccaccccuuuaaaucugagauguagacuauuagcauaauuuaaaacccuuugggggggggagguacuagccuagguuagauucuauaugcaaaaaaaaaaaaaccuaucuggucuuguuuuaccuuaccaagaaauaugccuagagacccuuugaugaggacucuaggguuacuaacagcaaugcugguuaauaggauccaaauguuucaacaguggguacaagagaucucuguaaaggguuaaggggauuuuuaauugcucaacuuacccuuucccuuucagcuguuuccuaacagugagugccuuguacacacuaggcaacuagcgaacauucacugauggauuauaaaacagagaagggguggagaacauccaacauggggauucugugugcucuuguaagauguuucugcaguuccacccucgcccuucgcucguccacucagguacugucugaauugucaacuucaauucuuggggugguuuuacaagaaggaacuggaagcagacucugcuaucaaugaacuuucaucguaaggagccaaaacagaggcuggagcaaugagucagugguuaagagcacuggcuugcucuuccagagaacccuggggucaaguucaauucucagcaacuaaggacagcuuacaacugucugaaaguccaguacccucucuucuggcuucugugggcaccgcauguaaguggugcaaagacauacacgugacaaacaccuaaaauaauaaaauaugcuauuucuuuuaaaagcagaagcaagcacagagugaggaguuaucauauagaaaggaaguauaagauccuggaguccagaggguggguaaagauagagcuagaagcccccggggucuccuuaaggagggggcccaugggcuugauauucguuaaggucacuguuacacagccauucugcuguggauuggaaagaaacacucgggcacugaaagcuugacaccccagcaugcugguccuguugagagacauggaucaugaguacgcuaacuucaucaguggauuaguuuucucaaggugucagagcugaaugggcuguuaggagguagaacaugauuggaagugggguuuuaaaggguacaguuugugucuggccucuuccuuucucuuuuucuuucucucuuugucugucugucucucugucucucugugucucuuucgguuucucucuguuuuauuaucuugcuguuucucucucucucucucucucucucucucucucucucucucucacucucucuugcucuugcucucuuucucuugucuaugauggcgugagucacuaucuccaucacuugcuuccugucaggauguucugccucacccaaaagcaauggaccccaaaaaaaaaaaaaaaaaaacauggaucuuuacaaaaaggcucuugaaacuccuuaaggguauauuguauauuguguaucauucaguauaccaaacccagggccacuuuaauucagggcuacaucuauuuguuccuccacagagccccugaugaacuacauggauuggguuuaggaaccacuucuucugggcccaaaagucucucucucuuuuuuugggggggggugggggguugagacaggguuuuucuguguagcccuggcugccuggaacucacucuguagaccaggcuggccucgaacucagaaauccaccugccucugccucucaagugcugggauuaaaggccacacccagcuaaaaagucucuuauuaacacuacauguaucuauucuguaggauacucuuucuaaaagagguccuuugagagacuaagagagucagaugggagauuccaaagcauuaaccaugagggaaaguguauguaauuuagaccaaaaaaaagaaaaaacgaguggaaugagacuuucauacuauuguaaaucuggaguucuauaaaauagcauaggccaauuaucauuuuacuaccaucuuuccagugaagagacugggagggaaagggacauaagagcauauuuucagagaaggccgauccuauaggagaacaagcagugucacuuaagccggauuugucagacacuggacaccaaacaccagcugacaugaggaccccaauacacauauaguagaggacuuccgagucugcguucauucagagacgacgaaccuaacacucaagagacuggaaaccccagggaguuuagaggucaggugggguggagggugggaacauccacagggagacaggagggugaggagucaugggauauagagcagucggaggguggauggggguguggggcagggaauggaauacggaguguaaaaagaaaaauaaaauaaaauuaaaaaaaaaaaagaaccuauuugcaggagauggcucagcaguuaggaguucuugcugucaaagcaaggggaccugaguucaaaucuccaaugcccuaaagcuaagcauggucgugaguguccauaaccacagccuucggagaugaagucagguggguccugggaauccucuaggccagcagccagccuggcugaaauuuccaguuaaagguucagugaggaaccgugucucagaaacuaacacuagaggaccagcauccugcucuagccucugcaugcuugggcaccagcacccgcauguacacaggcuuguccacaggcuuguccaccacacaaagaaaaggagggagggacgauaacagaaaguuauuguaacuccaaauccaucuagagacuggcacaaguagaaagugggugauaaaauuauaguuuggggcauggcaugggguuagcuuggucauaaacacaaauuccucaguuuaaucucuaggacccucaguuuuaaaaaagccaggcaguuuugagggcuggaguauuggggguguggggacaggcagauuucugggauuugcuugcgagccagagagaccaacgaguagaguuucgugcuagugagaaacccugucucgagaagaagguagauggcucccuggaaauaaaugagauuuuucucuagucuucaccauaaacgcacauggguaaacacacgaguacacgugcgcacacacacacacacacacacaggaauuggggcgcagagagacggggagcagagaaauagaguucuagcucuugcagucacuaaguuaagcacauuuguaggacaagcauccccgccgcccaccagugaggguugauagacguccuuaccucagacaggaggugcuggaucacaacggucagcgcuucaaacuugguguuaccacgggaaagaagcugucugaggugcaggaugaauccacuuuggcuuucacauuuugucuuguauugggccaacucaagcguucucucggaggacagcacaucuggagcugucugggucuggaugcauaggcuccugggauucuucugccugcccuuuucaacugcaagaggaaggaaagaaaagcacaaagaagaugcgcgugagguuaacuaauuuuuauaaccaccaccaccacauggggcucacaaccagccuacugccgccacaccagagcaucugaaccauguuuuacguugggacguacacaugguggcaggcuggaguagaucggggaucaggauggguggaacucgucaacagggccaauggcuuuaguucucacugugaagauuuaauggggaguuaugcacaugagccaaacagauuuagcaacucagaaacauaaaacacuggaggcagggaagaggcaaaauagugacuucguggccuuuauuuuuaauucaccauuguugucuguguucaugauguuaugugcaugagaguacagguucucaaagacuacugcgguccuguggcggucagaggaccaccuccuagagcugguuuccuuuuacuaugaguuccaggaucaagcgcaggucacuaggcuugcauggcaagcacuuucaccugcugagccaucccuccaacuccacuucauaguuuuuacucuuccaguuaaguugacaaaucugaaaguccuuuccugugucuguugggguagucccgcgauuucuguccuugaguccguuugugugugcauacgcgcauguguauguaagggggcagggggagagagaacgaaugugagucugcuaucacagugacgcaguaaauuauaccaggugacgaaaaggaacaagaguggcacugcacucaugacacaggcugaacaaaguacaauuauacaguaggcagaacuaagacacacuauucaaacgguuucccauuuuggagaaaugcugaagcuagccgguagugcacuuaaaucuaggaugcgguuuaaauccccuugugucuucaaacagacgaugaaaggguaugauuaaaaagcagagauuuaaaaaaaaaaagaaaagaaaagaaaaaagaaaucaugggauaagcacugaggaaaauucugauuauuggacuugaaaugcuuuucuuuccucucgaaggcuccuuuuuaaaaaauuuguuagacugggcauggugacacacacuuuuaauuuaauugcuugggggcuggggguggggaggcagguggaucucugaguuccaagacagccuggucuacagagguuuuguaggccaacugaggaggcgcacugagacccugccaccaaauaaaugaguacauguguuauuuuuguuuguuugucagcaugcuaaguaauaggcuucauuauaguauuucauagaugauuuguuuaaguuuuaguaaguucuucacaguugcuugcuggucugccuccuccacccuaaagcccucccauuuucccaggaaacccuuccuccuuuaccucacugcccccuguacccuuuccacaaacaccucccacagagcugucuuccccgcugucuuucuggucauugucacagucuacucugcagaugucaccgaaaucuaaugacccagcauauacacuggagauccugcacuuugcuccuccgagguuacugggaaaagcagcgugugccugugcgccuggauacacugccucauuuuucaacaagcgcaaacuucguuccccguguaguaaaaaaaaaaaaaaaaaaaagaguguaaaaauguucucaaaugcaugcuacuauuccagauucaucuacguuuggagagauugcucacuucccaugcuguguucugggaacaaccgguuuuaaaugaaaaucuuucuugcaguuuuggaagcauuccaaacgucaaguugcucuggguaaaacaggaagccuacugcuuggugucuggaaauaaacaggcccagcaaucaaaacaaaua

SEQ ID NO: 4411 - RNA, 96343 nt, Mus musculus
cggaguucgcacugcggcuccagccccggcgaguucucgcccccgcgcagccguugccgaggagaccgcgcucgucucgcggagcguugcgccccccccccccucugcaguucccccgccccccacucuucucccaccacaaugagguccuaagauggcgguggcugcggcgguuggcgccuaguuagcuaauguagagaaggcggccauuggggcuuugggcagucgagggggauuugugggccucccuuccgcggucuuggaggaagaaccgcugccggcggcggcuccuggaggggcggccgaccgccacucggcccuuggcaggaggggcggcuucguuuccagguaacgcggcccugggccaccgcgggccggagcacagggugguucgaggcgggcgcggcgcuggaagcggccuggggccacgccugcccguuuuaacucugaggucccauggcugcgcgauccuuccccacccccaggcugucaucggcuccucucggcgccgacugacacgcuagcucuggcgagcgucugggacgacgcuggcuggcgccuccacgaucuuggggcgucccaugugaggaccgcucgcccggugcuggagauuucaccccccuccaggguggaggggaagguugccuuguaguucggggugaugaguuccgaaagaaacuggccuuggcggcccgaggccccggggaccgccaucccucccagcccacccgccgaauuccauccugggaggggucccgggcggcccggauccuccugggugcagagagucuguggcccgggaguuuucugcggucccuuuuauucuuggagcaggaaggccccuggaggcguuccugacuccugcuaguagguucuuuucgcuaagaaaauguuaauuuaauaauccuucuccgcgcuccucccacugccccuucuucaccccuucgggaagauccaguuucuuuacaucuagaauggguggugggggggcgagggggagacuggggaugggugggugggagggaagcgagauguccagugggauucuggcagccuggcuugcuuugcagagacugcuguuaaggauuagguguucggccccccugugggggcgucugcgugaaccaacuuuuccucucgcgcuagccugguccaaacccaaaacaaaacacaaaacguuuuuuuccuccccuuucuuucauggcgguauuaggauuggugugggaacuacgggugacagaucgugcuuuggcgcuuagaagaagcgggcuuucugggugccccuaccgccuccuacccccgccccauaaccgcuuuccagaccccgccuucgguguucucugguuacuagagccgguguucaagagcuuuuugugcaccugcuucugccuuuucccuaucaccuuccuggucagggccacuggcuggcgucguuaauaccgaauuucgcacuugaagguacaccucgguaaauguaguuaaaaaaaaaaaaagaauucucaugccuaaagcuuuuuuaaaaaauaagagaguaacaaguucuugaauaguuugaguaacagggauuuaaugacuuaaucaggagaguacauuuucuucaagggucuuuagauggcagcugcgggcuauuuucauuauauuccaaagugaguguuaacacccaaagcguuuggaaggaucuuagagacuugggguaucuaaacgucuuuguuaauguaaauugaguuuaaaauuauuuauaaauuacauauuuuuaauuaucugaaacgauaggucauaaauuuagugcuuucuuucuaaguauaaaguguaagaauuuacuggguuuuuaaaauuuuaauaagcagacaguugcuuugaaccguggaacagaaagguauuucugaaauggggaaaauuuguuuuugacaccuuaguguguuaguuucauauguauuaaaguugggaacacuuuauacugggcuaugcugucuaaaagcuggugcaggguugaagggucuauuuaguaagcacacacuuugggugugcagccuucugaccugccauuuugguguaucuucauccuuugagagcugugccgcuccuacuagcuaaauaagaugauuuauacaguaguacuuucugggagucccuugucuuuaauuuuuuuuuuuaaacucauuugaguuugaauugucauaagacaauuauuuggguagcuucaauuuccaaguccauuucucucaaguuauggccuuccacauucuuuaucuggcuuuaucuuucuuucaugaucuuuucugcuugcuuaaauuuguuauaccaacaacugacaggcauugauuuaguuaucugaaauuacuucgaacguuaguagccuugccauauugggauguaaguucaguuaaaguuaaaagaagucaugaaggcugucuagaagauaaauggcuagggcuagcuuauugaucgaguaguugccuagcauguauuauuguucugcauuugcucuccaacaccaaauaaacagaaaugaugguggaugcuuguaaaaauccccucauuagggauauagacgcgggagguuuaagguccccccccacccccgaccugggaugcaugaaaugcuguauaaaaaugaagaaauauaauggcuaaaggaugagaauagaagagauuuuguuuaaaauauuuuagaaguaauugcucuuuaguguguauguauguaugugugcaucaugcaugcgucucucuucagaaggaaucugaaguuacuucucccaugcuguuuuaagaaaagccaggcaagugacauauaccuguagucccaggaguuggguagcugagacaguaggaucaggaauuuggggcuagccuguccuauagagccagacacagucuugaaaaaaaaaaaaucauacacacacacacacacauuaauuguguguuuugucugcauguauguaugugcacuauuucuuugccugguuccagcagaacucagaugagggugucagauucccugggacuguuaaagaggguugugaucaaacugugggugcgggggggggggacggacggacgggggaccugggugaguucagucucucuuuuguguuugaaacagggucucauauaccccauauaggcuggccucuaguucaguguguaguugaggaaaaccuugauuuauuugugcccacuucccaagcacugugaguucagguguaugccaccaugaccugcuagaaauccuauuuuaaaaguuguuuaauucuugcuuucugugaaagcaaacauauuuaaacucccuuaugaggacuagaagugagacuuaugcaggacuacagaccgguaguugauuuauaucucaauuacaguucugcucuuguuuuuuuaugcuggcagguuauaacaaaacaauaggcaaaauggaacuuagaaaaaaaucaaaugugaguguuuaaugccaaaugauugcauuguauugcauuguggcuggcauuuugugagaugaaaaagaauuacacuuauaaaauaauuuuacuaaaaggaaaaauuagggaagauggauaagaguaaugaaauauagaguagcugacuuaauucacaugggaagacuugggcuuuucuuggugagacuugccccauccaugguaaaggagcaaaugucagcugagguggaaaacccagaaaggaacagugacauguaacaguaacuuuuauucuacugaugcaaucaauuguggucuccaagccugcuuggccucaaacuagcucuaacaauauguucuaaucuucuggcuccuucucauucucugucuagcuuguucucucuugaacccgucucaguuaaacucuccugguaaaacuccuuucucuuucucuguuaaguagccucucuuuucucucuccgugagaguuggacauauccuauucugucacaucugucucugauuugucugacaaauuuuguuugccacucaauuagauguaauuuucaagcauguguauuccuucuacaacuaacuuuaccuucauuguuugggauuaaaggugugugcuaagggcugagccacacuacaacuagaaacagguuuuuccaguaaauaacacaaacucgggguucacagugugaacaaacauccugcaacagucauguuaggggauuuuuguuugaagcuaacaggcaaugcauucauuuuauaaauuugagugcuuuuaauacacuguguauugacaaauguuugggagccauugagcaaaauagacaagcuguauuaccccaugacagugcauuuauguguguguguguguguauaaaacuaacuuauaugauuaaagucauguuaaaagucaaagccaaggcaauaucacuuugaaagggugugaguagaagcaaagaaagcagguaauugguguucuagaguuaauagaaggagcaauuaggaaagucaaggaugcuaacaggacauuuuauauuacuugguuuggggcaagaaugcaaaagauuagugaagagaaagaaaaauagcucauuuuuaaaaaaccucugaauuuauuuauuuacuuauuuauuaugugugaauguguguguacuugggcacauagguagaggucagaggacaccuuguagaaucagugcucuccuucauuguauggguucaggagucaaacucagauuguuaggcuugguggcaaguacuuuuaucugcucagagccaccccaccagcucagcuuuuauugaguuuuuauuuuuuaagucuuaaguagaaaggacaauggcaaagaucuccugugggaauguuguuuuuguuguuguuugguggugcaagcuccagggagccuuuugccugugcucucccaguguugagauugcagcuucauaccacagcuauuuuaugugggugcugggaaucugaauucagagccucauccuuuaucaagugcuucgccaacugagcugacucuccaggacuccuuagaaaaguuuuauaggaggagauacuaguaccuuugagaaauuuacugaauguuaauauauugagaauugagacauaugcauauguuauuuggcuuuauaguuuuuccucuuuauaguuuuauuuucaguucucucucucucucucucucucucucucucucucucucucucuguagguugcacaugaguacccauaaaggcuagaugauggcaaauuaccuagaauuggaguuacaggugguugugagccauuugacauaggugcugaaaauggaacucagauccucuuugagaugcaugugcucuuaaucacugagccgucucuccagcuccagcuuucuauauuucuuuuuuacuugugucaggaucucauguugcucagacuggcacugaaccugcuguagccuccugucuccacaaguguuaagauuacagacauaaguugccauaaccgguucuagcuuuaugcuaauuuugcuucaauauuaggguacccuuuaaacauacuuuauauauacuauuagguuuuuuuuuuuuuaacaaaauaucaaccaaucauuuuuaucaguugaagacucaggggccaggugugggaggguuuggggaguggaauuugcuagcucagagaggcagagaaagccagcugaccuuccuucuuagccagcuuccacuucccagcacgaguccccucuuucaugaugccaucucaaaacuucaucuucaaacugagugcuccucccuucuacuuccuauguucugucugucuguccuccugacucccucuuacucuauguuuucuucguaguaauuuugauacuuccugucaacugauuguuugcuccgcuucuugaccuaugguugacuuuauuuaacccuguuuacaauauucaagcagaaggcuccuguauuaaagguuugugcuaaagcugaugcacaccacaacuaaaaacauguuuuucaguagauaacacagucuugggguucauagugugaucagauauccugcaacaauuagguuauuaaauauuguuguaugaguuuuucugaggaaccuaguucacccuacuaaaagaaggcagggacaccacagaaaugauucuauucagcaguagcacauuuaauuagaggguuacuuacaugagcaugggcaggcacgccaucaaagaacagucucuuuuuucccagccauuguuaauuguauauuccuagaguggaguggccugugcaccucaggagacucucuccaugagagacugacaguggucucaguguuacauagauuucaugaucugauuucaaaaugucaccagagcccagagcccagaccucuuccauguuaguacacuuuuagcccucucuuccacaguguucccugagccuuguguaugaguagagagggaaagucauacagauggaugauauuuucucccauuuaauggugagcauuggguuacuuuguuacagcaacagugacuugcucucaguucuuguacugcuuuugaggcucuucuguugcuucuguccaaagcaaaaagaaccuuucccagccaggguugacagcaacaauaguuuaugggcauaaacauaaauguuuagaagaauuuugaugggaagaauuuugaaggugugucauguacauagcuggccauagcucucucauuggggccugucaccuccuuagccacaacuguuuguuuuagaaacauuaaauuuaaaguuuacaccccucuucuggaguuaagccuuaaaacccaccagaaaguaauuuuuauaccucacaaaagucauggcacuuaaaccaaugaguugcaucuugauuugcguucguauggugucaacauaccugaauaguauggagacagcaacccccaguccagccucuauacuuguugguuuuuagggguuucuuagagcacuaagaacgauagccaucaagaagggagcucacacuaauucgauuucucuauuucucuauauucugaccgaugaugugcuguguuaagagauguaggaucuuuuuuuuuuuuuuuuuuucgagacgggguuucucuguguggcccuggcugucuugaaacucacuuuguagaccaggcuggccuugaacucagaaauccaccugccucugccucccgagggcugggauuaaaggcaugugucaccgugcccggcaagauguaggaucuuaacauacaguuacgacaugcaaccaaugucaguggcaauauuuuguauugaaccuuagagggagguagccugcccaugguauugguguuaguaguagucuuguggcuucugagagugccuuuuacaauuaggcauacauauauccuuaacugauauuuuuguuuaccuaggcacagauuauuguagggcuuucuucaccacuuucucaguguuauaauuuaugccuuauccaaccauaaacuuccaagagugccuggccucuguaccuuacgugaauaauuucccauccuuguaccuuuaguuguguuuguacuuucagaugcuuuucuaaaucuguaaggcacucaagcuagcguuagguccucuuaauagaguguagguaggaucucugaaggacuagcauaguuuguucuaggcuugugccauuuagucuugugacucugcaccaaaggccauacaggaucuaagggauacauauacagcuaguaaggcccauuacagcacaaaaagauccaguguuuuuaucaguucuucuuuaaaagggcauuuuuggauacaguuguguggauaggauuguagucuacaauuguucucuaggaauuguuccaccuccucauccuggggcaugugucacauaucccuaccuccugaguaaaggggagguugggagugacacuaugcccgcagccugcucucaguauuggacuuugugggccugucacucugggauagcucugcagccaccacacuuccaguacauuagcuauaccuggcugcaaaaaguaccuuggcugagcaaagugaaucgaguuccguugugcccucagcuaaagaguaaggugaaguguucaggccuaaagccuuccaaaaccucaccaguacagcguuugccugucuuuccauccccccauccccccccaaaccggaacaaaucuuuccacauuugcuuuuguccacaauaauaccuuuuucuuuuuccuucuuacccucuuaauugcuuauauacuucauuaaccugauuuacaggccuaucuaaaucacaucugcugaagccucuucuacuuuuuaaagauacuuacccacugugagguuuggcauagcuacaagauaucuacugucuuaggguuugaauuccugcacaaaacauaaccaagaagcaaguuggggaagaaaggguuuauucagcuuacacugccauguugcuguucaucaccaaaggaagucagguacuuggaggcaggagcugaugcagaggccauggaggaugcuguuuacuggcuggcuuccccuggcuugcucagcuugcucuuuuuuuguuuuuguuuuuuucgagacaggguuucucuguauagcccuggcuguccuggaacuuacuuuguagaccaggcuggccuugaacucagaaaucugccugccucugccucccaagugcugggauuaaaggcgugugcuaccacacgugccucuucaccuugcucucuucuagaacccaggacuaccagcccaggguugccaccaccuacgcagugggcugggcccuccccucuugaucaccaauugagaaaaugccuuacaguuggaucgcauggaggcauuuccucaagggaggcuccuuucucugugauaacuccagcuguggcaaguugacacacaaaaaccagccaguacaccugcaccagaacugaggccuccauugaauuuccuuuuucuuaucucuguagugaacauaauccagucuagcaaggugaaaugaguaucauauacugccuuugucgguaccucauuuucagccuccucuagguuuuucucauguguccaaguuuguuuguuucauuugguuugguuguuuuuaaauucugaggaggguauuuagcacuuauuucuauucuuucuuccuuaggcugucucaccagcuaugagaaauaccaagccaaugacccaucucaucaucaucuugauccucuugauccccuuuagcugucaaagcaaagacuaaaauggaggacauuagcuguaugucuuugcuaggugguuccucccuuacuugggcaaauuucuuugagcagaguucaucaucacuugcaugucuuaccugcugcugcagcuuccuuacaguccuauuccagauguuucuuucaggcaaugcaguguguucucuggugcaucagccauuugaggguaugcuugaacucauuuagaggaucauaauucauuaagaaggcaugccaccuuauaagacagaugaauauagucccuaggcguucugcccugacuuucccuuugggcagauagcuuaguuuuaguuacaagacuuaaaaccuaugguaggaacaguguagcuguuagaacagcaagcaagcacacuguuuggugccacauggagaacugccuuaguggguuuuucuccuugaacaugucuccucagagaguuuuaguuguagcaaggauaauccagcugcuccucuuagacuaauaauuaagcccuuauuuggguauuaaguuuuguugcucuuucuagguagaggugaacaaaaagucugaucauggcuggaugauggaggugcacaccuuuaaucccagcacucaggaggcagaggcaggcagaucucuauggguuggagggcagucugguuuacagagcuaguucuaggacagccagguuuacacaaacccugucucagcccccacuccccacaaaguuugaucacucuguugcucaccaacaacaaaccaaagaaacauccaagccgaugagucagcuuuauuggguuuacuuacaggaauauaggugaccccacauagcuaagucauagggcuagaggggagugguuaugccguguugcucuuucagaggaacugaguuugguuuucagcacccguauauuggguugugagcugccuguauauaaagauaauaucuuaugcacuguguaaaagcauucaccuaucaauagaaugcuuauuggccaauggucugaggccagauuaaaaggugggacaucugacagagagaggaauucuggguuucagucaggcacagggacaugagucuggauauagaagaugguugcgugaaacugaagaccaaguaaucagccacauagugggacuuagaauaaaugggauaauuaagauaugagcuacuuggagaauaggcccaagcuuauggccuaagcauuuaguuauaaauguaagucucagaggcauaauuuuggggaacuuguguaugggugggaaagcccacaguuacaguuagaaaugaugcccaacauggagcaugagccuacaacgacccugagauuaagagucucuugaaauaccgacuaaacuagcuggguaagucaaacuccagggaauccaauauccuucuagucccuguggucccuuauggcauuacauacaugcacacacacacacacaucuuuuaaggucauacucuaguagugaaguccugaaugcuuuguaguuggaguucugccuuuagauagcuuucccucuccuacauacuagagaacucccaagaccacauaagcuggcuuguggaacacaagaaugguaggcacaucagaaggaguuaauugcuagaaucugaagugaaggucuaauccgugaucucaaugagggaauauuaguggguuuaaucuugaacagaucuuaugcacguagcugcucucauuucaggauuguaacagucaugucacgccuggaguccaaaguucacagcaucuaucuguguaacaucauagcuagcaguuuaucuuacuaauccagagagauuuuauguuuuuaaaacauuucuuaauuuauuuugaggaggggcagcucauguagaggucagagaagaguagucaguucucuauaccaugugacaucugaggguaauuguaacucugggggcuuuucuaugccccucuuauucccaauaaaugacacagagaccuuagguuuauuaacaagcugcaagcacuauggcuggguagauacucaucuauucuaacucagucauacuugccuggacuacuucccagccaugugcccaugugaguuugcccuggcuugcucugcuccauuguguguccuuagucccuuggagaccugcucaaggaaaauccuccugguucuucucuuucucucuuuccuuuucccccucucuguccuugggaucccuagcugggauaggaaauucugccugccuucuucuccugcccagcuauuggcuaaucagacuucaucaaccagagaaauggaaaaccgucuuuacacaccacugacauaggagaugauccagucauccugaccgugccagugugcaacagugcagugcagacggcagccagagcucugggcacagaagucagcgucugaagugcacagugcacagaagcaucccugugcauuccugcucugcuucuuuacuuagggcucuaaauuuagcacaaguuuagaauguaaaacauuuucuccucaaauacauuuuuuaguuuguuccaauauacuaguuguugagaaaagauuuaaaaaaaauuugauauuuucuccaauuuauauaguuuuuauuuuagaaauuuauauaguguuuaaaauccaugaucuaugcauacaucuuuagaacaagcugugaguuuuaguuauaaauuuagcauaaguuuaggauguaaaacauuuucuucucaaauauauuuuuaguuuggcagugcugggaucaaauucagggucuuacacaugcuaggcaaacucugaacugcugaguuacaucuccagccuuauuuuugguguucuguuuuuguuuugagauagauuuucacucugaagccaagugugccauugaauuugccaaucucuuuccuuauccuuccuaguacuaggauuucagguuugagcuacaccauggccagcaucuugccaaauacauuccuaauauauauuaaagugggcuuacuuuauaacuuuacuuacagaaaguauaguauaucccauucaaggaaaauuuuaauauuuaagguuuuuugcuuaauaaauaauuguccuauuuacuuauuuuuaaguguguguguguguguguguguguguguguguguguguguguguguguguguucaugcaugaaaguggcugcauuugugccaggaacacauggaauacauagggagguuggguguugauucucaucuuccaucuuguuugagacugggccuuucuuauuggacauugcuguugcccauacauuucuaggcaggagucuccugucugcuuuccaucuccucuauaggagcauugcuuguacuccugcauuaagcuuuugccuaggcuauggggauuugaacucaggcugcugggcuuguguguugaguacuuuaccugacaagccacuuucucagucccacuuuuuccuuuuaaaacaauuugcuuuuagugcuuuuaaauacaggcucacuuuuauugccugucuaauuuugagcuauuucuuauucauccaagauauugcauguagaauauguucaaugacuguucauuguucaaguaagucuuaguucagugugcaugugucuauggguauuaauuauuuuaaaaguuuuucaauauauuucuaacaugcaauaguguaaaugauuguguuaaauuauauaaauaagagaaaaaagguaaaaguuacuguauuucucauucauaauuaguaauuaagcauaugcauaauuuucgauguuguuuuuuuccucucauguaacuucuccauaaauaaagaugcugcauugucuagccuuuauaauugauacauuuggaaggaugcuuagcauucuaaaaaucaguggauguaaaacuguuggccugguagcguuuauccugucauuucauaggauaacauccaguuacuuuuuaaguuuagcaugcuuaaagcccaauguuaccuccuugccccuuauuuaagacaggcuagauauggagagguauauucacugggauguaacaguuuuguucuuuuuuggguguguguguguguguuacuguguagcucuggcuguccuggaauuugcucuguagauuaaguuggccuugaaccauagagaucugccugccucuggcuccagagugcugcugggauuuaaggugugugaguuuugauucuugguacauuauugccaaaaugccuucuagaaagaugauaccaguuuauauuccugcaguagcugaggauucauuuugcuuuuagugucagucaguauuagaaaauaauuuauguggaauuuagcaaguuuaauacuuuauuuucccuugcaguuggauuuuauuuuuauuuuauauacuuuuuaucuuguuuuucuuuuuuguaaagauguugggggcuguagauguggcucagcuagugagagcauuuacuguucuugcagaggauccuaccuugguucucaguguguuaacuauauauuucauacuucucagauuccuucccccaaucuaucauuuucucuugucagaauuuuuugagacugacuuuuaauguaaauacaaucugagauauuucuuauuuguguucuaaauuuagugagacgacuucuuguuuaaaaaaaaguguuuuuuuuucuuucauuuggcuuuaugaaagucccauuucauugacacuucuguuuuuaauauguuuauuaucuugguguuggguaaaaugagcuuucucuaugugaaauggcuaaagcuuuaaugacaaagaccuuuuuuugacauuuuucuguuaacuuuuaggaaguaaugauauagaaauauauugggcuauaucuuugggagaugugggaaaacuauggcuaaauacuguuucuguggugugcuguguucuagcuaaggacauguguuaaagcucuuaagucucuguuaggaaauuguacagucuguugaacagucauauauuacaaaguuugagggauaaaauucuuaaugcugugcuuuaccucuguuaacaauuauuacuaauuuugucuaguugaauguaucuuuuggauuauugcaucauuuuuccucuuuaaaauuguucuuggugauaucuugauguucuauacuuuuuaaaauguauguucuuuagcaauauuuucuuuuuccuauuauuacuuguguuucauauuuuucugcuugauagaauuuuuuaaauagggucagguaacagauauacugcauuuuuauuuuaauaagauuuuccucuaugucuuaaagaauaauguugauagcauauaguaugcuuuuuaauuucgggagguggcucacuugguaaaaugcuuguauuacaaaugcaaggaauugaaugacuuaagugugguccccaaaauccaagugaaaaugcugggccugaugcccagccagcuaguuuaaccuaauugauggauuccuggcuaaagaggaaucaugucucaagggagggggcuggugguauuuaagauaacaccugaaauugucuuacagucuccauauguauccucccacacaugaaugcccccccacauauacuuacuuacauguccauaaaaagaagauaugcuucuuuucaauaucuccgagaauuauuaaaauaguagcagugcuagagcacuugccugccacauguaaggccucaggcucucuacucagcaccaaaaagagagauggcuuccaaaacaaacacagaauauguaacaguaaguaaguauuauauuugaagauguucaaguuagauggauagugguggcacacgccuuuaaucccagcacucaggaggcagaggcaggcggauuucugaguucaaggccagccuggucuacagagugaauuccaggacugccagggcuauacagagaaacccugucucagaaaacucaaaaaaagaaaaaagaaagaaaaaaaaaaagaaaaacgaaaaaagaaaaaaaagauuuucaaguuaauauuguguugaauuuuaugucacuauuuuuagauaaaauuuuaauaugauucuaguaaaauuaucugccuguuaaaguuuauuucuuuuguuuguaguuagugacuuucuguacuaaaguuauccccauguuuccuccuuuaucugcccuccuuucaacaugguagguaauccauaguagaaauccacaaucuuccuuaagagcacuuggaaaccguucucauggucacuccggccucugagccucugcuuccgugucagcuucuauuucuccucucugauccaggcaucauauuuaguacccuuaguuuuuauauguauauguacuccaugggguguauugcuaggguuguccgcacuucuaauucuagugcuuggggcucuaagacagcccaacucaaagccagccugggcuauauaggaagcccaaucugagaaaauaaacagggccuauggagaaggucaucagauagagacaugccugucccaaaaccugacaaccuaaauucaauccccaaguuccacagcggaaguagagaacggccuccugcagguuaucuuuuggccuccauacuugcauuguggaguauggauggauggauggaugaaugaaugaauguaauuaaauccucagacaacaacacuaucaaagauuaaaaaaauaauucugaagccaaaaaccgcugcaaggaggauuuaugaguuuggcagacuucagggagauugacacaacacuaugagagacaguaagcacucauugaaauguguuuagugcauuuguucuguuuuauuuggaacaaacuuuauuuuaaauagcuuacuauaagcucaggcuggucuagaacaccugauucucauacuuaccuccuaguacugcgauuauaagcaugugcuaccaucuccauuauauaauguguauaucauguagaucaauuuaucugugauacguguuugauaguguauucuuuuauauuuuugguugugagccuagccuuuaacagcugagccaucucuccagcucgauaguguauucuuuaagauaaguguuugaaagauuccuuuauauuaauaaguuugauagaaugcuuuaaaaucugaagaugguucagcauaugaaagugcuugccauacaaaccugaugaccucagaucacacaguggcaggagagaacugacuccagauaguugcucugaccucugcacacaugcuaugguacauacaugucugcacuuacauacaaaaacaugcauauacacaauauaauuauuaguacauuuuauaauaaaauaaaguuugucuuucuguguuaaaaauuaauuuuuacuuauuuugcagagaauuaauuaaaggcaacauggccacaggaggagguccuuuugaagaagucaugcaugaucaggacuuaccaaacuggagcaaugacaguguggaugaccgacucaacaauaugguaugauguuuuacucugggugguauauuguugaccacuaauguucagugaggcucucccaucgauuguauuuacugaaacucuguaaaaacuguaggcagauagacuaagggacucuugguugaagacacuuuagcuguaguuaauagaaagcaugaauuagcuuaaacaaaaaaugauuuauuaaaaggaggugaaagugcuuuauggaagccauguuaaagaguauagcucaguuuuaggaaaggaaaaagaaacagcagaguuguucgaaauugcuuuucaccucugugccugugcuucuaagaccuuuucccuaaccgagcuuucccuucuagaucugccuucuuucucucucugcuuugugucauauauugagauggccuuuuuaaagauuugcagccauggaggaacuuauauaaugacuaauuuaacauuaugauuaucuagcuaaauuuguuuagaucuccuuuuuucacuuaucaggaucaugaaagggaugaauuaaauaauauaaaagguucacaggacuacccauacauggaacaguuccucgaggggcaaaauuuccuagaagugaugacaguacuaagcaguuuuauuauaguaguaguuaaucaucuuccaguauggauaauguaggaaugcauaguugguuuuuuuuuuuuuaaugaauucaguuaugaagguaugaguaaauguaaguauuuucuaguuaaaauagcauuuuguucugaauuuauauaguauguaguagauuuuugccuauaaaauacuaauggggacaguaguaguuauacuggugcuugccaagugcuagguauuauucuaaauauucauacauauuuuuaaucuuauuuuuaaggugcccuauuuuaaagguuaaaaaagcgaucccaugugaaauuacgggauuugccuaguguuucuuuagugguaauugcuuuagaaccuaggucaauuguauuucuaucuuuuuuguuauacauacagauuuucaacuaaaggagaccuguuaaagacguauuuauuucacuacuuaauuuagaacaguuuuuuuuuuaaccuuuuuaagguaaagguuuuacuauacagcccaagcuagcugcccuugaauucuuuuaaacauuccagcuuuuuuuucucagucccucaguguugagauuuauugauaucagaacagauagauggaaagaagaguuuuuagaaaugcuuuugaggugggccuaguagugcaucccuguagucuuauacacguagacaauugauagacugaaauaggagaaucaugaguucaagaauaaccuggauuguauggugaauucaaggcagucagaaccaacaagaccuuauuucaaaaaagaaacuauugaaaauauuuaaauugauuugcauauugagauuugugauuuggagcuuaauauuuauuaucaguaauaggaagguaauaggcuuuuuaaagaucaagcugaaauauuaggauagauguaauaaugaaaaacaaacaaacaaacaaaacagauuucacagaaauaaaucucuaagguagaguauuugugugugaaaaugucuuggaauuuuaauauccacaucaaaguucuguuuuuguuuuuugaacauacuaaauuauuuuucugguuugaauuggucagauuaacuuuugcuuuuacuuuuuuaaaggagugggguggccaacagaagaaggccaauagaucaucagaaaagaauaagaaaaaguuugguguagcaagugauaagaggguaacuaacgcuauuucuccggagucaucgccaggaguuggaaggcgaagaacaaagauuccacauacguuuccacacagcagauauaugacucagaugucuguuccagagcaggcagaacuagagaaacuuaaacagcggauaaacuucagugauuuagaucagguucgugaauugcuuucaaaauaagauauaaggugggaaauacuugaaauggauuaaguaguguaucuuaagaauaaaagauugggaagaguaaaaguuucucuaucugugggaagaauuuuaaauucugaagaugagaagcaaaguugagaagcaaaguuacauuuuuacauuugccaaagcuacuucucucuggguuauuuucuaauagcuagcuuaaauuaugaaaguagauuuagcuaaguagauaaguuuagcauauuuauuggauaagugugaaugugauuaguuauauaaaguuuagaauauaacuaacuuauaauaaaguucacuaaaaugaaauuuagaucuaauggcaaauagaaaugauaauaaucucuucacugguauuuuuaccaguauuuuauugucacaucucugucuugcagagguagagguuuucaaacauauagaauaauagguucaagucuaauaugacagugaucauguaaaugauuauguaaauguacuauauacacauaugccaggcacugaacugauuugugugugcauguguauguguauaugguguuggagauuaaaccuagggucuuaaagauacuuuguaaacagucugucuugcuguauugccaauucuaaacuccuuuuucagauaguguuucauguaaaucaaucauugugcuuauauucuauuaguuaauaccaauucauuggauccaacaccuauacgaauuuuguuaaauaaauagcgauauggacuauaauguagcccacaguacuuguguuagacuaaucuuauucauauuuaucaacugcauuaucucaaaaaaugagaguaauaacauuuugauaauguagcauaauuuuguagaucugaagcucaaaguucuuuuacaaaacuauagacaccucaucuaaccgugaaacuaagaacaguggaauccuaaaaauuuguugaaagauuaauguuuaugugauuugguuuccuuuuuguguauagagaaguauuggaagugauucucaagguagagcaacagcggcuaacaacaaacgucagcuuagugaaaaccgaaagcccuucaacuuuuugccuaugcagauuaauacuaacaagagcaaggaugcuacugcaagucuuccaaagagagagaugacaacgucagcacagugcaaagaguuguuugcuucugcucuaaguaaugaccuuuugcaaaacugucaagucucugaagaagaugggagaggggagccugcaauggagagcagccagguaauaaaauggcuuuaucuaaaaggauagacaugaagauccaagcggauuaggcaaugcauguagaaauuucaguuagguggaauuagcuuuucucuagcccucuucaauaaucuacuauauuuauuuuaaguagaaugauacuuuauuucuaaaugguugggaaauuacauauuuguguucauuaaaucucuaacuugugaaauacugaacugcuaauuuuuuuuuaaagauuuauuuauuuacuauauguaaguacacuguagcuguuuucagacacaccagaagagggcaucagaucucauuacggaugguugugagccaccaugugguuucugggauuugaacucaggaccuucggaaaagcagucagugcucuuaaccacugugccaucucuucagcccuaaacugcuaauuuuuaguaaagggguauuggaaucaguaugauuaggcuuuuuaaaaaagaauuuuuuuuucaguguagcuauuggggcugaagagauggcucagugguuaagggcucauauggcucuuguagaagacucaaguuugguugccaacauacagacuagauaguucacaucuccugaaacucuggcucuaggaagaucugauaggucugcucuucacagguaccugugcucacaugcacugccuacauacauguauacaacuaaaguaaagucaaucacgaauaaaagaguaagacaguguugauauuuuuggaaaauauuuucaaaaauauacuacuuuuuuauuuuuauuuauuauuauacauaaauucacuguagcugacuucagacacaccagaagaaagcgucagaucucauuaugggugguugugagccaccaugugguugcugggauuugaacucaggaccuuuggaagagcagucagugcccuuacccgcugagccaucucaccagccuccaaaggaugcuacuuuuaauuuuacuuuuauaauacuaccaauuauuuguaaagagauagaacuauuaaaggacuguuuaggggcagugagauggcguggaggguaaaggugcuugcugugcaaaccuggcaaccugaauaugaucccuggagcccacguaaagguggaaggagagaacauagugcacuuaggccucuggcacaugugugcauacguauucauauaucauugugcacaugggagacccccaccccugccaccuguggaauagauaauuucucagcaauuuguuuuguaaacacaauuuuugggccuggugagauuacuuauugggggaaccuacagugcuuggguccuggcacucuguagggacaaugagggaaugaggaaagaacagccacauggcugugcugcugugaacuauaggacuucacucacugggccuccucugcugucuacacacugcacuugaguguucaguacccggaaaucacguaaaauagaaggacaacaccaacuccaugcaauuuuacagauaauauaaacuaaaauaguuuuauaauucguuacuuuuagauugauggugauugaaguuuauugacuauuauguuuucauuuuuaaaaaucuaaguuuaaagauuucuugccuguauaaauuuauaugguaaaccuaaauauauguuugcuugauaacacuauugcuauaaauuaugcugguguuauauguuguauauugccauucuuauuuuucuuuuuaauauuuuccuacagauuguaagcaggcuuguucaaauccgugacuauauuacuaaagcuaguucuaugcgagaagaucuuguagagaaaaaugaaagaucugccaauguugagcgucuuacucaucuaauagagcaucuuaaagagcaagaaaagucauauaugaaauuucuccagaaaauccuuguaaguuuuagacuuuaagugauguauguuauuuuuaugauguaccauguacaaauacugaugacauucugaugucacuccagacgaguuaacauauuuucaaaaucgugccauccauuauaacauuuuuauugccguuuuuaauaguuguaugauuuauaccacuaaaauauuucaggcuagagaaaaugaggaggaggauguucggacuguagacucagcugugggaucugguucuguagcugagagcacaucgcuaaacgcagaugugcagucugaggcuucagauaccacgguaagccgcuuuuugguaauuaaagugcuggaaaugaagauuuaagguuuuccuccaguuuucaagaugauaguuuuuggcauucuuuaguaaaaaguguacucuaggaaagaaauguuaauguauauauaguuucuaaacacaaguuugaaagcuuuacuacaaacauuguuggaaauccagucauuuuuagauuucgcuuacacagaaaugucaguaaaguugguuuugcucagcacagguuuccuggcuuuaagaagcauuggcaaacuuagauucauuguagguauaaaacuguuaguaucacuugggugugauacucaugaauauuaagcauguaauugcuggagaaguuuuuauguucauuuucuggugaggacucauuuuaaaugugcuaagauuuuugaaaaguucucaugcuguaguacuuuagcaaagcuagaugucuaaaacguugaaauaacagcuaguaaaugagacaggauauuguuaacauuauuuacucucaaugaagaaaaaguaaugugguuucugacuauaaaauaaaauuaauaaaacauuuuccccuugggaaagaguaauuuauaggacucuggagaaagaaaagguuauaagauugauuuaguucaaagaauguacuguauuucaaaacugcuuggcuuuuaaacacuuuuauuugaacagaugugcacuucccugaagugcaugugcuaacuacuacacuauggaagcaacacucuaaucauacacguguguaacugucaaacacguagcacuacuaaaguaagccuuucuuuguaaugauuagcacccauguauugauuuuuguaauauauuucaagauaccauucagcacuaggaauuugaggguuuguuuccuuuuauuacugcucugcaaauuuuaccuguuucuuuucuccucccuauccuuccuauuuaaccuuuuuuaaaguaagaaauuugauuuuuuuuucuuuuuauuuaggaaauacucgggguuugauccaaacaguuguugaaaauggauucugcugugggaaauuguuuucuguucauagugguccugggaauaguuucucucuucauaccaggagaagcagaaggguuaggguuggcugauaaaggauuuuauaggagaggaauguuacaguugauuguaauuuacauacuaaaauccaaaguauuuacugugaugagaauuuccuucauaaugauaaaaaaucauggccuuuuguaaauuguuauguaccaaauaaauguuaaaauaugcuuuagcaguuuucuauacuuaagacuugucgcagauauaacacuugcuuauauuuaguaaguaacuuuauucuauagaaacuuaagagucuaauuaaauuuacuuccucuuggggauggcuuuggguuaaauuuauuuuuaaggugaaacgagacauuuuuguauuuauuuacaaggcuggcuuauauguuaaacaggaguuuguguuaacuuaauauguuacacuauuuaaugaaggaggcaucuuuuagucuugagaauucggcccugcauugaggacaaacuagggaauucagcuucccaagaacagguuucagacauugauguuacuacaaguccuaaagggaaaggugacaaagcuccucagaaugacagggaacugagaccuaauaggaaauguagccgaaaacguggauuucccucaaagguauacuucacaauguuaacuugggaagucuuuaaaugagcagcagcaauguaguucuauuucuucuuuauuuguuuuucuguuaacggcuauuacucuuaacacuaaauuaucuacuccauugauauacuguaaucuguuuuaguaaaaugcuguugcuaaguguuuuuaaaucuuuuugcuuuagaauacaccucugcauggauaaaauaugguagcugauuuugauuuauuauaaauuauagaauaauuuguucuuuuugcuauuaaaguuuuaagcuauauaaaacauuuuaaaaucuuuuuguuaaguugcucuuguuuauaauacuauuauuuaugaauucgaaagauacuuuaacuuuuuguauuauuacuauaaauagagaaaaagaaaacaguacaagauguccugguuuucuguccuucauggaagacaugcuuuuuccugcuuuuggcuuauauuuauuuguguuccuguuuaaaaucuuuucuucuuccucucucucccucuuggaaaaaaauuaguugauuugcucauugguguuuuaauguuuugcuagauuuucuuuuucaguguuugauuuuaauguuuuuuguuuuaguuuccugugauuuguauaaaagcacuuaagugaagaaggcaguuucuguaguucuucuaauacauuugaaagaaauagcacuuguaaaagcauguguauccuuuuagcaagaguuaaauaucgauuuauuaguuuaggauacaccauaguaauuucagaaguuuuauugucugcuugucaccaaugaucauuuuuuacuuuauaguuauauuuucuucuuuccuucuuuucauucuuuuucauuuuucuuuuuucuuuuuuuuuuuauguuuaagaugaugaaacaaccucaaauauuuuggcaguuuuuuuuuuauuauuacuuuuuuugguguguugagggguugucuuuaguuauacaaagcauuaagcuuaaguuaccccuuuaagcagaaaagugccugguuaucuuuagacuuaauagcauugaaggggcaaaaaggaaugugaacuacuccagguaugcauuaaaauuugucuuucuuucuuauacaauugccagacacuguagcauguuuaccaggucuucuuucacccugugguaguucauuaacaaacaaacaaacaaacaaacaaacaaccuuccaaagcccuucuguuucugucucuuggaaaguauucuuacaaauaagaauaauuauaacuuaaacuuguucagggauuugucacaauuuaacuauacuuuaucuugaucuuuuaaaacaaaauuuuuauuuuuauugugugugaguguaugccuguggugggccacaacaugcuuguggaggacaaccuuuauugcucucccuagacaauguggguccucaggauugacucaggccaucagacucaaugcuuagcuguaagacaagcucuguagucugcugagccauccugccaacccuagucuugguuauuaauguuauccuaaugcagcacacccuaacuuguacauaauucacaaaugauuuuaauuaaauaaaaccucacuugguaucacuugacuuuuaaguuuguuuucuguuuauagaaucuguuaacucucacuccuuccaguucgucccucuaagagaccuuuuaaaauagaguguguuugaagaguagagggaaagguuucagauugauucuauguuagauuccgagcugaaaacagccuuaugaguugcagguugauauaaaaugauaacuaucuacaaagacugauauuuuugguguauuuuauagauguaauguuuuguauccuguaacagcuucauguauaccuaccuauccuuugugagaggaguacugucccaccauuguuuugagacagugccucucacuggcuuguaacuggaccaaauaaaccagugagauuggccauggguuccacguaucugcuucuccccaccuuugaaggagcaaguuuauaaguguggaccacuaguucuagccuuuuucuaaaaaaaaaauauagguucugaggauccaacucaaguucuuaugcuuauaaggcaagcaguucaauuugccuccucccaaucccccugcuuuuaaagacagggucuuacuguguagcuaggguacaacucauggcuaggguggaacucauauagaccacacuggccuugaauucagaguuauagcugccucugccucucaaguacugagauuuaaggcaugugccacuacagccagcuagcuucucagcuuucuucauaguugauugugacuacuaaucugaaauguaaacuauguguguauaaaaggugugaggugucaucaaccugcacuaaacuucuagucucaucuuaauaguuaauccucugaauaguuaacuguacuuucuucacuuuucccccauuucuaagucacaauguaagauguugucauggcuacccagucuuauuuacaauauugaugguucuacuuggaggagguagauggaagaggcuuuguguaacgcuggugaaggaugucauccagaaggaaacuuguugagcugucuguauucccugugguuucucuagaaaucucauuugcccagggagaguagaucaguguauucauuuguacuuucaaaagaaaucauuuaacuuuuuacuugcuuuaguaauuuuaggggagaaaucauuuaaaauuuuauauucccaacaaaaauuuguuaguguggcaaauuugaaaccaaaucaauacauuaaagggaauauuuuuuugucaauggauuaaaauaauagaacuuuaaaauauuuugaugguaaaucauuuaugaagaauaucuuuacaauauauuuuauauauaacuuggcuuaaaauuuauuguuuggggcuguauuuacauuucuguuuuugauuaguuuuguucagcuguguuuuaaauuuuaauuuuguguauguguuuuguuuuguuuguuuguuuuuugaacacauguggccuuaaagcaagaacuuuaccacuaagccauaucaucagcccacuuggucauuacuucuuuaaauuuuucuuuuaaaauauuguuuuguuuugcauguauaaguguuuuaccuguauguaugaguggguauccuaugcaugucugaugcccacagagaucagaagaggguguucgagccuaggaacuagaguuacaggugguggugaaccucugggaguggugggaagugaaccugggcuggguccuaugcaagaguaacaagcguguguaacugcugagucaucuccacccccauugguaguuucuucuaaguagucccuauucaaaucuuuuauguugcauauagagaggaugauaaauuuuuauuguauuggggaagucuuccagauucaguuuaugccccaaacucagcuaaauggauguaauuuaagaguuaaaaacuaauaaaaccacuugauacaaaauagaguuuucugcuuuguuauauauuuaaugugcuucauuuaggccuuuuuacauaagauaaucaaauauauuuaaaaauucuugaccuugguuagaaguuggaauauuuacucucugugucucugucuucucuccugcccucacuuacuuugcuuuuguuguguauguggaaaguuaucuucuggaauggguagaaaguuuugcuaccugauaguuuguagagaaaaucuuugagaacauuaacucaguauaauuuguaauucccuauuauuuugucugcaguauguauagcuccauuugccuuccuauacuuugaaaccuucugcuuucuaagaguuuuauucucuuccuuuuaacuccucauaguuuuucacuguaaaauuacucaauuuuuaguaugggacauaccaguuuucuaagucuauuaaaacuguaucuagacuuguguauuuaauugaaacuaguaucugcuguacuuugccauuggcaaaugaaacagggccauggauuucaacugucagguauuaguauuguuggucuuauuuuucaggccagagauccucagcaggagccuauggaagagacagaaaauuugaagaaacaacaugauuuauuaaaaagaauguuacaacagcaggagcagcugcgagcucugcagggccgacaggcugcucuucuagcuuugcagcauaaagcagagcaagcuauagcugugauggaugacucugguaugugauagucacagaauaauugcuuuagaagaaaggcucauuauuacaaaaugaauugcuauuacuguauuaucagaucucgguuguugacuaguguagcaaccugcaagccagguuuacucuguucugugcuuuucucugguuauacagaagagguugcaggaacaacuccuggcuaucauaccguacagacagaguaucuuugagagguaaaacagacaggccuguauauaguacuguuuuguaaccucagggugauagggaucuuguuuuuuuuuguuuccacuuugcaggaauuacugcuguuuuguuuuguuuuuguuuuaaaucucacucagcuaagauuguuguuuauuugucuugcaaagaagguuuaaaaaauaauaagcaagccaggccugguaucauaacaccuguaaucccagcacacugaagucugaggcaaggaggcucaaagaauucuuaggguacagggagauggcucaguugguaaagugcuuguuccccaagcaugaggaccuuaguuuggauccucaacaagcacauuaaagccaagucaucuguaguccccgcuccagaaggaacggagacaagagggucccugggguucuguggucuagccaguugaugagcuuugggcucagugaguaauccugucucaaaaauaauauggagagugacuaaggaagauaaccaaaaucaaccucugacguacacauauguguacauagccucccuucucuauaauacuucauagugaaauugccucauaaaauaaaguagggagggcucuagguuugccagcuuaaguaugcccugaguucagucccuagccccuggagaaaacauaaacagagaaagucuaauaaggaaguaaauuaauggagcauguuuacuauuuaauguuagcaguucuguuauuucauuuagaaauccaguuguaguuaugaacuuuuaaagcugcuauuguacuuuacucaguauuuggugagacucaaagcuuuuuuucuuuuuccuucagagcuguauauaacuauaagugacaauagaauugauuaguauugagucaccuguuuuguuauuagguuaaaaguaagauuguugcuuauuaaaacucaauaaaagcuaagguuuuuuuuuuuaguuuuauuuuuuaauugacagauaacaauuguauauauuugcaaaguaauauaauagacuuccauuggcuuaauuauaauuauguuuucguaucaauucucaguuuaucuuugagcauuauaauuaggccaguauuuuauuauuauuauuauuuauuugcuuuuuguaaguuucaugaagguugccuacaagauuguggguugcuuacagguuuaugggcaacuaaccaguggcugcacuacugaaguagugucuguaucaugcucacagccguuaacugccugugcauccuguggagcaguggggcucacaaaguuccuaauuucuucucuacaaucuugaguaguugaauuuacaucaucuuguuggaucaucagaauuguaggcuacuggcuaaggcuuuuuacccuugggacuguuucauagaaaaggaugucaaacagagucucuuacuuggcuaggcuuuauauagagaauauuaguagaaagcuauugaauuuuagguuaaaauauacaaauaauuucuuuuacaaaaauaaacuauuaggaauuucaauuaaaggcuguaauuaggagauuuauauuugagcuuuauauacuucuucaacaagaacuuuagcuuaauuuuaaaacaguuuuuccuuguguuuuaugaaauuuuacaguagaaaacugaugaaagcaaggguuaguguuucuaauuuguucggagacacaacacaucuuccuuagagaaggagugcuuuuuuuuuuuuacuguccagaaaguuguuuguuaauuaucugaauuguaauguugguguuuuccacagagaguuuagacuagaaaaagauuucugucagucucaaauacuaguuuuuaguuuuugguuguuauuguuuugguuuguuuguuugcuguagcagaaaaugaugcuauuuucuuuuaaaaaaaagcauuuuguagcuucuggcuuuuagcauugaaaggcuaaaaagauggcuucuggcuuuuaaaaauuaaaaggcuaaaggauaaagaugggguacuggguaguagagcaguagguauugucaguauugucuucagaaacgugcuuuaggagggugagaggauuuuuguuguuuuauuuuuaaugaagaugauaaaacauguggguuuuuguuguuguuguuuauuuauuuuauguauacgaguacacuauagcugucuucagacacaccagaagagugcaucugaucccauuagagaugguugugagccaccaugugguuccugggaauugaacuuaugaccucuggaagagcaagcacucagugcucuuaaccgcugagccaucucuccagccuguggucuuuagugacacugcucuaucacaagcagcuacuucaauaaauuuaucuauucagcugugggaguacaaagcuuggcuagcuggauuuggucuacuuuauggcaugguuuuauggaacacugucaaucuuauuuacauauugcuaauuuuuuuuugccuauuauuuaaugggagaaauggggguugaggcaagagcuguauuccagagagccaugcuacuuuucagucuauacuuuguagaaaaacaugcccauuccugaauugcaguauugguuuucuuggaggaggcagagucagcacuguuccuucuaucugauaaagccuuccuaucucugaccagccaaaucacauuuauuaauugggacuacaauccuagcuuuucuuguaaguugagauugaaaaacuugagucacuagaguuuagcaguugucucaguuuucuguuuuuagauauaaacuaauaaacugauuggcugagagauaaguaagguaacuaaaaguuucauauuaguguuagguugaaguucucccccuuuacaauguaugcuucacuuggggcuucucuauacugaauauaguauuaaauuuuguuuucaguuguuacagaaacuacaggaagcuuaucuggagucagcaucacaucugaacuaaaugaagaacugaaugauuuaauucagcguuuccauaaucagcuucgugauucucaggugauuagauucuauaguuaaguuuagaaaucacauuaguuaacccaguggaucaacuaaucaagccucaguaaacauaaauaucaccugacuugacugaauaaaaacaauggagcugggugguaguggggcacaauuuuaauccaagcacuugggaggcagagacagcugggucugugaguucaaagccagccuugucuacagagugaguuccaggaaagccagggcuacacagagaaacccugucuugaaaaacaaaaaagggggaaaaauggauacagaauccgucaaccuccaaaauaugauuuguaagauuugagugggccccauaugauucuuaacacuaucuuuugagaaauucuagguuagaggaaaauguacuuuguuaagaucuauuuuauuuuauuuguauauguguaccugaauguguguguguaucauaugcauacagaggucagaagaggacaacagauccccugggacuaguguuacaguaauuguuacugccugauguacaugcuaggaccuggguccucuguaagagcagcaaagugcucuuaaccagugagccauggauccacacccagaaaagcuaauuuaacuaugcugaguaguacagguauuuucucuguguaggcuguuagauaagcauuccuuugaccucuuuuaaacacuaggugguuauaaccuuugagacuugaaguuaggcuuuagucccagcacugggaggcagaagcagauggagcuauggauucaaggccagccuggucuacauugugcgaucuaggacagccagggcuacguaaugagacccuggcuuaaaaaauaaacaaacagagacuuaaaauuuuuuuuuagguuuuguuguuguuuauuugguugauuuuuuuuuuuuuugcauuuuguuguuuuaauuagguauuuucuucauuuacauuuccaaugcuaucccaaaagucccccagacacccccccccuccccuacccacccacucccacuucuuagcccuggcguuccccuguacugaggcauauaaaguuugcaagaccagggggccucucuucccaaugauaggggagccauuuugguuccuggaucccuuaaaauuaguuuuaaguuuaugcccuugcguuauuuuaucuuccugacaauuuuaagaaaggcuuuugaguaauuuuguuugguuuaguauugaagcaaagucuuacuuuguaagacaggcugacaucacauuuuucauuuucugugcuagccucuuaaagcacuaugauuacaggcuugugcugccauaucuagcaggacaauuuuagaauuaauaauguuuuaguuuugugaacuuuguaaaauaauuauaugcauguaaauuuugaguguagaaucuggagaagaaugggugaacauugccucucacugggaaagguagugaugcuuguuuugcccaccaagaaaauaaggugagccauucauuuuagacaguuaucuagcaaagguuaguaaaguuuucuaaugaucccugucagaccuuauguaaagacgcucuccgguaaucgaagaacauagguauaagauuguuaguggaaggaugguauuaauaacaaaauaggaaacaaaauaaaugucaacguacaguaaaaugcaacuuaauuuauuuguuuuaaauauuuuccuucuucuuuuuuuuuuaaacuuaagccuccagcuguuccagacaacagaagacaggcagaaagucuuucauuaacuagagagauuucucagagcagaaaucccucaguuucugaacauuuaccugaugagaaaguacagcuuuuuagcaaaaugagaguacuacaggaaaagaaacagaaaauggacaaauuacuuggagaacuucauaaccuucgagaucagcaucugaacaacucaucaugugaguaaaucugauacagcaauauuauguaaagggcauauaaguacacaugcuggcacaugguaguuacuuaguauguauuugauagguuaauaacuaguuugaaaaaauaaucuuugaaaaagaaaaucuugaaucugaaaagccuuuuaauaagccaguaugugauaagaaucaaauagauguuaaauuuauucauaaaagaaaaaaugaaguuggagggauaauuuagaacuagucucucguuaaauuaucaacccuaguucucuccccacaguaauaggagcucuuaagugcuggaacuuggaaucagcuuggguaaccccagcuggccauuauuacuauaacauucccauuuuugucugaaugaaaaaauuaaaauggauaggaacaccauuuuuagaauccccauucuugaccuggaaagaugguucagcagccaaaagcacuuacugcucuugcagagaauccagguuugguucucagaucugacauuaagcagcuccgaacugccuaucauuccaguuccaggggaucugauggucucuggguuuuaugggcaccuacaugcaugugaugaacauaaauucacacagguacauauauauaaaauauaaauaaaucauucaaaauaacaaaagaaucggauguucucuuuuguguuuugagauaagauuuuacaauggcagucaggcccacuucaaauuuucaguauuccugcuucaaucucugcaggucugggauuauauguuugcauugccacauccaucuuggaauauuaguucuuuauucuucacauaucuccuguuucucugcuauuugugcccugaaacacacucauuucacccgucuucaucucagcuaccuuucucuuccuguagaggauaguauuaguuguuaacguuuaagaacagaggaagacaacuaaggaaaaguuaagauuugaaaggucucuuuauggcuuugucucaguuuuauauacaaagaaagucauacuuugcugccugacaacucuuaagaaacuacuccuagaaaagcauguaagagcugaaguaaaagaaagagugauuaaagacuaguauaacgagaccauuggaaaccaacuguaauaauuguggcauuaaacugagaaguaaacaaugauagguccauugaggaagaaauaaauggcuguaguuuugaaguaguuagagguagaaaauuacagucuuaacaauuaccugcuaggauuggccuuuuguguucuauacaucagacauagugacucacucucuuuaaucucagauaaauuuauccuguguuuuuuuuuauuguuuuucuagcauauacaauuguaauucuuaucaguuucugucuuguuuuaaccuuguauuuuaaucuaguagcuguaaugcaaaaguucuagacagucuggaaggaggaaguaaaaauacuuuuccuuguguauuuugauguguuuaguuguugagguauguuaacauguggccuauguauguauauaagcuuucaaaauuuaaaucugcagauuuuaagaugcuaacuaauuuuauuuucuuugugagaauccagacuguaaauauaugcugguucauaccaugcuuagucugcugauugcuuauuuuucuucucucuuuuauaguugugccuucaacuucucuccaaagaaguggggauaagagaaguucaacuguagcucucucugcuccugugggcuuugcaucagcugucaauggagaggccaauagucuuaucucaucuguucccuguccugccaccucucuaguuucucagaaugagagugaaaaugaaggucaucuaaauccagcugaaaaacuacaguaaaauacuuuuugcaaucauucuucacaucuauuaaauagcuaaauaaugaggauaauauuuuaaacuugaaaauuuauaagaaacugaaguuuaauaagauacacauucuuaagauauaugguagaaggagauguaauaucugugaaucuuaucaguuggcuaaaagaaauaggcauugaucagguaguuucugaaaccugcuguuaaucauuuuucagggaaaggguuacaaauagcaagaacuauagguaaaauauuuuaauauucaaacaagcccuacgcucuagagccauaccccugaaacuauauuauacaagacugugucagugugagcaaaacacuuagaaaacacaggggugauauaugacauucaguucaugcuguuggaguuuucuuuugcuuuuuguuuuuguguguuuugagacaguaucucacuauauagccagucuuugcugguuuggaacucacuguauagacuagucuggccugccucugcuuccuaaguuuugggauuaaagacaugugacaacauguucaguugaaacuauuuuuaaaauugacagaugcccugagagcuugguauaaaucugugcauguggguguguguaccaacugcuauuaagugaaaauaagguuuuuuuucccuuuuucuaaaaugguguugguguuaauguuacauuuuuuuuaaucaggaaguuaaaugaaguucaaaagagauugaaugaacugagagaauuaguucauuauuaugaacaaacaucagauaugaugacagaugcuguaaaugaaaauacaaaagaugaagaaacugaagagucagaauaugauucugaacaugaaaauucugaaccuguuacuaacauuaggugaccacaaguuucuucuucccaauguauucaucugcuguguacauguguguggaguuggggcagggaggugcucagugaagaguucagcauuagcuucauauccuagcuuugaccauggaagcuaucuguuagggucauaaucauucuuggcccaugaagaaaagaaggaaauacugaaggcaauaauuuaggaaacuugcugguuguuacuuacuggaagaaaguuuuugaaguaucagaguuagcguguuuucccuaccuguguauuuuagggaggguuugaguuugcagaugcuuucacuuguaaacuucuaaguuuauggaaaagcaaauaauaaagcaggagucuguuauuauuucagcuuaaaugauuuaguuaaugcuauucuuagauugcagcuacauuacuaaaggcuaugguagauuuuaaauuuuuauuuauuuuuguugguuuaaauaacuuggcuuuaauuucuuucagaaauccacagguagcuucuaccuggaaugaagugaauacuaacaguaauacacagugugguucuaacaauagagaugggagaccaguuaauucuaacugugaaauuaauaacagaucugcugccaacaucagagcucuaaacaugccuccauuagguaugauucccuauauucacagaaaaauuuccauauuacuguuaugaaguagauuaucuuuuauuuauacucucaauguuuuaaaaucacguacuugaacgauacucauuuucaacagacugucgauacaauagagaaggagagcagagguugcauguagcacauggagaagaugaggaagaagaaguagaagaggaaggagucaguggggcuucauuaucuagucguaggagcagucuggucgaugaagcaccagaagaugaagaauuugaacagaagauuaguagacucauggcugcaaaagagaaacuuaaacagcuccaagaucuuguugcuauggugcaggucaguuuguugaaauaguacaguuauguaaggugaaaguuuuguguaugguugauaauuauguugcuauaacuucuuuucuuuucauuugauuacauugaaccuuguuauauugagggcccugcagauaggcuaagcaugucaccgcagaguuacauuccccagcccuauaugugaauccuagcagcucccauuaaagggucagucguuuacaugcugcauacagcagagacuggcagacuugagaacuugaaccugacaugguggugcacaucuguaguccuaacacuugggagguaggggcaggaagauuaggagaaguuaaagguuauucuugacuauaugcaaacuggaggccugcuuuaggcacaagagacuuucuaagaaaaaaauggagagcuggguuagaguagauauuugucuuuauaaagcauauaguaccuuuuacaacuuacuggugagaaugcaaccguauguaaauaggaucacaggagcaugguaguauuugcugaugacacuggccucagaaagaucucauaaaagcauccugagguagauauuaaacaaacggaaaaaguuaauugcccaauguuacauaauuaugauggccagaguuuauagccucgagcaaagccugagaucuuuaguuuuuaagauuuauuuauuuauuuuauguaugaguacacuguuacugucuucagacacaccagaagagggcauuggaucccauuauaaaugguugugagccaccauguaguuguugggaauuggacucaggaccucuggaagaacagucaguguucuucacugcugagucgucucuccagccccaagcccaagaccuuaaacuacuugauguuaauuaaaaaaaaaaagacaauccaaacuucagaauguuaguaaagcucaacuauuaauacauguguuuaaaaauaauguauacauauuacagauaauucuguaaacauuaacacuuccuaauucucugauguggcccaaagccugcugagccuuuuguaguugacuaagauagguaucauuuuucuagagcaacaaaaauauuuuaacuugugaaauuauuccuuuguuuucuuuuucucuguuguuucuuucaacuguuuuguuagaucauuggcaugcauuaccaaaccuuuuaacuugaauggaaaauuucuaauugcucaccagaaucacuauuauuugauaaucuaagcaaagugaguucaugucuccauaccuuucauuacauuuuuuauuauauugguauacuauaccuuguuuauauauuggauuuuggcuuuuucuacauuuucucuaugagaagaagagcuaugaagaaaagaaaguacauaaacauguagaaaccuauacauguaaaaugugcauaaacaucuuuugagguuuaugugccuauuauuuuugcucauauaugugaacuguguugggaaaagcaugcacgcuaaagaaaucgauagaagggcuaucuuucugaauuuccaccuuuuugaacuuaggucacaugacuauuacaguuuggaaugcaugaaauagcuucagaaacaaguaguaauaacaaguuaggcuguccagaauauucuuauauuuguaagaacucaucuugcuaauuguuauuaucucuuaguuuuccauuccuuuuagaccugugaguggaaacccuuuugggggguugaaugacccuuucacagggcuugcauaucagauauuuacauugcuauucauaacuagcaaaaugacaguugggaaguaguaauggaauaaugguugggguccccacaacaugagaaaguguguuaaaggguuguagcauuaggcaggcugagauccacugugaccuaagauaacaaaauaggacauugaaaaacuaaaggaugagaaauaacuuucaggcagcuuuguuuuacauuauuucucauucuuuagguuuucuaguccuauuuugugaaaauauuucauauacagcuucuucauuucuuguuauaacacaguucuugccaguccuguucauaugaacauugaaaauuucagauguaaucuucagaaaaagcauggaauauaaauaaauauuuucaagaaaaugcaggagcucauuuucauccccuacuaauuauuacauuaguuuaacaacagaagcaaauguacugacagcaagauaaacauuguuucucuacuuaaucaggacaggcuuuugaugggcccgcccucccucccucccucccucucucccucccucccucccuuucuguuuuuaaauacaagccaacuccuaacccuucagaaagaaagucugauccuguaucuccuacugacuaggaagucacugucuguaaucccagcgggucuuuaacuaauagagauucucuugcuuugcuagccucuugaguauuuaggaguauggaaaugagcuaccuuguucaucuuacuaucuuuuauaucauaaauauucauacuuguuuggaaaauuaaagacaaaaaugaggaaaugagggacauuuuuaaacagauaguaggcauggauuauuugaaauacuauaauagaugcaucuuaagauuuaauaucaaguuucuugcuccaugauaauuuuuuaguuucugcauauuugacacaaugcuauucuuugauagcucauuauuucaacaaaaaaagaaauggcaaguugcugggcaauauuggcaaacuccuuuaauuccagcauucgggaggcaaaggcaggcggagcucugugaguuuguaguccagccuggucuacagagauagguccaggacagccaagcuauauaaaucuugcuauccugaauucccccccuccaccccaaaaaaagcaggucaauuuuuauuaaauguauuuuaauucauaacacuaaugaaauaccugagguugugucccuuuauaaaaaaauuaggcuuauucaguucacaguuuuggagguuuuaagggucuacauucugguuaaauguaagaaggcugugcaagacauguauguggcaaaggaugggguaugaacaugcaugaaucuguccuguuuuccagggcgcucucccccuuccuugccccuguagucuuuucugugcccuuccucuucuuguaaagccaugaguauuuagcuaugggcgcuccaccuuuaugaauuuaguuaaucggguaacucuaaaaggccucaugucaaaacaucauaccaggauuaaauuuucacccuccuaauauuucacaguggggguuaaaaauaacaugugaaccuuuggggaaugcaugcaagccuuaucccaaccauagcacuaaguauugacagcucagacuuuauguggcggggcuaaggaugucaguauaucauagaacacccuagaccuacauucauucucuagcacgacaaaaauuguaaccgacuuauuuuaguuuuaacaguuaaauuucuuaucauugguagaggauauacuuugguuuucuguagaaacuauuuauaucaaauauuuauaucaauugacauauaugucaaauuuuagccuacugaauuauauaaaguguaaauuggauaauaucuuuggauuuccagauaguuuuauauuauuuugcuguuucaggaugaugaugcaacucaagugguugucccugcugcaucaaauuuggaugauuucuaugcagcagaagaagauaucaaacaaaauuccaauaaugcaagagaaaauucuaauaaaauagauacuggaguaaaugaaaaaacaagguaugauaaacuuuaacuuucauaauaaaaacuaaagagcaaguuauuuagauaggugcuuacuguguuauauuuugcuuaguauccuuauuuuagugaaguccauaaauaugucaauuuaauuauagagagaaauuuuaugaggcuaaacuacagcagcaacagagagagcuuaaacaauugcaggaggaaagaaagaaauugauugaaauucaagagaaaauucaagcagugcaaaaggcaugcccugaccuucagguaauuauaaaauuuauuuuuuucaguguguuugaaaauguuuaaaaacuaaugucauuuugaacuagucuggcuuuacuggucauuagauggcagauuauauuugccaauuuucugauuacugaacugagugaaauaauaaugaaauagauuuggguuauuuuuguuguuguuguuuuuuuuuuuuuuuuuuuuuuuacuuugaaaaaauaguucaugggaauuaaaugguuacuucuguuuuuuguauugggcuaguuacucauuuauucaugauauagaaacucaaaacuauuaucaccuuaagauauucuugcuuacauuuaucagauacagaucaacauuccauuuuuacugaccuaagauuacacaguaaaauuuuuaaaccaucaugaguuauuuuauuccauuaguuacuuauucacuuuacauucugaucacagccccucuccucccaguuccacccuuacaagucccuccccccauuaccuucuccccuucucccuagagaacagcuccccuuggguaccacccuacucugugacauucaguugcagcaggauuaaucacaaucuuucccacugaggcccaaccaggcagaccagccuaggggaauccagucgcagguaacagagccagagccagccucuguuucaguuguuaggagacccacauguuguuaggggaccaagcugcacaucugcuacuaacauguaggggacuuagguugaaccccugcauguucuugguuggugguucagucacugugagcccccaugggcccagauuagaguugacucuguaggucuucuugugguguccuugaccccucuggcucacucauucugucccaaauucuuccacaagacuccccaaagcuccaccugauguuuggcuguggucucugcaucuguuucuauccgcugcuggaugaagccucucuggagucaguuauacuaggcuccugucuucaaaaauagcugaguaucauaauagugucagggguuugcuuucuuacaugggacgggucucguguugggccagucauugguugaccauucccuuaaucucugcuccaucuuuaucccuacacaucuuguaagcaggacaaauuugagguugaagguuuugugaguggguugaugccucccccccuccauuggaagucuagccuggauacaggagguggccacuucagucuccauauccucuggugggagucucagcuagggucaucccuguagcuccccccacccccgauucccagccccaggucuccagcuauucaguagagacaccccacugauuuugguucucacucacagcccucccucuccagccuacuuucucuccacacuugaucuucuuccccaucccccuccacauccccucucucacccagauccucuccucuaugaguuauuuaaagaaaauaauuauauagagcuuuaaguuuaacuuacaugauuuuguuuaguauauguacuguuaaguuuuucugauagagaauaagacaauuauauuagauguaaggaugauauauaguauacucuuuuuugagaucuuccuaaaguauauuauguguagcuuuauucauuuguauguaugugugugugcacauuugucuagauacacacaagccuauguggagaccagagguugaugucaggugucaucuucugccacacuucaaucauacuuuuuaaacagagucucucuuacugaacugggagcuuagugauucagugcaugaccaaugagucccugguauccucuuguuucugucucagaacagauuauaggcccuuguggcuaugccuggauuccuaugugagucccggggaucugaaugcaggccuucaaagcuugcaaagcaagaacuuuacccacccagucugguuaacuuuacuguguaguuaaacuuguuuaaggaagaaagagaaaaauagcaaauuauguuucaggcacaacuguuucuaaguuuguacuuuucccacuuuuuuucuaauucuuuuguccuuuauccucaauauaaauaauguccaaagaaguaugugccaagguuggguugaguguaaacucccccuuccccuaauauuugauuuauauguuuuuacuguuccaauuguuaauucucaucaccuuuagcauguuaucauguuuguuuucuucuguuaucuuuggaucauggugccuuuuuuaguugcauaauagcagauuauggcacuagcgcucuaaagaaguaaaauaacuacuuuaugaaauaaguucaauuguauuagugccuuauaguaauauuugucauaauauauaaauaguauuuguuuauauauguguguacuuguauaaguguauauguauguguguauaugaauacauauacauauauauaaacauuuauauacauacacaauauuuuguuuuuuagcucucagccacuaguauaaguaguggucccacaaaaaaauaucuaccagcuauuacuucaacuccaacuguuaaugaaaaugacagcaguacaagcaaguguguuauugauccugaagauucuucagugguggauaaugagguaugagauagucuacuguguuguuccugaauugguuccuaauuccugaggcuguaaaguuguuguuguuguuguuguuuuguuuguuuguuuguuuuuauggggagggauugcugugggcccuuuuaccuacuggauagguaauauaugugaauuauuuucugucuuuuuuguuguuguuuuguuuuuuuuuuuuuguuuuuuaaguuggggaauaaaccuaccccucuugaaguuauauuguuucaaaauagucauauuccuuauuagcaaauauagaacagguauagaaaacauuaauuauuuaauuuagaauggccuauucuuugauauuucauuuuuacuugauuugcauaauaccauagcauuuauuaaauaguuuaugaaguauauuuagugcuucuuguuuucaugaacaguuaauaacugcuuuuuuuuuuguaucccuaaaauaccauuugacccaugaacaucuuaaaagauuuuaacuuuaguauuuuuaauuaugugcguugugugugguagaggcauguacacaaugaguguaggugcccauggaggccagaagugucagauaucccugggagccagcaggcaguugugggucaccugaugugggugcugggaacugaacucugauccuuugcaagagcagugcauacucuuaaccauugaguucccuucauggauaucuuagaauaaagauagaaacuuugaaaauagaauauuguuguacugauaguauuaaguauuguuaaguauuaagacuuuuauucuuuaaggcuucauucagcaaauccaaauauuuucuugacucugguuuuuaaaauaauaguuguggucagacaugagaagacaugaaauguuaagggaagagcuacggcagagaaggaagcaacuugaagcucuaauggcugaacaccagaggaggcaaggucuagcugagaccucaucuccaguggcuauaucauugagaagugauggaucugagaaccugugcacuccucagcaaaguagaacagaaaaguaagaaagucauuuaaaacaucuuuuaaacauuacuuacccagcgcauuaagccaggcagauucauuugcacaaccuagcacuaaucagcuguuucacugaagcaaguaucuuuuaaugugugacuaagaauuacucaauuagccacuuucuauucuacaguuuuccuuucuauuucaguuacucugguacuugaucaaauggugauaaagauuguuuguaaaacuuauuuucauugcaaaguuuuauacuuacuaaaugaaaaauacauaauuuuuauagugcuuuuuuuuccuucagaacagaaugcuauauuguauuaugacagagucucauguaacaaaggcuggccuugaauuccauauggagcuugggaugaccuguuaacugcugguccucuuaccuucgacuccuccgugcucacaguauaggcauucuccaccaugcccaguugaauuacuuuuuaucuuaaauuguguaucuaccauuuguaagguucuugaggauaaucauaaagucuuuuuauauacaacauuaaguuuuugaaaugaguuugcaagucccguauuuggaauauuuguaaaagaauuaguuauuuguuaagauaaguuaacuagcuauauaguaauauuuaauuuaaaaauuugaaguccagauauguugcagucuuauuuuuucagauauucagauggcauuucuaaaauauuauacauacucucuuccucuuaggagauuucauaauauuggagccucgaugugcauuuugcugaauaaaguauauuauauccuguuuuguucuugccacuguguaucugcucuuucacagaacucuucagauauuuuugaugagcuucugguuucagaaucauuuguguagagcuggcuucuuaaccgaggguucacgugacugaauguuaacugaacgggggcaggccuuacaaaauugcuuauuuccaacauacuacagcgaaaaaugaagccagaaguaaaugcugagugaauacaagguguuuccagcauugcuaaaccugugucgcaucaugugcacuuuguacugacagccuacaaggccaaccgaacacguuaccaaaggcuuccugacuuguuucaccgcacguacaaaguagucugcucugaacaguguaguuguggaaaguuguggaaaacuuguaguguuuuccuuuaucauacuucauccuguuaguaccgagcuuaguauaucuuaggauuuauuuuuguuccaguguuuaauuuaaaaaaauaguugauuugcugacuuuuuuuuuucauuuuguuuuuuugagacagaacuuuucuguguagccaagaugcccacuuuugacauacauauauacguauauacauacauagauaugugaaaagaauuuuggauuauggcagaaguuccaauaauucccaaaaugauuuuaaacauccaccuguaauuuuguauuacuuacuuguauaaaguagaauucuaagcauuuaaaauuaugagaucaaacugagcugugaaaaauaaugaagauauuuugugccuuaaauauuccuuuaauuuuaauuuauuucuacuuuucaacucuguguguguaugugggaguauguguaugcuagcacaucugccuguggaggcuacagccauugaucccugugguacuguaguuauggggacuugugagguugucuuauguggauacugaaaaguaaacucauauucccuaguuuagcguguccaggucuagaguuguuuuaauaucacagcugguaaauacaguggcuauuuaaaccaaguuaaaguuaaaauuucauuuuuuccccagucauaucagcagcauuuuaaguauucauguguccuauaucugauucguagggugggcagcacggauagagaucauuccaacuauugcagaaaauguuguuagggagcauugaaauagagggcuaucacuuaaggaauggcugggggacguuuaguuaaagaaaaacuuuccagaaguuguaaugauuauuuuaauuucuuugaaguauuacucucuagaaggcaaacuaugcauuuugucugacagcaauguaagacaacaucucagaauuauuguggugaaaugaacuuuugcauacauguauguguucauauauaucaaaaucuuaagcguuauagcucugaacauaucuagcuaaucuccauaaugaugccuaucuuaucucucaugaucccuagaacaauggcaacuuggggagguucuacucagugugcauuagaugaagaaggagaugaggauggcuaucuuucagaaggaauuguucgcacagaugaagaagaggaggaggagcaggaugccaguuccaaugauaacuucccuauauacccuccuagcaugaaucaaaauucuuacaauguaaaggaaaccaaaaccagguuaguuacaguguuuacguuuuaucugauuuuaaguaucucaagucuuuaugacaccaaguaguucugaaguucacacuaauuaaccaaaugcccagcaaguuaguucacaauggcaccaaccacucaaaagguaaugcugaucuuacaguuuaaagaacuuagucccacaggacuauuagucuuucaguacaagcccccaaauuaccuauauucucuugucuugacaaaaaugagaauuuccacaauuugucuuuagauuuaauaauuugcuacaacucuggaaaaaacuaccaaauuauuguaaaguauucaacgugguugcuuaaugugaaacagcuauaugaggcgaugucuguaaugaauggaaauguguagaucugcauugccuuugagguccaccuuugacuaaguaauaugccauugauuaucagguucaaucucugguuucauuucuuucccuaaagguaagugcguaggucuggaaguaauagccagauugauuuuaguggugacuuugccccucaucauaaagggcuaagaguuauaaacucuggcuuuguuaaaaggggcuuguucugcacaacacaacacagucagccauucggagauuccaaacauuuuagggguggagagaacaccugggguucuuaaauuagauacuuaaaaaaaaaaaagaagucaaauuauguuuauuuguagauacuugcauauauaaaugacagaugcuuuccuuuucuacauaaagauguugcuguaguaguucccaccuagaucagacaagagucagaccuaagcuuucaucuuugcuguuguuugggggaauuaagcaaaaaaugaaaauuuucagguagugaaaauuuuuguuaauaaacugauugucuugcuggcagcagcaguguauucuuauaguccagcugcugcuugaggucacuugagaccagaacauuguagugcagaaacaaccggaagcaacguuaauugcauuguuguuuguggguuguuuuuaaaauuacauauuuuaaaaauguguguguguguguguguguguguguguguguguguguguguguguguguguguguguguugcacaguggagguuagaaaaaacuuuucaggaguagauucucuccuuuuacccuaggaguugaacucuagguuaugaggcuugguggcaagugccgauccugcucagccaucucugaucugcaucguuacuucuaguaaugaugaacauucaugaauaacuguuaaucagauaaaacugugccacuugaugaagucaagaaugaaggguggaaaagugcuuuagucuaaaaagcaguuuuauuuuguagaauauaguuagacuaugguguaagaauacaaauaaagacuagaaagcaauuaaagaauaauuggaugggcugaaaaugcuauuucccccucuucucuguuuuucaaaauacgagguuuguugccauauuuuaaaacucguuaucucauaugauaacuuaaugcuguaaauucuacauuagguggaagagcaaucgcccuguuucagcagauggaaauuaccguccuuuagccaagacaaggcagcagaauaucagcaugcaacgacaagaaaaccuucgaugggugucagagcucucuuacauagaagagaaggagcaguggcaagaacagauuaaucagcuaaagaaacaacucgauuucagugucaauauuugucagacucugaugcaagaccaacagguaaauuuuaucuuugaaauguauuguuuuuuaaauuuacauuguuuugaagcaguacacaguuuauuuaacacauuguaacuauugucaacauucucuuccaacagacuuuaucuuguuugcugcagacucuucuaacagguccguacaguguucugccuaguaauguggcguccccucaagugcaccuuaucaugcaucagcugaaccaaugcuacacacagcuaacauggcagcagaacaauguccagagguaaccugucugacuacugugcagugagugcuaaaaugaaagcagaguuuuacaguuacauucaaggaaaaagaggcaggagccaaacugcagucagucuauugacugaaaauuacaaccauguucugucacugugggacuggcuuuuguuuauaaaguuuguauugaauuguauaccuaagguuagauaaagcauauaguauuuaaauuauacaacaaaacauaagcaugcaaaaauuuagguucuuauaccucugucuauuagaacuaaggucaguacuuguuccaacagcuaaguuauuaaauuaagccacgcuaaguuauugaguugggucaacagagugagcaaauacuuguuguagggucagaacaaucugucuauucuaaaugcuauuaagucauuucuuacauguauuguuuuugaacuuaguuuuugauggcaguauaacugacuuaaauuacuggcuuuuuuacagguuaaaacaaaugcuaacugaacuuaugcgccaacaaaaucagcacccagaaaagccuagaagcaaagaaagaggcaguagugcgucacacccuucuucucccaauuuauuuugcccuuucagcuuuccaacacagccuguaaaucuguuuaaccugccuggauuuacuaacuuuccaucauuugcaccagguagguaacugagaaccugaaggaaaacuaaguaaauaugaagauuuugaacuggguaugcuauuacaugcuuauuauuccagcacuuaggaauuaaaggcaguagaaucaggaguccaaggccaguuccagauacauacugaguuugaggccaagcugggcuaaaugagaugcgucuccaaaaagaaaagaaacaguuugagauuaugauuuaucuguuguauggauuucuguuuucauuguuugaggauuucuuauaguguauuuuaagcaaauuaccccucccuguggacucuuccuuuauuuccaacuucauguccucuuuuuuuuuaaacccacuuaguuuacuuaguacgagcauggguggaacagucugcuggaguguggacagcauuuucuuucuccuuuaucagccaucaguggacagcagcuuuuccaguagggacaggacuuugugaaccccuugcgcaucuauauaaacaggauugcuaauaaaacucagcuauuuauaaaggugaaagauacuggccuuguuuagggcucucgucaccaugcaagccauuagggaggugaagggugaguaagacucuacuucagagcagccacagcucggugagguauuuagugccuuuacuguucauuagcuuugcuuuccccauugguucauuaugugccugguauuauauguuacuuggauccaaagaugaguuaagauaaaucuuuaaaggauuucagaaucuaguuaggacggucauguuagcaaaugcucacagcagugcaguagcuguccuauagcagggauacagaaucuuggagaauauaagcaaauugguuuuagaaaagauauuuaagaaaaaguucauuuccuuaaugauuacaaugggaaaggcuuuuuaaccaguggaaccaaauagagccacuuaagaguuuuaaagcaauaaaauaucacuuggagaauuuagagauaguuaagucagggaagugauuaauguggcuggggaauagcaagggccuucuguggugugcaaaagaagcuuaaguuuuauauuguguucaagagggauuauaagggggaauaacagggaaguuuuauuucagaugaauaaaugugcuuaguaucaaauucauagcauuauuuuaaauauuguuuguaaaguauuucauuauugugaaauuguauaugaaguacuuacaauugagucuggcacccuguuauaauuugaguuuuuuagaaacauuuuaauuuuuaauuauaugugugugugugaauguagguuugugcauguaaguauagugcccgcugaggcuagaagagggugucagauccccugaagcugaaguacagggaauugugggucuaugugggcacugggaaccgaacucucucugcaaaagcaguucacguucuuaacuguugcgccgucucucugccuguaaaacuucuaguucuuuuuucuuuuuuaauuuuuuucauuuuauuuuuaaugugaguauuuuaauugcauguguaucugcaucacaugaaugcagugcccguagagaccagaggagccaucaaucccugggacuggaaugacagacagcugugagcugccaaguaggugcugggaaucaaaggccagucuucuggaaaagcauccacugcucucagggcugagcugucucucucuucagcccuaacuucuaguuaggcuucuuaagggagaaccauuaauuucuuuaguauaacaaauaucucagauauaaguagacugagcuaaaauaguaaaugagcauuaguuuauugauuugauaguuuuggacaggauguucaaucaauuaaaucucuuaaaaauacauuuuaauuucauuuaaggcuaagguacuucuucauuguuuucuucccuguguuuuuauuaggaaugaauuucagcccuuuauuuccuucuaauuuuggagauuuuucucagaauguuucuacaccuacugaacagcagcagccauuagcucaaaauccuucagggaaaacagaguauauggcuuuuccaaaacccuuugaaagcaguucuucucuuggagcagaaaagcaaagguacuugauuguaucaaagucggauacuucacuuacuuuuuuagaaaauuacauuuugugugugugugugugcgcgcgcgcgugugcauauggaggugacaggaucauuugagggcguagguuaucucucugcaccauauggguccuaggaaucaggacugagaaccgcuuacauguugaccuauauugguggccacgauucacuuugugacacagcacagaauuuuugugauugugcaguuugauacacuauuaguuauauaaaauuuauacaucauguagauauuccucgaucuuaagaacuuaacacccaccagaguuuuaauccaggguaucuuacaagauucauauaacaucaguagaaauguaugauuuaaucuugauuugauauuugucuuuagauuaaagaaguucaguguuuaccaacuuaguauuggaaacuacaguaacugugagggauuguuugauucacagucucugaauaccauucagauauuauuauauugaguauuauuuaauuguaaaaacaacuuuuagccaggccuggugacacaugccuuaaauacaaguucucaggaggcagaggcaggcagaucuuuggaguucaaggccagcuuggucuauauacugaguuccaggccagccagggcuacauacuaaaauucucucaaacagauuauuugaaguuuugaugguacauuguauuagucauaguuaggauuuuauauucucucucucauauuuauuauuuuuuaaugugauaaucucuggcaacacaguauaaaagaagggguuugacucagcuauuauuuuguaggcauauuuacagcuauggaaauaacuauauaaauaaauaauucagaaaaauguuuugguagcuaacucaaagaaaaaaaaucccuauaacuuuuaguuuguuuguucuggggcaaauaagcaaauugagauacuguaagggacaguaggcaaguuagcuacaagaauacucucuauagccucauuguuaauuacuuaaaagcaaacaaacaacccagaagaaugaaaagcauagauaucaguuggacccaguauucuauuagaaguaucucagaccuuuagagauauacauugcacaccaugccuccaccuaguaauacgauuggccaugucucagcuuccuaaguuaguauuuaccacuguuguuaagucgggaacucuggaggggcacuugguuaacagaaagucuuagaauuccuguuacacucaccucuagggauuacuucauccccuugacacuguuaacugcuuauuagguagcguaaccuuucuuuuuuucuacaaaguucccguuucauuaugaaaguguucuuucaucagagcuuagugcacaguugccaucuagaaaggagacugaucacaagcaaugaauauuuauucaaagcuucagucaacagggcuuccuguugugauuuuucugcuuuauuaucaauguuuuauauacccuuggcagaagaaacaacugugauuuuucauuaugaaugucuugguuagaauggaacuacauaucuuauuuuaacuacuugaaauauuucaaauuagauaucuuuaucuuacuaaaucagaaccuggguuauaaucuggguuaagugacuaaacaugguaagagaguuaaaaccuagcagucuuuaauaaaggucauaaaacugucaagugcuagcaaggaaguauuuuaaguuauguagaccacacuuuuucauagucauucaucuauacagguuuuauuaaaacaaacaaaaaacagccaagcaagaacaaucuauaaagaugagagugguuuuauauucauaauauuuuuauauuauguuuauaggaaauuaagugugaauuucacugggcauguuguacaaugccuuuaaccucagcacucaggaaaaggcagguggaucucugaguucgagaucagccugauuuaaagccaggacagcccggguuuuccugagaaaccaaaaccaaaauaacaaaaaaacaugaauuucauguauuacuuccccauguguaauaauuuucugauuaaaaaaaaauaacuuuuaagaauacaaacaaacacaacuucaaguucaccgguuauauagaacaaauugcagcugaauuuguccuuuaaguuagaaaguucugacucuuguuuugacuuaaaauuuauaagucaggcuggagagauggcucagcaguuaagagcacugacugcucuucugaaaguccugaguucaaaucccagcaaccacauggugguucacaaccauucauaaugagaucugacacucucuucuggggugucugaagauagcuacaguguacuuagaaauaauaauaaaugacucuuuaaaaaaauuuauaagucaguaucucccaaaaauauucuuuguaacacacuugcugggcucucugauuaaaaaaguuuuauguuuuugugaaaguguuuuccuagccuguugauuuuauuaaccaaaaucuauucuauuuauggagauggcaauaaauauaaauaaaucaaaauugugacuuauaaaacuuuuucuuuuugguaaggaaucagaaacagcccgaagaggaagcugaaaacacuaagacaccaugguuauaugaucaagaagguggaguagaaaaaccauuuuucaagacuggauuuacagagucuguagagaaagcuacaaauaguaaccgcaaaaaucaaccagauacaagcaggagaagacgucaguuugaugaagaauccuuggaaagcuuuagcaguaugccugauccuauagacccaacaacaguaacuaaaacauuuaaaacaagaaaagcaucugcccaggccagccuggccucuaaggacaaaacucccaaaucaaagaguaagaagaggaauucuacucagcugaaaaguagaguuaaaaauauugguaaguuuugaaauguguugaacauuuauaguauaaauauaaaccuuggucuuguuacuuugccauaacuguuauuuuuguauagcuagaucuacaggcauuguagaaagcugcuucaauuaauuuuaguuaucuuuauaguuuuuaaauucuuaaguagcauuuaauggagauaucguaaaacauugcucuuaauuuuugugcuuuuuaaacuuccuuuuguuucauguauauguaugugugugugucuguacacacacacauacauacacacauauauacauguguauacauacacacacacacacacacacacacacacacacacacauauacacauacauauauauauguauauauaugcuacauccacuacaguagugacucgcauuacagguuuagaaaccuggaagcaguccuggccuccuggaaccuugcuuggcauucccauagcuaggaugccacagauuugucccugcaauauuguggagggucuuguaugcuuucuuacaguauuuuacuggauaagagauagaagugucagggcaagcuuagcaaaguauacuuagaaucuucauuacagccagguauaacagauuacauugcauauuggugaauucuucugacaaaugaaaauucccuacagauacuuaaaagaacagcuaaguuaaacucauaugcaagaacuuaccaaggccuaggaaauaggggguuugugguauugcauuauucaugagaaggucugcuagagcagaacccccuggugcuagcuuucacaaggcugaaaggaguagcacaaauugugacuagagugugaaauccuuaccugucauuagcugacucuaggcagggcuguuuuuaucuuuacuauaaacauuaccugguuccuguaaguccuuuuugaagucaguccucuauuuuguaucagauaacuucacuguacuuugccugcugugacauccuaccccuuuguuuuuuguauuauauaagacugguguuugugauacuacauucagaucuagcacacucuccugugugucuguuugucacucccguuccugccuacucuaugccuaucugucugagacccugauucacauggauugagaagggcccacugagcccgguccguggcauaugugugugugugugugugugugugugugugugugugugugugugugugugugugugugugugugugugugugaauauauguauauucacacguauucaccagcauguuccccucccaauggcauauccuuuuuucuuuuucuuccauccuuccuuucuucauuccuuuucuuuuccuuucuuccuucuuaguuuuuuucauaacccucuaaauccaguuagugaaguaccuguguguaugaguguagggccauccacuauauccuaagaaaugcuacuaguaggaacacuuucaaaagagagugauucucucccagcagcucucagcugccaaacucagcucaacaguucuccaaauuuuuuauuacugaaaaguugcucagaugcccaaauguuacuaauuuuugucuuucaguguuauaccagggcauugcauugaauuuuaauuaugauuuuucuuuacauuucuugaugauucauuuaauggguuucuaauucauaaugcauuguuuuuuauuaucuuaaaggaaacuacuuuaaaaacagacuugcuuauauauagauaaauuaguauuucguugacuuuuauugaguuuuauauuaaguugucuuuauagcauugcuauguguaccugguuuuaagaaacagguucuucuauaauuuucuuaagacuuugcugaagaacuagauuuaaagcaguuauauuaaacucugaauaaagaucguauguuuacauuugguaaaaccagagaaccauccaaguagaaaaugguucauuucugaggcagacccugugaauaaucacauaaugauuauuugauuuccuggugcuuuguccccacaaauacauaacugaagaaaugugagcaauuuuuauuauaacacucaacagucuuguuuagcugaauaaucugaugugcuggggguagcacuccuuaagcuuuuuuaauguuucauauggggcucccugggaauacuguucuaaguauagauucugauucaacggaggcaggaggauugagaguucaagaucagauugggcuacuaccuaccaagacccuuuuuauugagcaaauaaaaaaacagauccugguuuaguugguuuggaaaaaaaucuuuauuauuauaaaaugccuuauuuuuuuaauuacaauuuuuauuuaugagaauuugauguucuauucaaugaaauagcaugcccaaccccauuucccuccagcugcccauuuauucuccaucaugucaccuucccaacuucaugucuucuuuuuuuucaaggucuaauuuuuuuuuuuaaauguacaaauuguuaaaugaucucuuucauugguaagugaucuugagucaaccacucagguuaggucauuuaguccaacauuaugaaguccuuuguacagugguggaaaaacacagcucaaacuuguucaguucauauuucugaaucaaacuguaauggugugaguaggcuuagaaaaacaagaaaccugcccaaacuuacaugggcaaccugaccuugugugagcugcugaugacuuagcuugccucuagauggccggugagagaaacgacggucuuuuugauaauucacuuaugugcauggguguggcgucauccacuggagcacaggaagaaguguugccaguggagaaacauccucaaaagagacugauucucccucagaagcuaucaaaugccacucauuauuaacuaagaagcaagaccuuaagggcaccuccccauuuacgccagaaguuuggcugggcugauguugugcagguaaccauggcugcuguggguuuaugaguucggugaugguucacauguagaagacaauauuucacuguacuuugcuccauccucuggcucuuccauucuugaugcugucuguucugagauacaccugaaccuuggggcuugguaggguacuauuaauaaagauguccuacuuagcacugagcauucaguuucuucucagcauuaauugcuguccacugaacaaagaagccuuucugaccaaaaaauaauaggagcaagguucaguccuaggcccaagaucuccccagccuugggaugaaacuuccuccucuggagcagggcucaaaucucaucaguauugcaugagagggcuuauuuccuagaaggucuguacuguggaaugcagaauccuucacuggguaagauuauugaugucuuuuuuucucucaguagccuguguagcuccgucuggcaguaugaaagcuagccaauagaaaagaaguuuccccuguugguuugagauuguauuuuuauauacuacagccauaguguguggugucuucaucaauagagucuuaccauggaguuauggugggugucuuagguuucuuuuucugggaaaaaaauuucaugaccaaaagcagcuuggggagagaaggguuuauuucaucuuuuaguugcaauccauucugaaggaaaguuagggcauggaccuggagucagaaacugaaucagaggucauugaggagaaacugcuuauuggcuugcuccccaugacuugcucagccugcuuccuucuagcacccauaacuacagggcuaggaguggucccacccacagugggcuggcuggucccuucuauaucaauacuaaucaagaaaaugcccaggagacuugccuauaggccaauugagaguccuuuuuccagaugauauuaccuuguaucaaagugauauaaaaccagccaacacuguggguaaccaaggguaauaauaguagcuugugguguuuuguauaucuuuggaaucuccuuggccagugacuuguagggaggugucucaugacuugcauugcaguuuucauauaguaauucauguccucugggagcuacauuguccaccaugcaaacaucucuauuugauuuugaaagcagcuuacuaacgugguuucuuucauuuuggcuaauucacgcucucuaucuaucccucuuccacuuucccucacuccauucuuacuuaguccuuuauacccagucccuucccguauacuucucucuucuuucauaacacauguauucuacuauccauuacauuuuguaaauggaucuugagauaguugacuucuguagggcuuucuauauccccuuccuuuggauuagccuuuccgacaaccccuuaguuuuaccuacacguuugccccucauaccuuaagccuuucuacucccagcaccagcccuucccagccccaacugaaaaaugcucccuuguuccuucugcuccaaguuaagcacaugaaacaaaugauuugaagcuagaauucucauauaagagaggacaugugguauuuauuuucucuaccaggguuacugcuaguuguuuuucuaauuucuuauauucagccuacaaccgugauuucauuuuucuuuacugcugaguaauauuacaauguguuugcaugcuacaguuuucuuauccauuuguuacugacgaauacacagguugacucugcuuucuagcuguuguggcaaggguggcagugaacauugaaaugcagguaucuaauaggaucuagucuguugagucauauaucugagucagaaggcuauuuuuagcuuuuuugagaaacuuccuaaauuauucccaguguaacuguacuaguugaugugucuacugacaguauagaagaguuccccuucaacagcaucugcaaccgguguuuguuaucauuuguauuguugauuauggccauguuaaugucauauagauggucuagcuuuuuuccuauuuuggggcaaagauuguuauucugaucuuuguacugccuucccucauguuaauuuaaaaaaugucaguccaaauaauaauucacauuauguucagcugacauucacugccauuguuaagguccuguuucacagcagaauaaaauuggucuucuaaauuguugauauguagaauguaaggcauugauuaaaagcauugauaucuguaagcuuauuagaaauauacaaaguuguauagcccaccuguacuaacugaaucaguguccauuguaccaagagcaacacugaaaccaaaggaaccaggagacaguugcaucucuagccauuuuauaauccacugguguccuacagaagacagagaaacagaguucucauauuuagguaggagcugacagggaguuuuuuuuuuuuuuuuuuuuugacagucucucagagagagaugaaagugagugagaaauggccacauagcaacucuuguguucuaggaaguugauaaacagugggccagcucuucccuugguggcuguuuggaaucgugcagggccuuuagaaugcuauggcuaaugcagcuuucaucagugaaggcauaaguaguaguaauauuucuuguagcuauuucagucaugcugaauaaaucagaaccagacauaagggagaguuguggacagaaauuagagccucaugcuuucacaguacuaucucacuugucgagugauaauaugaagcauugauccuuauuaauuuuguuguccuccuuggaaaaaacuuggccugguagcucacaccuauaauuaaaguuauuuuagaggcuggguauggaaguuugaggccaacuugggcacaguaugagacacugucucaauaacaaaaccaaaaccaaaaccaacccaaaaaugcccuagagauaacuuaucagucacacauuaguacuguaacuuagaaaaccaggcuuuggauuggaaagauagcucaucagauaaaaauguuugccacuaagccuagugaucguagcuccaucccugaguuccccucuguggaggagagaacagaguucccaaaguugucuuucgaccuccacaugcuuauauaucuaaacacauacauaggaauaaauaaaauuuaaaaugugauauaaaaauucaaaagaaaucuagcccuugaccuugauauuuuucuugauucauguuuuuucucccucuuuguaaauaucuaaaaauuauuuuuauuauugcuauauuacauauauuauuaucauuauucucuuucugguguguguguguguguguguguguguguguguguguguguguguguguguguguguguguguguguguguauugggaaaaagucccagcuagaugcauguguguguagguuaggggaaaacuccauguaguuuguuguuuucuuucacauuuauguguucuaggaucaaauucuaguuucugguaagugccuuguggcuuauucacuucucuggucaguccaucuuugaaaacauuuuuagguuauuuuauuuuacauuugaguguuuuuccuuuauguuuuguguguguaccacauggcuggugcccuugaagggcauuagauccccuggaauugagaguuaaagauggcuuugagucaagagccacacauguucuuaaucauugaaccagccccagcccccacucuguuaaagaacauuacucauucuuggaauccccucuucuacucuuucccuaaacccauccuucuuuuuccuuaauguccuuuuuaaaaaaaacaaaacaaaaacaaaacaaaacaaaacaaagcugacuguauuagucacuuuuccguugcugugguaaaguaccaugacuaaggcaacuuaugaaagaaaggguuuauuuuauuuggcuuagguuccagaggaugagaaucuguugugaugggaaagcagcagguaugucagcuugagaaagaagcuaaagguugauuuuaugucuugacuuguaagcaggaaacagcauggaaucaagauggugugaaucuuuuagaucuuaagagccugccuucagugacauaccuccuccaucaaugccauaguucuuaagcucacacccaaacacugccaucaacuggggaccaaguaucgaauaucugggauaauggggacaucucauucaaacuaguaaauacaauuaguacugacuguguuuacauggucccugucuuauccaugcuauaugguugacuggcuugugcaauaaugcagguaacaauggcucuuugaguuaauaaguguaguugucaugcccaaaagacagcauuccacagcaguccuuccuagucacuggcucguauggucuucugccuccucuucuacaauauuuccuaggccucguuugagagaaugacaaagaugacccauuuagaguugaacacuucauaguuacuuucauagagcuuuaaccaacugugagucucuguauuaaccuaugcccaccacaaaaacuuuaauugacuaaaguugagagcagcauacaucuauggcaaugagcauaauauuuagaagauggcuugagaacauguccuuuaagcaaaacagcaguaguagguucucauguagggcuuuugauuucccuagucguggacuuuuugaaguaaguuuauaguaccaggcaauaauuuccuccugcagugcaguccucaaguccaauaauaagucaguuaccacuugauggucaugccacuguuuuaccagugaccugaaagcuauuguagcaugcaggggccaccacuagguggaacuauugauggaugguucuccucuccauacguauggugcucauaucauuuuccacaauauuuuugguagaauuccccuuuugcuuauggaccuguuuuauguacguacaguaguaaacuagcaguuaagagaauuauucccaguaacugucaugcagaauagguaauuaugacuaggcuucagccugaaaaaucaauaaggaacucagaaauuuaaauuugagguaauaaaauauuaaauuacguucuuagaaauagaagaggagauuugaauccucauaauauaucacagaaacugcacaauaauaugggaguuuauaugauaugauaaagcagcugcuucaaucugggaagcauaaauagcaaagauuguagcauucuguagaagaaaaaugaauacauaauccaaauacagacgcagauaccuauuacuagcauuugguaguccaagaaggacuuaauucguuuaaaggcauucagaucuauguccaauuuauugaaaacaaaacaagcaaacaaaaagugguauagguuauagugggcugggacggcaauuuaagaauccuauauucagcuaagauaccuggcuuagccuguuugaagcaaaccauggaaaccagaugugacucauaauaaaguuaccuuugucuaagaaagauaagauagaacacuuaacuagucauggucuuacacaccugcagccucaaaccuauggaggcugagucaagaagauugcuuugaaucugaugagcaucugggcuacaaagucgcagacuacauccugucccaaggaaccaaaaagagacagacacauacauacacuaacacacuuguuguuguugcuuuuugagacaggauuucucuguauuucugaaauucuguagaccaggcuggacucagagaucugccugacacaaucuucuaagugcugggauuaaaggcaugcaccgcucaccuaugagguauauacacuaacaaauucacacacacaaaccaaucucgguguauauucaaagguauagagguugaagcaggaggauugaguuaucuuugucuaagaaagauaagaucuacauuagcuagucacaguuguguacaccuguagccccagcacuauguucaagagcagaugaauuuuuagagugagaccauguaaucaaaagaaaaaaaucaauagaauauuagacaauugacuguauaguuaacuucagaaacauuaucauuauauauuaccagaaaaucugucuuuaaagaaaaaaguuauauucaccaugguagguuagauuugaagucauuccuaauuaaauuaaaauggauuaagcaaaacaaaacaaaaaacaguuaaggaugauaaagccauuagccagugccugucacacuuuagaauggaaacacuucacaggcauuucugucaaaauggaaaaauagguacuuuuucuauuaccacccuguuugcuuauuuggaaacuaaggaccagaaauauuggaguaacugaaauauuuguuucugucaguauuuuuauuaauguuaauaagguaaacuauugaagugguugguaacugaauaagaggccacuuuucuuugcucuaacaagaaaaauaguuguucuauagaaccuauauuuuuugaauaauauaaaaaagauuaaguauaaaaauagguaaaaauguauaauauauaacucuucagauuaagugcauuuaauuuuagucuguuuugcauuggguuguuuuugaaacugacaaaggggaaaaagacucucggcauauauggaaagauaaacaucuaauuuuggccaagaaaagaagcuagguaggguuugcuuaccaaaugaaaaagcauacuguauaacuucugugaccaaaagaauaaaaaaaugaccuugcagguaaggcaguggugugacacaugccuuuaaucccagcacuugaaggcagagacagauauuugugaguuagaggccagccuggucuacaaacucuuucucaaacaaacaauguaagaaauaaaacaaugaaauaugaggguuacuauuucagugggaagaggauagacuuaaccaucaguucauauagaauaaaagaaauugaguugugucauacaauaaaaugagugugaaguguaaagagcuuagaaaauguagcauugugaguuuuuguuuguuuguuuuugucuuauuuuguaaccuugaagauguuuuaccuuggagucuaguagagaacucagaucuuaugagauuugccuuccguuuaguugccuuccguuuuguugugaugaguaucagaagauaaaugaacuguuagaauacuaauuauugucacccaguccuucuaaagguuauucugaagguauucaaggccauuauuuuguauuccguuuaugccaggccauaaguaccacuaaaaacccaguuacuuguacuauuuuacuguggaaaugaguuucccuuucagaugaaguuaguugcaacugauaacagcugucacuuuuuuuacccgaggguaugaaagugccagugugucuagcacaugugaaccuugcaaaaauaggaacagacauucagcccagacugaagagccuguucaagcaaaauuauucagcagaaagaaucaugaacagcuggaaaaaauaauaaaauauaguaggucugcagaaauaucuucagguauguuccucuuuuuuuguuuguuuuaaucgagggaauucaucuuaaaaugaaaagcuacacuaaagcaaguuuuaauaauagacuaucacagauuccuaucaugugaaagguuuuaaucauagagaaauguaaacuacaaauagccuguguugcugugaucucuuuaguguuucugacacguuaaaaaauucuuuguaaacaaguaauuguuauuaauacggaauuccuaauugaaauucuaguaaucuuacuuaaauaggauuugauaugaaaucauauuacuucucuucuuaagacauuuaaugcauccugccugugauaaaaugugugugccuuauuuuaacaaauacagcuagcaaggaauuaguuccuucuugccuuguauauucacgucgucucacaguccuuugccuugaacccuuuucuuucagugauacugaguuagagcauucccaugacugccauguuauuucucagcucaccagguuuuuuguuuuuguuuuguuuucuccuuucacucauaaauagaauuuuaauuccauaaucuugaaauuuuaucugaaucuaagguugaguagcucucccuuuccucuuucauuuccauuuguguuaguguaaagcuuuucuguuaucugagucaguauauaauauuaagugauuuuuagaugucauguuguccuuuugauucuuuugagggcacguaacuacuuuuuauauuuuuacacuaaauaucauuauaauaaugugauuggugguaugcuguaaguguuuauugaauggagucaaugacuaucaccauuuuaaguauucaccaguauuuaaugauuuauaaaaagaauagguacauugaaguacauggaguugguaaccauagauucagucucauuugucuccuuuggugaauaugguaucaucuauuuguaucauacuuuauauacaaaauuuugguuauagaauuuuuaugcauaucauuugagccuauaaugcucuauuauuuuauuuuuauuuuucaguuggggaauuacagggaagguacuugcuuucuuccaacaauuuuuaaaacggcuggcaauacaaauuguacuuuucuguaaaaucuuugaaaaugaugcccuuguaaugaugcuuguaacuauucuuugggauucacuuguggaaaaaugaaaaaaaaaugaggguuuaguguuggcugaacagcauaauuccaucuauguauaaauagaaauauaaagggaaacaagcauagaagaaaauguaucagaacauuugcagugaucuuaugaacuauguuuucugaauuuuacguaguagauaguuuuuaguuuuuuaaucagaaaagaaacuucacauuugcuuguauuuugaaauggcuuucucaaauugcuaggaguuaguagcacuuucagcuauaaaggucaagauuguuuugguaaaaauaauaaaucuauugcccuggacucagcaaaauuuuuaaauuuucaucuccuuucacuauuuuuacccaacacuguuauugucaaagagucggguaagaguugagaaaagguacaggcauaauaaaaauugaguagaauuauuuuaauugaaagucaauauuccagaccuuauuauugccauuaaaaaaagaagucugguacaguggcacaugccauuaaucucaguacuugggcagagucaggcauaucugugugaaugguagccaaucuggucuacauauugaguugucuggcagagguacauaguaaaaaccuguuucaaaaaauuuauugaauuuuuugugaauuaaauaguuugaggguguaaauaugcugcucaucaauauucuaaagggcguguuuuucauuuucugugacacuaagauacucuacauuauugaugcuuguugugacuuggccuauuaacaugguaauuagagugcaacauuuauugguauuauuggauuauacuuuccucuuuucccacaguaauuauaggagugucuguuuuuauacucucuacccucaaaaaaaaaaaaaaaacagguaguguaucacugugguugucaucacuaaucacagaagcuuaguuuauagcagggcuuuuaaaugagaacacuuuacaguuuuaaaugaaacaauauuucuauggauguuuuugugcauauauguuuaugcaccaagugaaugacuagugcccgaggaagcaaggagaagguaucugauccccugggacuauaguuaaaggugccugugaccauccacgugaguguugagaaucaggcuaagcuccucuggagccccagccagugcuuacuccuaaccacggagcgccucuccugcccagccaaggagaauguuuccaaauacagcauaaacuauuauuugcaguaacaugucacuguggguaaauaucuuuuuaaauuuucuuuuuuucucacucacuuauucauauuauaauaggcccugucuuuacaacauuuuaugcuuauccuaugucuaaccuuuacuacagcacaugucagaauuuuacagcagucuaacaguugaaaagaaauacaugugaagugccaggagguaacagucuacuuaguucuaguguccauauuuguuacuuuucuuuauugaacuuaaaguccuuauccugauuuguuuguuuuaguuuuauaagucagucucucuguagagccuuggcuauucuggagcucucuguguagacuagucuggccuugaacacagauccaccugccucugcuuccugagugcugggauuaaguggugugcuaccacgccugacuuguuuugguuuuuacuuuaugagugugguguuuugccuguauaugucugugcuuugggugccugaugcuggagcugcagacaguagucagacaucaugugggugcuggaaauugaaccugacuugaguccucuaaaagagcagcuagcauucuuaacuuucgagccaucuuuccaacccuugaauuucuuuucauuuuuagauuuagcuugguguauauauguuacucacaaaaaauaaauccgcauauuuugaagucuuugauuuauauuucacaguuggcaaaacuggccacuuuucuuguuuuagaaacaugaaaccuagccaacacaucuguaaagguaguagaaacauuuuuugugacauaguguuuaaaaaucauuuguuucauauauuugagauauugaaacgcauuaagguuuuuauaaauagauaccaguguuuuuaugcugcaaccaguuucugcuaccagucaguaucugaaaaaauaauauaccaucaaaaaaaaaaccccaacuaugaugggcauaggcuauaauaaauauaauagaaauuuagaaauauuccaaaaugcuauuuugauucagaaguacagauuuguauuaguacauauuuauauuauuuagaauuacaaaaguauucuaccuccagcagaacauacgagggauuuuuuauuuaauacgauuugcauaugauauacaguuauaaagacaucuuagcuccuuucugcagugauaugcaaauagaaaguaaaguccuauuugaauccuuagaggacucuagagaagguaaaacaaaggcaaaagagauggcugagcuauuaaauauuuaacucuagauaaaacaagaacccagaccugacaaaaguagauuagacaguaguagaaucaagauuagguuggcagagaagagggagcuuucuagcauucauuuuaguuuaggaggaaagacugacauggaguuuaaaucucuuaacuacgcaaaaggagagaugaaaguuagaauuaauuaggaguaauuuuauuguagaauaauucaucauagcaaacuacuaagccauuaauauacuauuuucuuagagcuuugaaacaucauuuuaaaaauuaaacuaugguuuaacuugccauacaugaauugaaaguuuucauaacaaauaauauauccugauuuggauguuuuccuuuaagucuugguuuucauuucuacuuaaugucacauucauuuuaacauaucgcauguggacauuuugaaacuauuaagagauagcaucuuuuaaaaugucugacugccuuaaggacagaucguuuauguuuguggaaauuaauaucuggacauguagugcaacuuaguuaauuaguacaaagguuaauuuucauuauuuuuguauuaucuuauuucuauucugcaaaagugauuuaucuugauacucuuugcaugcuuaaaaaacauauauugaaacaaucaaccuuuuuuauuucuuuuuuuuuuuuuuuuuuaaagaaugcuucuuuuuuuuuuuuuuuuaaagauuuauuuauuuauuauauguaaguacacuguagcugucuucagacacuccagaagagggcaucagauuucguuauggaugguugugagccaccaugugguugcugggauuugaacucgggaccuucagaagagcagucggcgcucuuaaccacugaaccaucucgccagccccuuuuuuauuucuuagaaucauugauuuuugaagaaaaaacuagauccuugcaguucuacuguccuaguaaaauugcagaauuugagagcuagaagaacuacuugggaauggguugcuuuugguuccauuucuguuucuagaaagaacacaaaauuaccuaauuuauacccugaauaaaaguuuagggcuaacaauaugguucagaguagcauaugugaggugcagggauuguuuuccaucagcaaacacucaccccaaagaguaugacuuugaaagaguguugcccguccauggggcaguauuuuauuuaaauaauucagugauguggaaagucugacaaguauagaugggcaucuucuacucugauuuguaccaguugaauacauauuacauuguagugacaaguuaugacauaauuaugcauuguuaagccauagcauuuuuuccucugaacauuaauaguagaucuccccugcuuauuacauucaagagcuuauugauuuucagugacuagucccaugaaguacauacaguuuuccagguuuuguuuuuaauugugguuuuguuuaauguucagaccaguuuuuggcuauauaguccaagcugcuggccuuuaacuuacagccuuccuuauguuccccaguucuagaauuauaggucauucuuuuuaacugagaaguuaguauaauucuaagugguauucagauauugcuauucuugaauuuaaauauuuuaauacauaguauuuaucuuaauaauuuaagauuaauucuuuagaagcccugaaauaggauuuguuguguuaaaguguagaaaaugauguagauuaauaggaguuauuaugaagguauuuuauuaucauuauuuucuugaucuauuuuuaucuuccagagacuggaagugauuuuuccauguuugaagcuuuacgggauacuauuuauuccgaaguggcuacauuaauuucucaaaaugagucucguccacauuuucuuauugaacuuuuccaugagcugcagcuacuuaauacagacuacuugagacagagagcuuuauaugcauugcagguaucugcuaccucauauucuucucucagcuuacucagugcuucuauauggguagcuccuuaagugaagcacggccuuuccucuguauauuuugauuuauuuucuguuuuuuguuuguuuguuuguuugcaacauuucauuuaaaacuucuuguauagcuuuaguuuaucuuuacaugcauuuuucugugcuuaauauuuaagcuaugaaaaguacuuaauuuuucuuucauuugccacugcuuugaaguuugucacauaaauuuggaauaaagcauauaucuauuguauagaaaugucuuuauuucauuauuuaggauaucguauccagacacauuucugaaagugaugaaagagaaggagaaaauguaaagccugugaacucuggcacuuggguagcauccaauucagagcuuacuccgagugagagccuuguuacuacugacgauguaagccaauauuauguguuaaaugcgagcacauguucaauguauaauaaagaaagauugacauuauugauagauuauagauauagauaauauuguugaugauuuaaaaaugauauacuuugaagcaauagacacauauacauaucuuuaauagguauuuaauacaucuuuguugaauucuucagaagauuaguuagaccaaagaguggucaagucagaaaacuuuuaaauauauaaguacaaaauaaaucaagucuguaaaagaaagaccuggacaaaagaaaaucauccaggaaaaaaguaaaauuuaauguauucuacuuagacaaguuuaugaaucaacuagaaagaucggggaaaaaugauaagauacuuuuauauauuagauauuugaaaaugacccguuuacagguacauuuauaauuuuuguauagcaaauacuuaaauaauucaagcaucuggagaucucuaagaaagaauaaaauaaugaaguagcuuauagauaaagaguuaugaaauaacauuguugugaauuuuaccacuauuguaauguuaacaaaaguauucugaagaugauauuucuccaaaaggauauuuuaucuuuuuuugggguaaggauaaucuguuuagaaacuauugaggauuuucuuuucuuuuuuuuacuccuaaacacgugcugaagacaauaccuccuacacugucccuuuuucuuauucuuguucuauacuaugcuauaaaucauaugcugcuauaaaaaacugucuaaaaauuccauaguuuacacuuuguuguguuugugcauauguagugcauguacauguguguguggugguggugguguaguagcaguagcaguagcaguagcaguagcaguagcaguaguauguguuugugugcuuguguauggaggccaggaguuggcauggaaugucuuccuugauugcuuucuacauuaucuuuugagacagcaucucucauugaaccuggugcuugcugauuacuggauauugugaucacuugggaaagacucaguuucauagauucuauuuuuauaauguuaaauauaaauuaggaagugauuacuuauuguaguuagcugaagaugauauguuccuuuuugcagaaaauaaaaaggcagguagcugucugucugucuauuuauuuauccauccaccuaaucuauuuggagcaugggaauugcuggauuauaucguaaacguuacuagauauugcaauaacuugggaaagacugaaaucaagugauagaaauuguauugaugagagaugauguauauuaacuauagagaaugcaaaaggaccuucuugacuggugcaaauugucuuuguauauguguuuaaacuugauuuuguguguguguguguguguguguguguguguguguguguguguguguguguguguguugggagaagaucucauuuuauagcccugacugacuccuuauguaaaccaggcuggccuugaacucugugucucugucuccauaguacugugucuaaaaccacuauauccagauaaugguuuuuagcaugagagaaacuaauuauguaaguguauucauuuguccaaacucauuaaacaauacacuuaaaauagguacauuaauguauguuaguuguaccaguaaaauguuaauuucauaaaauuaugaauaucauguuuuucuucagauauaaggcagugagauacauacaguaaggauauaaaguguccaugagauguaaagauaauuuaaaauguuaacuaccaauuuauaaucuuuagugaaaguuggcuuucuuauuuuuauuuagccaaaauguucuccaagauuacuuaauguuuuaaugucuauuauggauuauauugcauucuugucugaguagaguucucauugcaacuuuuuagugucccuuuuaaauguaugcuuuuaugcaaauaacaguuucuguguuaaaucuugaauguuuaugaaauguuuagaaggaauauuuaggaauuguuucuuuaacuuaggaaacauuugagaagaacuuugaaagagaaacacauaaaguaagugaacagaaugaugcugacaacgugagugucauguccguauccuccaacuuugagccauuugcaacagacgacuuagguaaguagcgcucuuccucaccuggccgcaccuuagaugcuuucuuggcaauguugaaggaaugaggaauaacuaagaugaacacaaaaauacccaucaguccaaauccaugacucuuuuguucauuccuugacuuggggcaaaucauccacucugucacuauguagaugcugaccaaguaggauugcuauauucguggguaaaacauagaccuucauauauaaaugacaguaguuuuauuuucauuaaacuuuauuuuacauuaaggagaaaggucaucuauuuaguucuucaaaauucacaguuuuuccaaauauuuuuuuuucuuuaaaauuuuaucuauaugaguaaaaauaugccuucagacacaccucagauagguaucaaaucccauuacagaugguugugagccaccuugugguugcugggaauugaagucaggaccucuggaagagcagucaauguucuuaaccacugagcucucucuccagauccuccaaacaaauuuucaauaaaauaagaauagguagagguaaaaacucagauucugugauaaucccuuuacuuaggugguggugcaaucugaggcaagcuacuuaagugcugucaucuguagggucauuuaaggauuagacaaauaacuaugaugauguacaugaagcgucucauuaauacaguaaauagaauacuuuaaaaucuaauucugggcuagagggauggcucagcacuuaagcgugcuugcugcucuuccagaugaaucuggguuugguuuccagcaccuacaucagguggcucacuacuaccuguaacuccaguucccagggaacuggccucuccuggccucaguggacuaccugcacauaugugucauucacucacacagauacauacaugcacauaaauaaaaauagauccuugaaaaagcuaacuuucuucccuugugcuuaguuuuauuuuuuuuuggagaguaugcaaaaggauuugcuuuuguauauucuagaaauauuucuguuccaaauucagguaacacugugauucacuuggaucaagcauuagccagaaugagagaguaugagcgcaugaagaccgagacagaaagucacucaaauaugagaugcacuugcaggguuauugaggaugaagauggugcugccgccgcugccacagucaguaauucagaagguauaucuuuagugugaucaaaaguaauaaucagaguugcaaauaaaaacucugaaguuaacucuaauuccacaauuuaggaggaugaagcaggaauauuaggaguuuaaaccuaguuuugacuacauugcaaauucagaaccaguuugaaauauauaccggccacccuguguuuaaaaaaaguuaagccccuuuuaauucuagugguuuuguuauuuauuucuuuuaauuauaaggauugcuaaaacuacuugguuuuuccuuucuauuguuuuaacauaaaauuauuauaauauucuauaaaguaucauuuaaauguguauauaucuauguacauaaugucauuggcuuuuguugacauaucauuuuucuuaaaaaaaauagaaacucccauuauugagaaucacaauucaccacaaccuauaagugauguuucugccguccccuguccuagaauugauacucagcaacuggaccgccaaauuaaagcaauuaugaaagaagucauuccuuuuuugaagguaaacaauacaagauaaagcagcauauauaauuucuaauaaugaccguauaagacuuacuuauaaauagugccauugaaauuaacagggcaaagaaaaaaauggaaaaguggaauaugagugcgguuguuaauucuaguuucaagaggcauagacaggcagaucucugaguuugaggccaacuugguauacagaaugaguucgaggacagaugaagagguaaacuauaaaaauguguuucagucaggcuuguuuuaauuuuuuaugucacuuuuuaaaaaaauaguuuuuucauaaaauauauuguuucaccuccuucaucuccuccuagguucuccuuaccuccccacccauccaacuucaugucuucucuugagagagagaaagggggugggggagaaacccuuaaaaaggggagccauaguaucuaagcaaaagacugguaaaguuuaaaaaaaaaaaggcucagccaaagcaccaugagauagcuguuagacaaacuugaucuauaaugucauuuaagucaaugaucugucuuggucagagaaggauauugacaucaaauccuguuguuuugggguuuaaucuacuucuguacauuuaggagcaugcuuuauuaauaggagucaccuguguuuggagauagcucaguggcuaagagaacccacguguuguuucacaagugucuaccaggucaaugccaggagauuugaugccauuuucuggccucagacacuggcaacaagugugguacauguacauacagcccccccaccccccuugguaucaucuaguuuggcuaccucguguuagugggaaagggaaauuugaccuggaggaagggugacagggcuugcuuaaaugaauuaaauagccaaaaaggaaugagaacccugagauuguuucagggcuauucuagacugaccuugagaagccaaccaggcucagauuuauuucuuaauucacacuaaacacacacacacacacacacacacacacacacacacgagacagauggugauggauaucacagcuuggcuuagaucuuacaauaauucuccggucuuacccucuaaguauuagaauuacagacaugcaaccacgcuugguuuucaaaagguuuuuaugguacaguuaagaagaggcuugcuuuaaguggcauuugaaaagagaaagauauuucauaauaucuagagacauuuuuaguuguugguuuaggugcagguguugcuaguggaauuccuaggacaccauaccacaguaacucuuacaagagaaaacauuuaauugagggcaugcuuacaguuuuagauggauaguccaccaucaucauuauauaguggaauuugaugauaggcauggaagacauggcaggcauggugcuggaguaguuugagaguucugacccauaggcagagagauacugggcauggcaugggcuuuugaaaccucaaagccccauuccuuauagcacucuucucccacaaggccaugcuuccuaaacugucuaaucucaccaaagaguuuuacccccuggggucuaagcauucaacuguaugacuugcuggggccauucuuauucaauccacaacagauagagaaggaaaucgguagaagguggguaagaguuuaagaguaauugagauuaacugaacuacaagcaagaagauagucagcaugcauaacucuucuuacuacagaagggaagugaugaagaguaugggaacaggaaauuuguuuuauuggucauuuucugguguguggguuaaaaucaccaaaccuuuuaguguguuauacuauagagauuggcuacgcuuaccagugaaucuuccuaaucuuuaucacacaaaugcaagagaaacaaauuucaaguuguguagauuaauauuuuuuaaauaauagauaaguuuauauccuaaccuacuaggauuuuuuuaggagcacauggaugaaguguguucgucucagcuucucacuucaguaagacguauggucuugacccuuacccagcagaaugaugagagcaaagaguuugugaaguucuuucauaaacaacuaggaaguauauugcagguaagaguuuauuuuuguaugaguuaccuauauuccauuuguuagggaucuuaccauuuucugguauuauagaagugauucaguaauccauccugauauucaguuuagauggcauuuuaauauuaucucuuuuaguuaacaaguauaagaggacuuuuuguauuuucguuuaauauggccaucuccagcgacuaucccaacuucaauaaaauauuauugguuuaaaggaacuggagggauggcucagcuguuaagagcacuugcugcucuucugaaggaccuggguuugguucucaguacccacgucagguggcucauaacugccugugacuccagcuccagggcuuggguauuaugcacucuguucugauuuuuuguuuuuuuuuuaaggaucuguauacacuuggcauacucgcauagauaggugcacauacacaugacuaaaaauguuuaaauuuacugguuugguauucuaccaauaagaauaguucaagacugaaaugcuuagauagcaugcuaugauuuaauuuuaaauaauaugaggaguuuuagacacuagaaaccagccucuuuaauuagagaaacuacuuaagagcauaacaguaguacuuuuaaacuauaucuuaauaaaauuuggauaacuggcauuucacucucaacacuuuuuuuagggaucuuuaagcgcaucuuucuuagauauucauaaagaaagcgggacuauggucgugccacuaugacucacaaugagccuucuguuuuauacuuauuuucugacuuccuuauuucuuucccucuuauacugcccagccucuaauaaucuugauuauaacauaaugcggugacagauuaucuuuggugggcuugagccaagguguaugccugagaaaaaaccgggcaugcaacagaucugauauaaaaggaaguuuauugagggaagggagaggaggaggagcuggggggugggggagggagggagggaaggaaggaaggaagagagagaacacaugaagaacagagggaacaccagaaacagagagacagcuaggguccuuuuaucugcccacugcacacaccugccacaccuaguagcaugcauggcaucagaagcuacaaggucccugagagcuggcaggccaguggcauugucucuacacuaacaacuguccuaucuuguguuuagauaagcugcagcuuucaauuauauugaggccaugauucucaacuagagaagauuuuuguuuccuggaagagauuugacagugucuguagcuguuuuguuuuguuuaucagauaagaugggagagagauaagaaaagaaggaagugauauacuaguuaguggccuggcaugcugcuaaaccuaugugauguuuaucuuuuccauuaugaugaccuaaauauuuucacauugagauaguuaagugauggauauuguuacuauagauuaaguaauacauuuuucucuuaaugugagguucucuaagaaauuuuguuuugcuuccuguuucagagguuaaagugguuuuuaaccaacauaauauuuuuauugauuauuugggaauuucacuaaugcaccacaaucacacucacuuuucagccuuccucccccaaacagagaugaauaaaaaaaaagacagaaaaagaaacccaccaaguccaguuuauguugcccauauauucacuggaccaugauuaaacugccaguggccaguuccuuacagaaaauugaguccuuccccaucccaccccaccagaagccaucgaaguguagagcuacacuucgucacaauuuuuaagaguucucuucaauggcuucuuguuuagacuguuucuuugugugugugugugugugugugugugagagagagagagagagagagagagagagagagagagagagagagagagaaugugugcagcacuuagggauggggaaagaguuguuauaggagccuucuauggcucucauuuucaacugugagucuacagucauugaucccacugcaaaagaaguuuccuuacagucaguagcagcuuggauccuagauuuccacauggcuucuggggacugcauggaccacagacauccacauggccucuggcggcaccauggcagccucagcuuggucuucaaaggcaguacagacuauggacaguaucauguuuuucaggggcaacacaggccacagacaucaacaugacuucuugcagcagcacagaccacagacauccacagggccuucagggguaucauggcccagggccgucaacauggccccugaccacaucagggccacagacaucaacauggcuucagguggcaguccaggccauggauauccauuuauccucuggcaauaaaauggaccaagaauaucaacauugucucagacaguagcacaguaaccaauauaaccuccagugauagcauggacucagacauucccauguccccccaccaccacagacaucagcauggucucagguggcaucauagaccacagacauccacuuggacuacaggcaucaagagagccuaggcaggagcauggaccaugggccuucugcccuggcagcacaaaggcugagccugcucaagcucuaggguguagcccuacuuagcagcaacaugcucacagcuuuacaugcaaauagucauugcaacuaguuguugaucugguucaagguuucugauuuuugacacaccacaaauacuggaccaucacugauacucaucucacauauccagagucagggugcucuuguggcuaggaagggcuucugggagcaggaucugccugagcuacaaacugcuacauagcucccugcccucagugcaugaggcucaccaggcaugacaguugugcucacagccugugggcaguaauguaccuugugcucucuucuucccagccggagcagcaggagcuccgaggcuccaugcuggggcugacugcccuacucaggaaugccauguuguuuggugcaguuguacugucauaucaugccuauauccuuuuagagccuccaugggucucuuagacugcucugaggucccucaguugccaucuucagucaauccaagaacucugccuuacaccuuugggggcuuaaaaggaaucuuuagggaaguggauggucagggaaaaaaaccaacucuguuaaggacagucauuagucaucgcccacagguccuacagagcacugagcuggaggauugauuucucuguaagccagucaguuccuucuggaaccaccucagcacuaugacccuguuaucugggcccaguugaccucacaagcuuccucuuaaacuguuuaaguguaguacuaucacuuugccuuuuagcuaauuuaaaaucugagggagguacuaauuuucuucauuuuaaucuucuauuuuguuaguauuaagacuaaagaacaaauucaauaauaaucucagaguuguucugacuuuuguuaauaauguugacacauaauuuauaagguauagaauuuaucaaugaucuuguacuuuauagaauaggauuuauuaacaugaaauagguaaauaagguauucuuaaggaaauaucugaaguauuaaaaauacuuaagauaacugauagguaaugaauuuuuuauaaauuuaacuagcuuauucuaagagaaagaaauaacuauuuuagaaugugguugaaagaaauuauucauaacucauuuuuagucuauuuguucaacccuuuuugacuuugguuuuuuuuccugauuuuuaucacagggucaagucuguugagagcaaaagcuaauuuaaacuuuaccuagaaucuuucuuuccuucucuccuucuauuuuuuuuuuuuuuuuuuuuuuaaauuuuucgagacaggguuucucuguguagcccuggcuguccuggaacucacucuguagaccaggcuggccuugaacucagaaauccgccugccucugccuccugagugcugggauuaaaggccuuucccucuacuuuuauuuuauuaucuuuuuuuuuuuugugagcuucuaauuuuaaaguauugacuucucauuuugucuucugagaucuguucugacacuuugugcuuugagucucuuagcaugcaugcuccucuuuguaguacuggaacucacugugaagaccagaauggccuuaaacucagauacaccugcuuuugccuccugaauccgugcucuuucugugguuuuguguuuucuuuuggggcuuggggcaagguuacaucaaaauuaccuuuugucuaagugacauagcucccagguuugcaagaaagagaaagggcaguucuuuguguaaaauaacacauuuguucauuagaugaugcugcgugucaacuugauagaacgaaugauuacuuguaaacuuacuuugaagaaaauguaaaggagaaugacugguauaaauaagaaacuagcaucauguagaugaggacaacuguccucacugaggauuuaaugacugacuaauguagugcauacauagucccacauguccucucggggcaugugggagaugagcaaucuguuauauuaaggaaguacuguauuauagugacuguuaugcucuuuucuccccaguuguauacucuuaaguggggcuaggaauauuccugcuuuguaauaagaauauuuuguaguaguacuaaaucucuguauagaaccauggcuauuaauuucaaguguuccaguacuuaaaaaaauauuaggaacaaggacaacagugcuagauguauuacuguggauaugaggagccccaggagaucuuaacccagacgcagagaacaccaaguguacaaguaacauuauuauauagccugaacgggagcuacccuuuguauuuagguuuuuauacauauguguguaugcauacacacacauuaaucugcacguacauacacauuuauauaugugucuuauuuagaguuucuauugcugcagcgaaacaccaugaccagaaaccaaguuguggaggaaaaggguguaaaggguuuauuuggcuuauacuuugguggcauuugucagcagcuacagcaggaaggaacugaaggaagucaguacaggaacucaaacaggucaggauccugaggagggagcugguacagaagccauggagggcugcugcuuacuggccuuuuauuuuaagauggauuuauuuguaugugaguacacugucgcugucuucagacacaccagaagagggcaucagaucccauuacagaugcuugggagccaccauguaguugcugagaauugaacucaggaccucuggaagagcagugaaugcuuuuaacugcugaacuaucucuccagccucugguuacuugcuuuuuuuguuguuuuguuuuguuuuguuuacauggcuugcuuagccugcuuucuuacagaacaacccaggaccaccagcccaaggauggcaccacccacaaugggcugggcccuacccuguuaaucacuuauugagaaaaugccuuacagcuggaucucauggaggcauuuccucaacugaggcuccuuucuuucugaugacacacacacuaccacccaguauaguauuuaacaauaauuaaagaaaaaaaugagagagagcaaggauguauguuuggagggaggaaaaggaagggagaaacaugauuauauuaaaaucucaaaaaaauaaauauaucuauauacauagaaaauaauacugguuuucucuaggcaauuauuuuaaccuuuaaaguuacuuguauuauuuuauacacgguugaaguuuacugugaucuuacaauuaucucuuuaaacaggauucacuagcaaaauuugcaggcagaaagcugaaagacuguggagaagaucuucuuguggagaucucugaaguguuguuuaaugaauuggcuuucuuuaagcucaugcaagacuuggauaauaauagcauagcuguuaaacagaggugcaagaggaaaauugaagcagcuggagugaggcagucuuaugcaaaagagguaaguuucacuuugccuuuaagaauggcuauaguuagcuuauaaauacacgucuuggucaguauucauaaauaaacauuuguuuauccuuaguaagaacaguaacuuuuaguaaaaccaguuagucaaauuguauaucuguauguggucuacauaccaaacuuaggauucacaaggcaagauaaaagacaggaauuggugcuuacaaugaauuguuagaugcccaguucauuuuaguauugcuuauuaagugcucuaaagaggggagaauuggaaucuuguuccuggccagcuuuccuaccguagcuguugacaaauaccauaaaguuuccaagaauaugugucauaaggaagucacuuccagucaacaaauacauguguucauuggcuagauuuuuaguuuaguuuuguuuuuucuuuuuaaauuuauucacuuuacaucaugcucacugccccuauucucugucauccuucucccuuucuccuuugaggguggaguccucccuaaguauucccuaaccuugguacaucaagucucugcagggcuaggugcauccuuucccacugagucccgacaaggcagcccagcuagaacauaucccauuuacagcuaacagcuuuuggguuaguuuaaaagucuguucuaguucucuuguuuuucugccuuuuuuaauagugacugcaugcaaagcuagaccaguuaguucuucuguaauguaaggcuuauuaggaggcuuucucacaguaggcaccuuuucuuuacaucugaccaugagcaggggaagcaggccaagacccagacagaaaaagagagagagagaaacccuucuacgaaucuaaaauagaguuaggccaucuuugccacaucgcuucuguuuuuauucuagauauagauugauuucaaacauugccacguucuuaaggaagauagagcggcagagcccuauaguaaguuacugcaagggucuuucaguccccuugaguaggcaaucucaggaaggucuucccagauccugaacuaggagcugaccucaaagacaagagcuccucaugaggaaaacucagugcagugauucucaggcagggcugagcauaaaggcacaagcacacuaaggagaguggugagcugagcggugacagagugggaaucgagcacuugccugguguacauguaaguccugaaccagacuaaugccaaaggaaaagcuguggugagaaguaggaagugagggcauggggagaggcaagaccagguacuguguuugagaaaccuuuauauggucuaaacauuguggaaaagacuaaaguagaauaacauuauuucauguaaaguuuaaaauaaucuucuagauaacauuaaguagggacugucagaguagaaauggaauuggguagaccaguuagaaauuguaauuuuccagauuagaaauuacaagggagcuaguugaaguuuuaagucugguucuuccuagcccaugcucccagacauaagacucagacucaaaauauauuuacaaauaguuuggccauauugcuaggcucuucucucacuagaauuauaacguaagauaaucuuauuuacuuuaaucugcauucugcugcgugggagguuaccugugcuagguaucaugagucagucuugucacaucuucuugggugacuccccugccuggcuguaugucagaauccucucugccuaccaggugucccaccuucuguucuacucuuucuuacaggcuguaugguuugguuauuuuuaacugacaggugauguauacauagaauuuucuuauguauacaggauauucuuauauguauacauaagauauucucucucuauaacguagagcaguggcuuagaaguuaagaguccuuauugcucucucauaagaccuggguucaguucccagcauacacauggcucauaacuaccuauaaguccgguucuagagaaucuuaaaucuuuuucaggccuccuugggcaccagccaggaaugugguacacauacauacauguaaacaaaacuuucauacaucuggguaugaugaugcaugccauuaaucucagcauuugggaaauagagacaugaggaucuuugaguucaaggccagccugguuuacauaguaaguucuaaaacaggcagggcuacuuagccccuaucucaaacaaacacaaacaaacaccccaaaaaaccgaaccuucauacacauaaauaaaaaucuuuaaaagaaguguuaaguggagcagggagaugacucaguggacaaagaaagcacuuggauuaagcaugagaacccauucagaucucuggcgccauguaaaacacggccauggccgugcaugccuguaacuucauagcgccauguaaaacacagccauggccgugcaugccuguaacuucagugccucuacagcagauaggagacucccugcaagccugacagccacauuguuacgguauauagcaacaagcaacaaaaugagagcaucucacgguagaauacaggagcaguaugugagguuaucuucucauuuccacagacacacacuuuuuaaaagaaagacgggguggggggaggggauaggggauuuuuggagggaaacuaggaaaggggauaacauuugaaauguaaauaaagaaaauaucuacuaaaaaauaaucucaugaaaaaaaagaaagacaaacauuaagagagguuaaggagcgggugugauaaaguauguguaaaaauauguguaaaauugagaaauaauaaauuuuuaaaggaaugauaagcuaaagucuuuagugguuuagauguggauaaugacaggcaacaaagacugauuuauuuauugagauuuagaaaaacuggaauuucaaaagaauugcuaaauucuucuuaauugauuugcuauuaggccaaaaggauucuugaaggagaucauggcucaccugcuggagagauugaugaugaagacaaaguaugugcuaauuaguaucuaucaguaauacuuuuagaacaaaaugaaauguuaaaagcuuuuaucuuuuuuacaauuaaaguauguaguuaaaucucuuuucuucugaagaaacauguuuuuucuuaaaaaaaaaaguagaauaucaaagauaaucaguugacagugaguacuguugcugugaaagcucuaccauacauaccuuuuuaaguacucuaagggauucauuaucuacauuguucacaggacaaggaugagacugaaacuguuaagcagacucagacuucugagguauaugaugcuaaaggucccaaaaauguaagaucugauguuucugaucaagaagaagaugaagaaagugaacgguguccagugucuauuaguaaguuuaaaggcuuugaaacauuuauacauauucuuucuauaguucccuuaaaguuuauaggggugcaaugaguauugugucaaacucuggauuugcaucccaguaccauuugacugaaugaucugugugaccuaacuaaauuaccuugccacugagcaccacagcuucuagugugcacugauuggaguacuucagauaugguguauaaguaccugugccacucagugaugcaguagacaguagccauuccuaagauugagugggcagauaugaugaugcgcaacaguaggagacccauguagucucggguaauuuaaguccaggaguuaguaccaacaacacagugagacucucauguacccccuggccccaauccugaagauuaaguugugagcuaacuaaaauuuguauguaaucaauuuagaucugucuaaagcugaaagucaggcuuuaacuaauuauggaaguggagaagaugagaaugaggaugaagaaauggaagacuuugaagagaguccuguggacauccagacuucacuucaggcuaacacugaaacuacagaagaaaaugaacaugacagucagguaguuguuacaaauauuucagcuauugaaacaagagccuucugaaagcuguuaaaguguauacuuuuuucccauuguuauuuucagggauuaaaaaauauuuauuaaaaaauuaguauauauauuuagauuugaaacaugccagccuguggcauuuguauuuaaucccagcacucuggaaucaaacgugugcagaucucucaugaauucaaggcaagccagagcuacagaaagagaccaugucucaaacgcaaaaaaaaucugaagcacugguuuuauuuuauaucuaauaaucuuuaaguucuucuuuguaacaaguuguaaaacuauaggauaacuuuagaagaucugauuuuuuuuuuuuuaaugguuuuucgagacaggguuucucuguauaucccuggcuguccuggaacuuacucuuauagaccaggcuggccucugccucccgagugcugggauuaaaggcgugcaccaccacacucgaugaagaccugaauuuuuaguuaaaguuucauauuuuucucuuggucacgaauuagaauaguauguaacaagcauaaaucauuucuuuuuuugccuuuacuuuagcccaagagacuauaccugauacaguuucuucuguuguuagguaucugccgaaccuugaguguuuuaagauuuauagagauauauucuauaugugagauauacacacucauauacauauuuugaaauaaacgacuuaguuuccuuggaguuucucuauaaggcauuuuuuguggacagauugcauucugauagaaagucccaguuguuggucuuugcugguacuuuccuuggagugguuucuucaaaaaauguucuccauucuccaccguuggucauagaaguuuuguugcugguauucuuaaguuaaauggaucacguuagguauuccaccaugauguagacuuacacuaacuaaauaaacccuuauuuucagugugauuuuuuuuuaaacuauguccuuacacauuuuuuaaagauucuaccucccuguacuccugccuuuucugugaagcuaauucaggucuaaaauguaaucucccaugaaaacuagaaauggcccguccuugagagacuagaacuacuaccggcaucacgccuugucaccaucaaccacugccuaccuucacaguccucccuagugcuggggcgggcuuccucugugggaugacucucacacucugcuuugacuuuguucaucuggcucuucuuucucacuucuguguaauucacucuaagguuacaaauguauccuuuaauuuugagagaagauucccgagaaaaguaauaaaaacuuguaggcucuguuuuaguccugucauguaaauucuuuuguguuuucaaugcaaaugguuuucauuguuaacuaaauccuccuugaaacucuuuagaugcuguuauguuccuguguuauagcccugggguuggauacaaaccacacagcauuauuuuucucuauagggaacauauaauuuaaggucuucuuacuauuaaaacauauuucucuuuuagauucugcaacaugaucuugaaaaaacaccagaaaguacaaauguaccaucagaccaagaaccaacuaguaagaguaagaaaucuaaacuacccuaacuuugguucuuuaacauauuuucuuuguccuuaaacuaaaaaaguaguuuuuaauuuguagcuaauauaaguacguguaaaggcauuuuggacuugaugccuaucuuuguucuucuggccuauauuuuauaaaagaaaaauguaagaaaagagugauugauuaaucuuuguuguuucauuuaguauaguguuuugaaacaggaucucauguagcccaggauggccuugaagaguuugaagauaaccucaauccuccugccuccacccuccugagucaucgaauugcaggugcaugcaugcacccauauugugccucuaacuagcaauuauuuuccauuuacguguuuguguauuuauuuugaggcagggucucuauauaaauccaccuugagagaucugucugucuguuuccugcauugugggguuaaagacaugggacccuugcucaguuuguguauuccuuuuuuuuuuaaagauuuuauuuauguauaugaauacacugaagcugucuucagacauaucagaaagagggcaucagauccuguuauagaugguugugagcuaccaugcaaccgcugggaauugaacucaggaccuuugaaagagcagucuuaaccucugagcgugcucucucucucucaaguucccauguauucauuuuuuuaaaugcauauguaccuuagucuauguacaugugucacaugaauguagugcccucagagggcacugggcacugggccauccggaacagugugaaccgauugcuguggcgcugggagcugagccccguccugugacagcagcacaggcuuugacccgacaccuuacagacauuugacagauacuaccuuacagacguuuguuuauccaguacaagugagagggcuguguuuugucucaguuuguuuuaaaauaauauucauucuagggcuuuagucuuaaaacagccuugagaaauuuaaauuaaaauguuccuaguuaaaucuguuggcuuaacuugggaaccaugaguagggagaagggauagggaucuuuucugucuuacaugucaucauuacucuuucaaagauuugguccuuaguguuacagaguaaaauugaacaaaugcuucauuccucuaaugccgagacuuucuuuucauggcagaugaucaagacagcucuccugugaaaccuuguuaucucaauaucuuggaaaaugagcaacaguuaaauagugcuacccauaaggacucgcuuacuacuacugauucaucuaaacagccugagccucugccauuacccuuggcugcaagugaaaccuuagugccuagagucaaagaagugaagucugcucaggaaacgccugagagcucucuggcuggaagcccugauacugaaucuccaguguuagugaaugacuauguaugucgucuuuacauuaccacagagguuugcuuuugaaugucugaauauuucauuuucaugaguaacacauugaauauauaaaucaaacuacacuuugugcuuagguuuagaacccgucaacauuuauucuuuaaaacuuacuuugauaguaaagggauaauaaauuaaauggccauuucaaaaucugacagauuuuauaguuuuaaaaaccaaaaaauuaguugugggugacaacuuuaagagaguucauguuuauaucugaaaugcuaaugacacauuuuaaauuaguuaaucucuuacgcuauuuuuuuuuaacuucuuagcuauuuagagcauuuuuuaaauucuuugauauaccuaaagguuuaaauuugggguaugacagaaaccuguuugacagagucauuuuuuuaauuauuauuuuccccccuuugguuuuucgagacaggguuucucuguguagcccuggcuguccaggaacucacucuguagaccaggcuggccucgaaccagagucauuauuuuuauauagcaaauuacauaacaauguacuaaggaauuucacuuauaauaaaaguacuguaguuuuuuuacucugaaccuugauuucauuuaaauuuuauagcuaacagguuaguuugcagaugucugggucauauauuuuuuaauauaaaauuuccuagcagaaauguaaaguauguagcauaauauuuuaaccccaguggguacaguguauccaucccucucuuguuguuguuuggcuugguuucuugaauuuguugguggauugggccaaucuggaacuggauaggcacagacgauccugggacuguagguccuccugccucugugccuucaguucuuucuuaaaaauuaaaaucgauuuuguucuuagauguuuucauaguaacagcuuauagauugcucagaaagggaauguuucaaaaacauccguagaaacuuacacuuuuuuuuuuuuuuaaagauuuauuuuauuauuauauguaacuacacuguagcugucuucagacacaccagaagagggagucagaucuuguuacggaugguugugagccaccaugugguugcugggauuugaacucuggaccuucggaagaacagucgggugcucuuacccacugagccaucucaccagccccgaaacuuacacuuuuaaauggcuuuauuuuccugcuguguacauuuaaguauucaaagaucugaaauugcuugauuuaaucuuuaaaacauuuuugcaauauuuauuuauuuuaugugaauguguccugagcccauauaagucaaaagugggcauuggauuccccuggaauuggaguugcagauggcugugagccaccguguugagaauugaaucugaguccuuuagaagagcagccagugagguuaacuacugagucguuucuccaaccccuuucaaaaauauuuuauuuuauuuaauuaauuagucgagagugugcauguacauacaaguguccuauugugugugaaggucggagaccugcaggaauuuguucucucaugcugugauuuuuguuuuguuccguaguuagcuuuuuuuuucauuaucucuaacuuacucauaggaagcagagucugguaacauaagucaaaagucggaugaagaagacuuugugaaaguugaggauuugccgcucaaacugacagucuauucagagguauggggcucucuucaacuaagcuugccuuuauaacaaauacugagaugaaaauuauauuuuuaauuuuuguucuaaaggaagagcuaaggaagaaaaugauagaagaagaacagaaaaaccauuuaucuggugaaauaugugaaaugcagacagaagaauuagcuggaaauucucagauacugaaagaaccugguaaaaguuaccaauuuuaauuuuauauugaaaaaucaugaucuuaccaguuuaguuuuugaaaauauacuauuacuucuuagaaaaucuaagccuacuauugaaaaaggagauguucugucaaugaauucagguccuuuauucuuuucaaauuauguaagauuauguuuuuuauuauuaaaauuuuuaguuuaauaaaguauuagaugcaaugcuaacacuaaugcuuuaugacuuuuuuaaugcuuaaaauucauguaauaucuuuuauccccuugugaagaguacggguugagauccauuuucccuccugucaucgcucauauuauuugugagguuuugucuguauuguuuuaaauauccuuaaaccuucuucgauguagaaaguaaaaaccccuauuuuuacaucaugaauuuuuauuuagauaaacacauuauuauaauuguaguaauuauaccuuguuucccaaauacacacacacacacacacacacacacacgaguauuccucguaucaaaaucaaaaggauuuucuuuuguuuuucucuauugguaguuaaaaaccauaagauuuuuuuccccuuguguuucuggacauggguggugaacauuuagacagaccagagcugcuccuuucagcucaguucugccacuugaauacacggcauccagagugguggcagccugucuguccucgggagaaggugcagcugccucccucuugguacagccucauguacuuaagucuuucaagaacauugucgauagcucuucuguuuucuuccagccacuuuucucuuguuugcacuuaaucauuuuuaauaguuacuuucuuuuucuuuuaauggaguauuuuuagaaauauuugguuggccucccaucaugaaaaacaaauacucauucuguguuuugucagggaauuugaacuaaauucacauuuuuuauuguguucuuguauguaauguaaaaacuuuuaugaaaaagaauuuuaaaaguaaauuuuaguaaguaguauuuuaauucacuaauuuauaaaacauugaucauuauucuucuuuucagaaacagugggagcccagaguauaugaaaugucuucagagacucaucuaacucucuuacauagucagcacauuuaaaaaaaagacacuaaauaaacauuugcuuugaucuguauaaaauguaaauuaguuugacacugcauuuuugaugggugugcuaauuucugcccauggcaguuuaaaacauuagaaucugaauccuggacagauucaaaccuugacacacugugggauuuuucuuuugcuuuuuguccuguuuuuucuuucuuaugaucuugaccccccccucccccacccuucauugugacauuugguguguuaacuuuaaaauguaguuuuaaauaaaguuugaacuuaucuguaaaguaugcuuuugggaaauguuguugaauucuaugcagcaaauugcuguuuuuguaacaacacuauucagaaacagcaguggucaaaaauuugagaaauucuuauuuccucuaauucuuauuuauucuaaagcucugccuuagaccagucuuucaaauaauguuaguguugcugcuguuaggucugauguucuuguaguuccugcucuugugugcgaauaaagcagaugaaucucaguggucuuagaacauguuaauaacucagacuguauacacaguucagacauuguuaguaacuagaauuuaacaggauuaucuauuagauuaauauuuuucagaauuuaaaauguugccucauucuaaaaauuaaaaaaaaagcuuuauauguauuucuguacagacaaguagcauucuaauuaauuaaaaaaaaaaaacaaacucuuucaaguuaggauaaauagaacuaaauuuauguaacagaacacuaagauuuuuaaugccuauggacaaaacaugccuuuugagaugauaauuuaaaaccaaagccuaauaguuguuuuuguguguuuugagagagaagcaaguucaaguguuaagaacgucucugugaguuuuucaucacuaaguaaaccaacucuuaaaaagugcuuugccuucugagucugucuacacuuaccacuuccuauaauauugcagagccaguuaaccaugaauaaucugucagucuuagagauuuauacuugaaaaaguaauagugugaaggacuaauuguucauuccaaguauuugcuuaaauuuuuaaguaguugucuguaauacucuauaagaacuuauuugguauuccuuuaaaauuuucacuugcagcugggcaguagugacacgccuuuaaucccagcacuccagaggcagaagcuguuugaucagaguucgaggccagccuuguuuacagauugaauccuaggacagcugauguuacauaaagaaaccauaucucaaaaacaaaauaagauucucacuuacuugauagcuuaauauaaauguccagucaguaaauaacaaaugaugguuuucucugaggacuuuuguauuguuacuuaauuuaaacuaggaccauauuucucaaccuucauuaaaauuugcaaaacuucuaaucuagaauuuacccagcuggacggacuucagggacauuagaacaguaauuuauauuauauguacaaacaaguuguguauuuuccaggcgcaaaacaagaaacuccauuuuaauccucaggccaggcuuacauagugcagugcguuguucucccucccuuuccugcuuugugucuuugcaugcauacaguggagggcuguauuugauguucgcuacuaccauagcaucugugagcuuuaucaaacuaguuuauuugacuuauguccuaccugcuaucuccaauuuguuguuuucauauuuuaguggauaauuuaguuuaaaauacccagagauugggaacaugcaaccguguaacgugauuuuucuaguaaguaucgcucagaaggaaguuauaguauuucuguuuguauuaauuuguaaguuaaaacuuugguuaguaagagaaaaaaaaucccaauaaauaagcuauaacucuuauguaguuagagauaaugcuaccauaauaaacugcccagacuguggagguacucuguauuuuguaacauucacuuuggguaaaugcuuuuucauugcuaauaaauguauaucauacauucacucugaauuguauuuuuauuuaaauugacauguucacaguaguugagaauuuauuccaaaauugugacuuaaucguuuuuuaauguuaaagauucaggacaggaagaauacacugacaucaaagguaugaauggaaaguauuuuucuugugaagagcacacacuucauuauuucuuaguugcaugaccuuugauauauacauaaaaggaauuuugagauuggaucuaccuucugugguuugaaaauaucuaagagaauauaaguguuacguaugaugcaguaagucuaugugaacaggagaggaagcacacuuuuuagaucuguucuagaagagggguguuccuguaaacucaccuaccaucgacugcuaauuacuaacuuccacaaccuuauggaagcucuccagagcaacggaaacucuagucuccucccucccuccgacuuuaacagcuuugacccuaaggucaguagacucuuauccucauuuuuccuguuucugaagaacuggguugaguagggcacugaucaaaugggggcucaggaacuaggcugcagugugaucacaacaguaaaccaaaauaucugcuuguuuuuaaacauguucauuaaauugcuguauuuauguaacauguauauguacauuaaauuguuagucuuguggagggaugcauguguacuaugguggacauuggggaagucagaggacaacuugcaggagucuguucucuacuuccaucauguggguccccagacugaacucaggucucagcuuuggcagcaggcagcuuuacccacagugccaucucacgacccagugacgauaguuuuaguucuuugucuuauuuguuguuucuaguuuuuuuuaauugugggauaggacaaagauuguaauacauauuuugcaucaaacuuccuaguaacauuguaugguuuugcagcaaggauuaaauaggauaucugucauuagucaggcccucuaaaguccauguuuguaggucaaguacggagauuuuugugugugugugugaaaaaugcuaugaaauuagugaagaagcaggcugauaaaggagaaaggaugcggugucuggguagaggauuucaacccucucaguacuauguauacuguggaaauuacuuucuaaaugggaguaaggcuagaacaaaugcagcaguuugcugcucuggaaaaggauggggcucaguucccagcacccacagcucacagcucguagcuucuguuccagcuccaggggaccugaugcccucuucucuucucacugugaguaguugccugcaccuggaacacacaaacucugguacacauacacaucuaaaaguaaaaucuaaaauaggcuuaagacagguaacgacagaaaaaagugaauggccuuuaccaauauuggcccacauacugugcccuuucaugauuucagaacaacacugacuuuucaaaguagccauuugggggaaauagcagauagagggguuggguacugacugcuggcuuugccacugugaucaugacugguaacaaugacugaaaaguuagcaaguaggcuuaggcuuaaauuugaaagagaauggaagggguugagcaugugucucaggaguagaguuccuaccaugagcaaaguccuguaagcaucaucagcucugcaaaaggggggagaaggaagaggaggaagacauuaauaaagauaagucagucuguugucuggauaucauagccaccuaagaaagaacaauaugaagaauggaaauaauagcccagguuuauacucauuuagcaaaaugaauuuuauuggauuuaucccaucuaucugaaguagauugacacuauuaaauaacccacuaaugugacucccaguaug

SEQ ID NO: 4412 - RNA, 3197 nt, Mus musculus
acuugacaaggagaaaaguaagguugaguugcucaguuacguuaauaggagggaucagaacugggauuugagccagaguuguccaacucuugagcuuuuauccugauacuguauuucacaacgacaaguagcacaacaagcaggccuucugugggaggcuccugugacccaagccugggaggcuguggaugacauuacuuuggcuuugccaucugcugguucuucccaaaacacuuaggcuucuguagggaucagaaaccuuuugagauuagaaacuguugauaaugugcuaucuuaagagggcacaugauuuucaccucuacaagcucagauguacuuaagcuuuggggauucugaagucaagaauguuagucuuucugugacugacgcagcaguacauuaaaacaccaaauucaaguuccguaagucauugaauugcaaagucuaggcacuuguuacuguaguaacagaguaugugaguccuugucaguguaaauuuuuacauucaccaucuuagaauuguggauguaggauguagcuaguccuacaguaccucauacagugagguguggcugaccgucagccaucaacaccagcaacuugucaguuuugggaauauccuccuucuuggauggggcaguguuuccuagccaguugccgccaucgagcagacugauuugcuagggcaagucuuccaucgcaauucuacauacuaugugaaaauuuucaucagaccccacaacgauuugcuuugaauaauaguuugucucucuccaggggaggagucagaccaacugaccaguagacaguagcucuucauguauuucugguaguuuuccucaucuugaaaugucauaguuaugguagaucaugcagaguacagcauccacuugggggacuuggaggacuuggaaggcaagcagauuagaugcaaacagcucaugcuucuugguaugacgagagguccuaaacucugaccaggaguguggccaaccaucaggccguguggcaggccagauacgguuaguuggcaagcgguguccgagcugaggauucuucgugguucuuugaccucgcguugcaccuaugcuacagaugcuccuugagauacugaucacugaggccuuuggagcugcugggcagugauucaggcauguaagcccuugggacagcugccucuucagaggcuccucugaagguaggucaaagugaaugacauacauuucuauacaaaccaugacguaaaucacuggccauauugaucaaaugggccggagucaacuaggauuuuagguaguggaaaucuacauaaacauaucuagcuuucagcucuaccuccuuuuuuuucugaggaccucaaccugccuuaaugguuguaguucuuacaacagcaguggcaccugaagcuguugcuucccuagaaaggcugagcaagaucaaccagguguccgagaccuggcuuucugcaaguguuaccacuaagugacaaguacccuguggagcauuuagaagaguuuagguuccagguacuacggaacugugcauacagcacguuugagaaaugaaugagaggugcagaggcauuagaaccugguagauuuggcccagaccacaauuagaaccuuugcagcugacauggaagcauccaauuugguggcucagacugucccaaaaaugcaucugcaguagggcauaacuaucaguaauugacacaaacuuaaguguuuuuauuuaccagugaaagaaaagccauugauuuucaaauauauauuuagcuucugaaaauuucuugaaugauugcaaaaauauugccuuauauuuuaucacauaguuugggaguguaacucagugguaaagcauuugccuaguaugugugaggccuaccuaggguucaaccucucaaaucacaagauagagggguuuuuuuuguuuuuguuuuuuguuuuucgagacaggguuucucuguauagcccuggcuguccuggagcucacuuuguagaccaggcuggccucgaacucagaaauccgccugccucugccucccgagugcugggauuaaaggcgugcgccaucacacccggcagauagagguauuuuuaaagaaaauuacuacccaauaccaaugcaugguugaguggcuuagggccugauaacuuuaguucaaucugugguacauauauggcagaggaagagagcaacuccaugaaguucuccuuugauuucauggcguacacacacacacgauaaauauaauuuuaauuaccaccugguuaugcuucuaaauuuauucacagugccuaaaagauugucagauuugauagcacgucuauaauccuaguauuugggaagguuggaguucaagggcauucucagcuacacugauaguuugaggccagcgagcuauguugagaccuaguuucaaaaacaaaagaaacugaagaugucaagaauuguuaaguuguaauuucaaacauaaaguaugcugauagacuguuuggaaaggcuguacuaugucccuccaguuuaccucagcauguguuauaaacacuguuccuuuacauuuauuaggauguauggguguauacuauuuccacaugugguggucagaggacaacuuugugggacuggcucucagccucuccuccaccauauagauuuuggagauagaacucaggucaucaggcucgguaacaaguacacuuacccacugagucauuccaucagcccacaagcauucuacuuuugucaguauugcauagcaugcaaacaggaaaauguuaggauucugauuguuucaccagugagcugacuagugacuuaauaacugucuugugguuucauauuugccauuguaaaauaaauauucaacaauuauuuuuuuuccucagaguugcuuuagguuuaggaaucucaaguguuucuaaacuuugcaggcaguuaguucagcaggagucaguaccugacauggcucgagacuguuaguguuacucauagagaugcaugagugaacccaauaaaaaccuugucaaguauuuguagaguggugaugcacaaggagucuuuaauuccagaccccaggcgguagaggcagcuggaucucuggguuugagcccagccuggucuacagaccuaguuccaggcauccagggcuacacagagaaacacugucuugaaaaacuuauauucugaaaaaagaa

SEQ ID NO: 4413 - RNA, 35098 nt, Mus musculus
gggggcgcagccccucucggcccugugcgcggacuccgcucuagggacucggcccggcgccucuaucucuggcguguccccugccgugcaugguguggcccagggucgcugaucacgcguuggggugcggccugcugcugguggagguggucccugcugcagcugcugcuagagucccucggagcggcgcuugcagcugggaagaugcggggccaaagucuucucaccuggguccuagccgcggcagucaccugcgcccaggcacaggaugugccgccggugggugagcuccagccgaggcacagaugggggugcaggcgcgggcucagggggaggugggcgcagcuguggcggggcgggugagggacaccugcucgcggucuguaucuuccgugaggcgucgggggaacucugguucggucccgcggaguaugggugcaaauguggcuugugaaccccgggcuaaguggcuuugcugcuguauggaccgaguacacauuuuagggaaguucuaacuuucaagaacaacuguguaggauucacgcauucuccaaucuuauauuugagauuaccagcuacuguaggcggaacucuccagagaaaaagcuaacgauugacugguggccguaguauuuucugccugguuaccuagugcuuuuuccugaagaaaccaucgcaggaagcuaugggucacaugcagucuuagcccagaugaugggaacccacccccaccccgccccccuaagaaggcuguacuggcuguggccuucacgcccaggcauggaaugucugucuguaccguggugcugcucgaccaagucacaaugccacagacuuuauauauccgcaagagacugugaggaacuaacaugauucuuguauuuacuagaagaggaaguauagcccuggagugaaaaauguagccagaggucacaucguuguucccagaaacauuucuaaguucagccucuaggucaaagcccgacagcgacauuucauagaucgauucuauaaaggcuauagaauugaagacuguuuuguugccagauuugauaacuaggaaccuggaugcaccuuaccugugccagaugacaagaauuuugaaaagaggcaagacauuggaaaugggagcagcaggaguucuuuuaauuuuauuccuagaaggagaaaugcuuuuuugaauuugagagagagagagagagagagaaaauuagccagccacuagaauagauacuuaguagauaaaaguagaaugcacaucagggcagaggguggcacacgccuuuaaaucccagcacuugggagauagagguaggcgaauguucuaggacaacaauggacacagagaaaccuugucugaaaaacaccacacaacacaaaguagaaugcagaaugguauacagaguaauuucagugaccaaaacccacauaguauguacaaaagauugaaggaagagcaaaacguuugcucuaguguagauaaagaauugauuuaccaaacuugguugggauuguaagaauuguugaagaauuaaguauuuugauagcuugugccuuuuugcccaaagauuaccaaaggacacauaaugguugagcaaacuaggucuaguguuugaugugagggacugauauagaccuuuucaaccguggguuaaguaacaacaaauucuaaacaaaauacuuggagaauuugaguguaacccaggauuuguuguagagaguagaagcagagcauccuuugauuuagcaagagaugcuguucugaguuacacaguguguaacucuuuaucaguguguagacacaaucaugauacaagcuugcuuugucucacuuugucucugcgguacuuaauuccucuuuguguccaagagcagaacacaaguccaugggguccuauaggccuguaagguguuaaugugcagcuaugaacucagagcaguuucauguccuuagagcuguuauuuuuguguuuguuugcuuuuauucuuucuuaauacuuuguuuuuaaaugaagauaucuuguuguuuguuucuuuaucugguuuugguuuuuuuuugggaggguuguuuguuugguuuugguuuuuguuuuuguuuuuuuucccccagugcuagagugcucacccaggaccuuacacauacugggcaaaaggucuuuuuuuuuuuuuuuucuuuucugauuuuuuuucaagacaggguuucucuguguagcccuggcuguccuagaacucacucuguagacuaggcuggccucaaacucagaaauccgccugccucugccucccaagugcugagauuaaaggcgugcaacaccacugcuuggcuggcaaacgguucuuauaguuauaucacuagcccaagcaaaauauuucauuguuuucaaaauaugaaaaauuaauaacccuucaauugauuuaaugauuuuuuacucggaacaguggauaucaaaaucuagucggucuacugauaaucugauuggaaaaguguuugcacaggucuuaacugaaaugagaaaaaaauaagaguuaaacaaaaauaguaacuuuccuuauauuuugguuuuauggccauuuuauuguuauugagcuuuucucucauuaaaaugacaaagucagguguuacauggagaggauuuauuuuguuuuaaaaucuucacuuacaaaauaaaaauugggacccuuuuugaguggaggcacuguuaaaauuuucacucucuugaagauauugggacccaguuuucuuuuuuuuuuuuuuuuuuuuuucgagacaggguuucucugugcagcccuggcuguccuggaccucacuuuguagaccaggcuggccucgaacucagaaauccgccugccucugccucccgagugcugggauuaaaggcuugugccaccacacccggcaugggacccaguuuucaaaaggcccuuuaagagcugccuggaagccuggggaccuuguuuucugacagaauggaagacaguuauuuugggggguuuuguugacuuguuuguuugauuguuuuuugguuuuuuuuuuuuaguuugaaucauuauaugaauaauaaacuaaacuuuuuauuguaguguagccugugguaaccaaauauauuucaaaaugaccuuugauagguguggauaaggacaagcuucaaaugacaaaugaguuauuucguuuggaacauugacugagcguuuuaguuuuauguuggaggcuuuuuucaguauaaguaauugaaggugaucuuaaguuauucuucacuauuccaucuaugaagaguucauuaagauauauugugcagagaaaaguagcuaguagagaaaaauccagaaaaugagccgggauauugauagucuaggcauaaugguaaucuuugaagccacuggagcggauaagcuuuucuaugaaaaguauaaaugagaaaaugagaagcagccaaaagcugagugaguuucccaugugugugccaagugaagaagaggccagcaaaguuaauggcacagcccaaaugggcaagcucccauggcaggacgggcaaggaagggaucgaggggguuacuguuaaacaccauugagaauggaguguccauucugcuggcgacuggaagcuacugcuugucuuguagguaguacagugacagaaaggcaaugcagcaggaugaggagugaugggaaggaaaagaccugcagagaaaugaccacgcucucaguaauagacccgagcagagccagaagugugacugaacacaugauugaguaaugaauugcuaaaaugaacugaugucagcuacagauauguguggugaaacuguuggcauuggcagugacuuucacaaagcuuccauuaaucucauaagccuuagaugauuuuguccauauugcuggacuacaaaggaaagaauacacaggcauaaucuguccuuuuaacuaagugcuguuccagaguccuucccacaaaguagcauugagucagccaacaagauaaacuaggcucaugcccucuugggugguugauucaccuauuuauuuaaauaccaagagcuuacuagguugcagccaguuaaaucccagaagacaugagagcaaccaugucuucaucuagauuguguuugugagaaacuugcccugaucuucaguaagagucuaucauguaacccugcccguccuccaacuggagauccuucuucagccuuccuggugcucagcuuacagguacacacuacugagucagauuuaaaauguuguguauauaauuagaaucauacauuucauugagauuuucacuucucuugugggauucaaauauauaaaggacaagguuugcuacuguugaaaaauguguaacauucacugauuccuuaaugaaauaauuuucacuugguguguuauuuguauuuaaaaccauuuuuuaaaucuuaauuagugugugugugugugugugugugugugugugucugugugugugugucugugugugugucucugugugucugugugugugugugucugugugugugugugugugugucucugugucugugugugugugucugugugugugugugucugugugugugugucugugugugugugugucugugugugugugucucugugugucugugugugugugugugugugugugucuaugugugugucugugugugugugucugugugugugugugucugugugugugugucugugugugugugugucugugugugugugugugugugugugucugucuguguguguguuucugugugugugugugucugucugugugugugucugugugugugugugucugugugucugugugugugugucugugugugugugucugugugugugugugugugugugugucugugugugugugugucugugugugugugugugucugugugugucucugugucugugugugugugucugugugugugugugugugucugugugugugugugugugucugugugugugugugugucucugugucugugugugugucugugugugugugugugugugugugucugugugucugugugucugugugucuguguguagaaggucagagggguaucagaucaccuagaucuggaguugcaggcaucugugagcugccuggcuguggaugcuggggaucacacugaggucuucugcaagaacaguaugugcuguuaacgauugacuacugagcuuucucuccagcccuguguuauuguuauacguguguuauauucaguaacgagacuuucccuaaugacuaugaaggacauaaagacugaucauuuugaauagauuuaaguugcuaucaaauaagaagaaacugcacugccagcugaacucuugaucuacauuuuuuugucccgucccccccccccaauuuuaaauacauugaaacauuguuuuucuuugucuuagcaacauaaaaagggacuuucuggagguggggauggggagaagugagacauugagauucuauuugggauuuuguuuuuccaagauaagguuaaucuguuuagcccuggcugucuuagaacucucucuguagaccaggcuggccuugagcucagagaucugccugccucugccucccaagugcuaguaguauuaaagccaugagccaccaccugguuugggagucuaaauuucauuuuuuuuucuccuguaaaaggguaguguaauauagugacagacuacuaauacuguacuugucuauuuaaaauguuccugccuugcuaaacuugucuuuuauuaaaaccaucccugaggccccuugguauugcaaacuuuauaugccccaguacaggggaaugccagggccaagaagcgggaguggguggguaggggagcagggcggaaggaggguauagggaacuuucgggauagcauuugaaauguauauaaagaaaauaucuaauaaaaaaaacaaaacaaaacacaucccuaguugaauuugggaauagucagagaccuuaaacagugaaugagaugaguccaauucuauuucagugcugugcacaaguuuugaaggugguguucccuugaagaagccguugcgacugaggaggugccucucaugaguccccagacuagccuuccauuuaaaugacuuccauguggggaccuugugagggacugagauaccaaggucuguggcugccugcccuccuuucucucucucucucucucuuucucucccucucucuuucuuucuuccuuccuuucuuucucucuuucucuuuuuuacuuguguucauguuuuauucuuacagacauacucugacuucucuuaacgucauauaaaucuuuggcucuuuguuuugggaaccagaucguaugucauuuucaugagugauuauagcagcccacauuacuauagcccucagcugugacucccacauguagcauuggcugguugcuuuccagaucuuaccacuuggacaggucaucuuauuuccugaacacccgacugaccacuuucaauuucucucugaggucuucaauaagagaugugcgugugguuugguuuuauuuuagcuuuggaucccaugucauguaaauguaaugagaaagugauaguagucauugugguucauuauuuacuuaauugagucugguugccguggaaagaucugaacucugugcagauuauucuuuuagggaucaaacugaagcacuauguguguguguguguguguguguguguguguguguguguguguguguguguguaggccaaagguuggcaugucuuaccuauuguuuccaccguacuugagacaaacccucccaugagccauuuagcucuguuggccaggaagccaucagguauguccucuuucuaugaacuguugccucuggggcaacagaugugugccaccaugccugguucucuuggugugggcuggagauucaaacccagcucuucugccugagcagcaaacacuuuguucccuacacuggcuccccaaucccuaaagcagcuuuuacgguugugcccuaggaagccgugacagcagcaggugaagcccugaacucggauucuguccaucccuaauggagcucagcccagcauucugaacaugaccauacaauucccaguuaacuugaaacugagcaaaaggaaagcaacaggauguuuguauaucgagucauacuuucuaauauuuauuuuuauacauguguaugagugccauauaagugagggugcccucagaggccagaaagagggucuuagguacccuggaggcucagcuacagguaguugucagucaccuaacauggguucugggaaguauauauacuugggucuuuccccagagcauugugcauuguuuagcucccaagccauacaguucucaggucuaguguaauccuaaccaaguuuggguaguuagaagaaauguauguugcucauguuaauggacauacgaauugcgcuggugaaucuaguaacuacucaccuuacuacaugacuugcuuuuauucuggguuacuuuauguggaugggugguuugccugcauauguuugugugccacacuuguguagugcucacggaagccagagagugugucagguccccuggaacuggaguugcagaugguagugagcugccaugugggugcugggaagcuggguccucuggaagggcagccagugcucuucaccucugagccaucucuccagccccacuaaaugauguuuuggaaguucguaugugugguugaacuacuuuuacaguuaccaaccucaaucuuauuaaacaaggacuagugaauuuagagcacauauagugacaauuucauuuuuuugguuuuuuuuuuuucggucucucucucucuguguguguguguguguuuguguguguguuugacuguaggcacacgcacgccuucucucacguggaggucagaggacagcccugguguugguccucaccucacgucuugcggcuugagaucaggucacuuuaucuuuccccugcacaucccugcugcaguucggaagcuucuggggguuuccugcuuuugucucccaccucccuguacacuccuggaguugcagccccucgugcuucaugcacugcuuugcgugugcgaggggucugggaauccugacucaggcccucccagcuguccccagauggagcuuucccucgcugagcugucucccuagcuccucuuccuucuuccugggacuggagagggacucagccagccugcuuugaacucaguauguccugaggaaggccuuaaacuccugagcuuccugccuaccccucccaaaugcugggagugcaggugugugcugacucgcccugcuugcaggggcucuugcugccuuaaaagaauuccagguaaugguaauuucaaacuuuuaaaauugccagagacucauucucugaaaguucuccauguauugugaaguaaaaucauacaugcuaaagaauaaauauuuggaaauauauauaucagguauacauggguaaagaaaauggggucaugugggcaggcuccuaguccauuccuucuccaguccccuccccgagaucugccaccugcaguuguuucugcucuuaccugauggaugauuacaugcucaggaaucgucaccaguaucuccuggcacacgaguuguuuacagcugaccuucuuugauugugguggaaucaaucaaagacuacagguaucauuguagugauacauggggcacuuaaaauuaauguuaucucucuauguauugauauuggugauguaguauacuauauguaucugaauuaauuagguucagguguugccuaucucgugcgcaaggauggauaaagagcuuacuuuaaacacccuucccacuguuacugucuuccuaauugcucuguggagauagcccucaugaaauacagcucaccauuaaaaguacacaacugggaggacugagauaauggcucagugguuaaacacuugccacgaaacugugaggaccagaguucaggacucagaaauccauguaaaugcuaagugggugagguaaccaucauguagaaguccuggucucgggcuggagagauggcucagagguuaagagcacugacugcucuuccgaaggucuuaaguucaaaucccagcaaccacaugguggcucacaaccauuaaagagaucggacgcccucuucuggugugucugaagacagcuacaguguacuuagauauaauaauuaauaaaucuuuaaaaaaaaaggaauucucagucucugaaaguggagacagggcuggggaaguccuugguggguaggaacacucacuguaacaauaucaggacuagaacucagaugcccagaacccaugugaaaagauagguguggccgugugcacacagaaucccaccacucagguagagauaggaggauuacuggggccaaaacacagcuuuccagguuugcagaagaccuuuucucaaaggagugugauagaacaggacauucauacgguguccucgucuggucuucacaguggaugucugugugugccuguguguguguacauguguauauuacacacacacaaacaauaaaacagauucagcauagucacagaacuguacagucaacacugcuaucuagcuuagaacaguuacccccuaggaggaaaaucucuacauuuauauauuuccacuagcagaaccucucuccauagacuuaaccauucugcucuuugugacuggcaucuucuacuugauguagcaguuuuaugguucuuccuuccuaaagcuuauaucauuucgucauuucuucuugccaaguaagauuccaugacaaaacauagcucguuguguuuauucauucugcagguggcagacguuugagcucucccacuuuuuggccaguaugaguaacacuccugaaaauaucacgcuuuugugggguuuaugucauccuguaucuugggauguacguaggaucaggauugcugggcucgaggacaguguuuaccugucgaggaacugccagauggcuuuguaaagcaggugcuguuuuguaucuugcuggcagcacgagagguccaccugagugaucccgugugcuggcagcaugaguaauagcaacacucgcugcugcugggucucaucacgggaggaucacacgcuggguaccucuccuccuuugauuaugggccauuugcauaucuccuggaaaugggccuauuuggaucuucuaucuguauguaaaauugagcugccuuuuuauugccaaguuuugcguuuuacaaaauauauugugggcguauacugucagauauacaaugcgcagcauuguaaguggagacuuaauuuugaacucuuggaucuauuccacuguuuuauguauuuguaucuauaguagcacccacuguuugccacuguguucaagacucacuguuacuuugauggcccuaagauuuacaccuuauuuaagcagaggaucaucauagaguaacucacuacacuuacuacuguagucaaaguuuaacuucauacaaauuaauauuuuaccaaacacacaaaauaauagauuuuuuaugacauuuucauacguguguagcacgccuucugcuccuauuuguacccagcauuuuugcuacucuuucucuuuuccuuccccuuucccuuccccuuuccaccacacaaagaguccccuucugcuuucauguccucugugugugugugugaguauguguauguauuuaggaguauguguauguaugagcauguguaugagagaguauguguguguauauguaggagugugugugugucuaagugugugugaguauguguauguguguagacgugaguguauguguaugaguguguguguguguguguguguguaagugaaauucaaugagacaugauaccugccucucucuuuucucuuccaucuccuauucugcucacccccucuagaccccguccucucucacauagccccauuucuuauaggaaguuuuaaaacugaguccuccaacuuuguuccuuuccaagaugaucuuagccauucuuuaugcugagacccauggauuuauuuuaggaauaugaucauuuucacagaauuaaauccuucacgcacaaccccccccauaugacaccuuuuauuuacuuauguuguuuuuaaucuuguuggaaaguauucuguaguuuuagguauauuccguuuugaauuuccuugguuaaguuuauuucuaaauauucuuuuuauuuuguuuauguguuugagacagucuguaucauagcccagaauggcuuuagcuuuugauucuccugccucagccuguggagugauggauuauacauguguacuuugucuguagcuauuguuuugaugcuauuauaaauggaauuauuuuccuuuaauuuagcuuuuaauuauauagauacgcgauugcuaauuugguauauuguuccaaugucuuguagccuuagacuugauacuucuaguaaguuuccaguagauucuuuugaauuuucauacacugcaugacauugccucuuuucuaugucagaugcucuuuauuucauuuuguugcccuguuuucuuggguagcacccagacaucuugucuuuucuguguucuucuguuuccuuuuucagagcuuuaguuguuguuuugguuugguuugguuuguuuucacucucauuuaguaaauuuuggcagaguuauuccaauuguaauaucccugcccaaacuuuauuucucauuuuagaucaguaaaaauggaaaugguaaacuguuuuauuugucaauauugguuauuguccaauaugcuuugauuuuauuucuuuauguguaguucugaaguccucuaccaguuguccagaaucaugcgacuuugucuggggcauuccugguauugaacacagagccuggugcaugcugcauaagcagacacugcugcuuugugacuccagcagcacagauaccgagcuuaacucacauccauuugugcuuugccuuuguaagcuuguccccuggaguuuauccuugcuugccuccuuccugccugccugccuuccuuucuccccccuccucuuccuccuucuuccuccuucuucuuuuuuugucuuguuugcuagaaggacccaagccguagucaucccuguauccccacuauauuuggaaguucaauaucuuucauccauucuuccugaaaucuacugaauuucuguuggagugaucaccauguuaauauuugccccauuuauuucucaaugccauuuuacaugucccuaacauacacacaaacgauaaauaaacauaaaagcaauuuuuaaaaauuugagcaaaaaaguuuacuuaggaaaauuuauaaaaccccaaaaacaaguguaguguaucacugggugugaugaaggguguggugaagaggaggcggggacaguccaugaguuugaggccagcguaugcuacauugugaguuacaggccaucugggacuacacaguaggauucaguuucaaacacaugucacuguauuuaauauaagcuguggugguuauuugcaguuuucauugucagcaucguagacugucaucagauuucugugaacuuuugcuagaagccgaagcagagacccugacucuucuguauauaaacauauauauaauauuucagcauauagacauauauauuuagcauauagacagcuggguaacacaaaaguuuuauacauuuucuuuugagguccuagcugagguugaaacauuuuugagcaagaacuuuuacaaucaguauuauuuaacacaaaggacucuuugcuccagacuucuuacugcugcaucuuaaggaacucacuggaagcauacuuagacaagaaaccuauccauuuugggcagagugaaaucacuaaauacucgccaugcugacagaagucaagugugagcuuuccauugcugcauauuguucagcagacagagucuaagcuccagcuguccacacagugguccccuccaccucucugccuccucuuaccugcagagcugagcuucuuccuuuacuuucugagucucagaucacuagaggccaggagauaaacaugcuugcuacauggaagaagugacaggagucauaaauuggcaugaauacuuuuggaugaugguguguuagaagaaaaguucaguuuggccacuaacuaugaacaguuauccgugaugcagccucuuucauccauuguccccagcaguggccucagugcucggacugcccuccuaugaggaaacacaguguggcauugagagggcacagaaaauucuaauacaacgugauacucuacuggagauguguauaggagaugacugggcuuguagaggaggucauugagacuucgaagaacgagugcugggggaggagaggggagcaaguguguggguuggguuuuagaagaucaccaggucagagcaugggcguuccgggcagaggacacagcagauguauagaauggaagcaugggagguuuaggaaguguuuccuuauacccaugcuauuaggagugucuggaacaggacaaggaugguaggcuuugaacagauuauuaaaugccuuaugcaccauagccugcagaucugguuugggaugccaaucucaagucaagucgcaauagaguugccucagagauuaauguaaagcgcccuccuaucaagccauugacuucgggugacuuugucuuuguguaaacugaauugaaacaguaaugaucuggggauuugagaggcaagaguuuuguuuuguuuuguuuucugaaaagguauugaaugcuggggcuggagagauagcacagaauguaagagugcauacgucucucacagagcaucuggguucaguucccagcacccauaagguggcucacaaccaucugugccuccaggucuuagggauucacgugcccucuucuggucuccucagauaccaggcaugcaagagguacacauacgcauuuaggcaaaaugcuaaaacaugaaauaaaaguaaacaaaucuuuuuaaaagguauuaaauaccaguagcugucacauauuccuuugaucucagugcucaguaaauccagguaggaagauuauaaguuugaggucaguuugggugagcuacauaauaauaaauucgaagccagccugaacuauauagggagggagacccuaucucaaacaaaaauagugaaaugguuuuaaaagaugguucuuaauaaacuauacuuuuuaaaaauguugcuucagggcuggagagauggcucagcgguuaagagcaccgacugcucuuccaaagguccugagcucaaaucccagcacccacaugguggcucacaaccauccuuaacgagaucugacgcccucuucuggagugucugaggacagcuacaguguacuuacacauaauaaauaaauaaaucuuuaaaagguugcuucaacuggaaagcauuuacaauuuugugaaauuuuuauuuuucucuguuuuuuaguggacagaagauugcagaaaaucaacguauccuccuucuggaccaacgugagugagcgcagauaauuaaaccauuauccugugugcaugcuguucuuuauaauagucuucuaguaauuauagcaggaaaagaaaccgaggccaugucuuccaucuggagagaggcuugguuuccuuaugugugugucuuauguauauggcuaaggcagaaaugaagguaauaugauuuagauguuuauuucuugccccugaaacuaguaagaaagcgaagaauaccuacgcaucgacaaacaauucuaucuccuaaggaacguuuuugcucuaugacagacagcuuguaucacaccuacugagcggugauacucuguggugccugccuauaagcccucagacuacauuggaacauauaaaggaaccugugugugaaagagucaagaaacaaaccuuaacuugauaaaguuuucaggcaaaagaagaucaaaaaccauaagacaaagacugaagcuacauuuuauuuuagucuaacauuuuuaguucacauuuucaucuuuccaaauauuagugauggaguaagccuuggaaauaugcaguuccaggcgagaggcccagaggggacagcacgcaggaagaaggaaggaaagguguaggggagagcugucuuuggccucuggucuucccucuuccugcaagcacacuccuaggguggaagaagcagagugcagcgaagacuuauggguuauguauuguuacaaguucccacuggcccuuuuccuaauccauguauuguacguaaccucugccagcacucuugggagcugagugucacccuguguccaucccuuagagcauugcugaugcucauuaacugcucguaucuguuguguuguuuguucauguaguguucugaccuuuggauuacauuauaaacugccuuggagccauguaggcuuaggcaggaugguuuaugcaguggucugggcauagggaauaccacguuucaagcgacaaagugauauuguuuauaguaaaguagaaccuuacacucugccaauucccacugauugagcgucaguggcuguugguuaagaggacugugauuacccaacuuccuucuauucccuccccuagugugaagauuuaggaguccagcuucaggaaaggucuucuccaucacuacugaugugaucuuggccuucauugccuuccugagugugucuccuggcuggucuuacugcccaguucacugagcauuuaaugaguacuuucucuacuaaaggcaguuuuccccuacugucuuuuaaaauguauuuucuauauaucugagacuacauuuuauuauaaacuguaaaccuucccugacuaaacauaauacaauuuucuacucucucuguguauguguguguguguauguauguauguguguguauguauguaugugugugucuguguguguguauguguguguguauguguguaugugugugcacauguccauaccuagauacuguaugugguuuuucucuuugcuugcuauuuuuuuaaaauauuuuuuauuauuacguauuuuccucaauuacauuuagaaugcuauuccaaaagucccccgugcccucccccccacuucccuacccccccccccauucccauuuuuuggcucuggcguucccccguacuggggcauauacaguuugcguguccaaugggccucucuuugcagugauuucucuccguuucacuaucucauccuuccacacugaaauccucugcccuauuccuaaccuuuucuugucugaacuguacagcagcagcucuugagaucugggagauaagggugacauucguggaccuuuaauuaaugaguguuuucacaguccuaugaggucauccuuuucaaccaaaugcauggauaucuugguggcaugcagcagcaaaugugagggaggaaagaggcaagggacaccuguucgucuggccagaccagucacaucaaugcagauguucaggaacugacagccacaucacccugcagccacuggagucccauuaagcauuucuuuugcugcucguuagcugcuuugcaccugcucucuauuuguacacaugugcauugugucacucgggcuaguuuacaagccaccuggaaagccaggaggguuccgaugauaucauuacgagugcagugaccgggcuuagcaacugcugagacucacauggacaugguaguuacacuguguauggugauguagcagaaccuauauggaaaucucuauugcucuaaugccaaggacugucuacacaucucauggacucuccacugcccucauaaaggagacaccuccugugucuauaggaaguagagguacaguuuuuaaauaaaagaauaucuuagaaaagauaucuuaugugagaaacuauaagauuaaauuaaguuuuaauuauuagaacaacuuucuuaaucagaucuuucuuaaagcaguucucaaaaaauucugauuaguggagguuuuauuaucaggguuuccugucuucuuagucccacaaaaguuagaucuucucugauaauuuucucaaccucucuguuuccucugucaaaugcuucggccuguccuauacucaacugaagaugacucaggaguuuauggaaggcgcucggauugcacugguucuguuagauacaagaaggaggggcugguuggaauucauagguaaagcaccagccaccgucaggcaucacuucaagagcucagcacuucguuacugcaacuagacauggaaauccaaaugcccagcuuggggggaggaaagguguaacuccaucucucuauaaauggggcaccagauuacuaaacugugggacacaaguuugcauaaggaauaugauuaguuuaaaaaaagaaggaggaaaaagaauugucauaaugaaaaggucccccaccccaccccaccccaaagacuccagucuucaugcaauaucaacuucuaaggagcuaaggaacuugaaaagaacaacgaaauucauucauuguaguuugguuuaaacguauauuuccaaaauugagugcauuucucucugcaucuaaaucauaacgcaaauggguacuggcuagcaauuucauaaacccuuacacauauaccuggaucccaagcucagcaacuuuauuuaaaaacccacauaucauaguaguaaaguauacagagugucccaguaaaugccugucaggaaauaacccaucccuggcuauaaauauaagguuagaugaucuguuaagagccagguagcgccgggugugguggcgcacgccuuuaaucccagcacgcaggaggcagaggcaggcggauuucugaguucgaggccagccuggucuacaaagugaguuccaggacagcaagggcuauacagagaaacccugucucgaaaaaacaaacaaacaaaaaaaaaacaacaaaaaaagagccagguagcccugcaccacauaucaguagguacccuaugcuuuucucaaaguaauaaauggcucaagugauggauguuuuccgauuuagcuuuuaaucuaauaaaucauugaaugccacaccccugaaaccuauuucaguuuguucaaaaguaugaaaaaggccugguguggcggcacaugccugugaucccggcacuuggucagagccaggaggauuugagguuccugaauucaaggccauccuugacuacauaguaagaugaaggccaaccggggcagcaugagaccuugucucaaccccagcuccccaaaugggucagacaaugaaggugcaauagcaguagaagcaacuguaggguuaguacacccggaguauagccauccauuacuaauggguggacaucacuucaccccauagcagggauugcugagugugugaguaggaagucgagaauguugguggcagauuagacaggcaagaguguacaggagcacuggggaagaugggcuggccuuggagaaccagaggccaucuugggaagcuuguauuguuaccacucugggcuuacaggugaccucacuaacccaaucacaaaggaacucacacaauauguaaucacugauaaguggauauuagcccagaaacuuaggauacccaagauauaagauacaauuugcuaaaugcaugaaauucaagaagaacgaagaccaaaguguggacacuuuacccuuucuuagaaaugggaacaaaacacccauggaaggaguuacagagacaaaauuuggagcugugacgaaaggauggaccaucuagugauugccauaugcagggauccaucccauaaucagccuccaaacgcugacaccauugcauacacuagcaagauuuugcugaaaggacccagauauagcucucucuugugagacuaugccggggccuagcaaacacaaaaguggaugcucacagucagcuaauggauggaucacagggcccccaauggaggagcuagagaaaguacccaaggaacuaaagggaacugcaacccuauagguggaaaaacaauaugaacuaaccaguacccuggagcucuugacucuagcugcauguguaucaaaagauggccuagucggccaucacugcaaagagaggcccauugggcacgcaaacuguauaugccccaguacaggggaacgccagggccaaaaagugggaguggguggguaggggauuggggggguggguaugggggacuuuugggauagcauugaaaauguaauugaggaaaauacauaauaaaaaaaacaaaaaacaaggugacgucacugaagccguaagaagagaacaauuugccaauaguguuagacugacugacaaagcauuccagacuagaaaaccaagugcugaaggguccuagugucuagauggucuagaguucugggccuagacuaaauuguuacagauauuuaggaaaaaaacaaaagcaaguauuuucugucagcaguauuuuaaguuauagcccccgagccacaguugacucacauauuagcaagucauauuaaccuuccagaccuaguagcuauaauuguuuuuuguuuguuuguuuguuugcuaguuugguauuuugggcaggggacgggggacguuggagccagggugucacaguguagcccagcacucuugaguacugcgacuccuauggcaggcucagaauguagaauuguauucugugauuucugaguuuauuucaaauuguguguacaaaagagggcugaagcacugcgugcaaacccugacuucuuugcagauuuugcuuugaguagccagcuuccaugcuguugcugugccugugugucugguccauccuuucagcucuauaacccuccugaaaggcacuucuuuauuucaagauguugcccucucauugcagcuauagaggaccaguuccguggcacaccauaaaucuugauuuaccacccuacaaaagauggcaugaauuauuggcucaaaaggcaccagcgguauguuauaaauguuaacucuucuuguucugacuuuaugaaauauaauucugcuuuuuaaaaacuacuuucuaaguugcauauggaagcccacaccauaauccaagcacuugggaggacuguggcagaccaaguguuaggugcuuaggggccagccuggucuacauaaugaguuucaaaguacccucugcuauagucucaaaaauacuacuagggaagauaaaagauggguugucauuugagagcacuugaggacacucaggaucauaggauagcucucagucaccuguaauucuaguucaguggaguuguuuggccuuguuugacaugaggcaugaacaugguauauauacguacuacucauacauauaaaauaaaaauaaucuucuuuaaaauuacuacugaaaguuaaaggcauauauuugauuuucuuccacuauguauaguaauugauagaggaaaacaucauuucccuguagcuuuuuguaauuugggacauagaauuggucucuccuucccuuuguacuaucuuccuucaucugaaugauugagaagcaaugcuacuuuaaagagaaaauuguguucauaaauucauugaaaauacuuucaaacugugcuauuuuauuacauauuuugaauaagucagaucuaaauuguuuuuaugacagcaauaugaaucuuaaaucgcaguacuuauguauuuuuaguguuuuauuuauuuuucaguugaggauuuuagugaauuccauaacgaguuuagugaauacauuugugccaaguggaaaacuaaugaagaugguggaucaaaagcugguaagaaauaauuuauucaauuaauuuuaaggauacauauauaaacacauggacauagaguuuuaaaauacaugcuuagguggagaaacauugaagcagcaaccucaggcccuacgugggucuaccccuaguucucacagcaaugggaaaauacacaaauuucaucaggagcaugaaauuuugagcucauauuauaguuugguguauagucacacuacugaaaacugaguuucuuuccccuugagaguauauauagcucaaugaugggacaccaucauaaacuauguuggaagccccagauuugaucuuagcaugagaaagaaaaacuuagaccuuaaauuaacucaaguuacaaguaaaucaagaaacucauagauuucucuaaauaaagauaaaaugacauguucaggcuaacuguguauucuguggaguccauugguaucugugacccuugacacucaauuaugcugaauguuucuuguagcuaggcaaucacuaagucauuuccuucccugaccccgaguccuacaggaagacugcauuucacaauaccuguuaaauauaggugguaccgaugaacaucaaaggacuggccccaaaccucccaagguguccucaucaucuuucagauucugcugcaagggcaggucauagagaggccggaaggcucuggagcagauucagagaacugauggcuucaggaauuaauacucuuagcugcaagucugggcucuacccacugcuuucuucuuugguuguaaccaccaagacaaucaugagacauugccaucuccuccaggacagaacuggaaaacccuaguugaaagcccuacuccuagagacuggaugagcaaagcaggcgccccucccuaugaccugcugggccaggcuuauguucucaccucuccauuaaaguuaucaaaugcguuaaagggacagauucacccagaauaaacauugguaggaacuaaaaggaggugagugaguucucacgugcccaguaccuaaacccuccucuacuccgaaugucaguagggaggcagcagggcgguuuguaaugccaugguuuaaaaucuguggugcagguuuugaugccuugaaauuacugcauucuaaggaugcagcagucaugucccuaugaaauguuacuuuccugguucaaaggauaauauuuaggaauaauacuuacuucauaugguggcugugaggacuauggcauaucacucuguaaauguccugcugaaccuuugucaauaagccguaguuguuaaauuggcugggacauuuaccucccacugaugugaggucaccuuaugccgauggugaaaacaggauaucggagcagcgagauagcucagugccaagccagaugacccgagguccaucaccagaaccuucagaguagaaagagcaaagcagcaccugcaagauguccucugacucccauacgccuuaugacauguguaugcauauucccccuacacaaaauaaguaagcaaauaaaguaacaaagagacuuuuaaccacaccuucuuagcgggagaauauaaauugugcucucaguguuugugcuuagcugagguggagaguacgauacaguguccaucacugaauuugcucauguguuguuugcucauugaagacaacuguucaacuuaggagaagccauuaacaaugacagccaguguuguaaaaugguagaauacuaugcguuuguugcuggguguugccaguugcuaaagagugaagaagcaaaacuuggcucauuguguugaucgagauaguggaucaccuaaagucaugcagguagaacgacuccaguccccuucugucuggggacugggccaaagaucaggagggaaacaaaaaaucuaagaaucacagguuuuguaggaguccaacaccaaacauuauauagacucuuuuagaaauacaugacauaaugauuuaaaaauaacuuaugcuaaaagaguucuaaucagagagccagauugcaaagcauauguuuaaguucaguguucauugguuucuuucuuuuuagccugguaugauuggcagccuuccugacccuuuuggagaggaaaugaggggaauugcagauguuacugggauuccucuagguaacguacaccuugcaaugcuuaaagcauuuaauaaaacccugugacauaauugcguugaagucggaugcaaaugcaguacauauaaugaaaugcacaaacccuaauuauaagcagcucaucggagguuuacccagguuccaugcuugcacauuucaucauagaaggugaagcacacuccaguccuccagaaugcuucaucugccccuucacagacacuguguccuccacagguuacccuggucugccuucaccacgcuaagaacaaggcugagcauggcugcagggcucucuucaccauggcgguccaggcucuugacgagaugguugcucuucggacuuugaucacuaauaguggggcuguuguugaugugcgcgagugcauuccugugcguguuucucuaauggagacacacagugauuucucuugaacugaacuuuugagucacaggguagcuagugagguacucagccuuguaaaucccccaaggcaguuugcuaacaugagcagaauuauuggcagcacagcaugagaaauuaaacguucucacauggacacuacguucuccugaugaguuacugacuuucugucaguuugacuuuuuuuauuuuccucaauuuuggggaagggcaaaacacuagucaaguuuucuuccucucuucccuccaugugucacagugguaucucugaccuagucaggugguucugccugcgaacucucuucugggcuguuaccuuugugugugugggucccgugugagcucaggaacugaggcagcuuuaccccgucaccuucggccuccugcuggccaugcuggccugcuuuacuccuaugugccucagggucggccugccccugaccaucaguguucugaaugaaauuagaauaucgugaauauaguuuaaugucaaccuuugcuuaaguauugauuucucaaagacauuauuucuuuuuaauuuugggagaaaagaucuuauauauaauucauuauucuuagguagugauauuugggggcuauuaauuucuauuuucuugguuccaccuuccuuuuuaagucacugcuguguagcccggcuggccucagcuucaggcccugcuccugcuucagggguacugggguucugggcaugcacagccucgcccagcucucaaaaguuuguacuuucaguuuuucaguuuaagucauuuauuggcaaagguuuugcucacucaccuaaaagcaaccaaagcgauugagucggcguuuucugacacccgcagugcuuucacgagagaacugauggacauuuucuguuguuucucaacagagcuggcuagugcuuuuguuuguuuguuuugcugcacuaaacaguguguuucaaggggcagcaagcuggaucagcaaguacaggggcguguugauuaggccuuacaacccgaguucuagauuccugggaucuacaguuuucuucucaccaccacauguacgccaugccaaaccuuuuuuuuuuuuuuuuuuuuuugagacaggguuucucuguguagcccuggcuguccuggaacucacucuguggaccaggcuggccucgaacucagaaaucagcuugccucugccucccaagugcugggauuacaggcgugcgccaccucugcccagcuacaccaugccaaacuuacacacacaaacacauguaugugcacacgugaauaaaugcacauuuaaauaaacacaaaaauauuacaacgucugggucaugguggcacacaccauuaaucccaguacuugggaggcagaggaagccgaucucugaguuugagcuagccugguuuacagagugagugaguuccagggcagccagggcuacacagagaaacccugucucaaaacaaaacaaacacaaacaaacaaacaaacaaaaaaccaaaagcaacaacagcaaaaucuaacugaaaaacaauuuuaaaaaauaaaauacuggaaauauauacuugucaucuacaugagaagaaagucuuauauaaagaguuaucacaaguaauuaccaaauauaaauaacucuagagaaaaauagauuaauaguucaugauaauacugagauucaucaaaacauaaauaaacugagaauaagcuaggcugaggucaaaaugcaggcuaagcacagaauguuagcauuuaacaagacagaagcaugccgcacaccuucagauucaaaggugaauggcguuuuccuuuaaugucaugguuguuaacaucagcaaaaccuuucccugguuuuucucccccacaggagagauuauuucauucaacauuuucuaugaauuguuuaccauguguacaucaaucauaacugaagaugagaaagguaaucugcagagaacaucauacaauguacuuuuuagaauaaguuagaacaugugcuaaguaggcuugcuauuucaauugugugucuguuauauaucauuuaguauauccugguaaauucuuauaagugcauugaaaauuagucuuauuuuaagauuacuauaaugcuuauuaaacuuuaaaugagacguggaaaauguggaagaaguguucuagaccagaagcauucuuuguaaaagagaucauguuaagugucugaguguuugcuuuaauguguugacuguguaccaugcgcaugucuggcacuccaggaggcugcagagggcaucugaucccucccaacugcagcuacagacacuuacaaacugccaagugccugcugggaacuaaaccugugcugucacuaagagcagcacgugcccuuaaccaccgaggcaugccuccagccccucagaaacuuuuguguuuucugcauaucugcauagucccuuuauccccaccuguauaacugaguagaaggaaguguucaccaggggccucugcuacccgcgcugaggcagugucuuggucacuauucaaucugugaaaagaccauggccaagauagcucuuaugaaauaaauauuuaauugggacuuguuucugcuuucagaggcuuaguccauuaucaucaucaugcuuagcagcaggcaggaagccauggugcuggagaaacaaaccccugagagccucacugaucucuaggccgaagggaggggggagaacaggaaccuggccuuggugcgggcuuuuugaaaacucaaagcccauccccaaugacacacuuccgccaacaaggccacaccuaauacuucucaaauagugccacucccugaugacuaagcauccaaauacuugggccuguggaggccauucucauccaagccaccucaggcagugacagagguuuuucuggagucccagaacaaacacucucauaguuucuuagucagcaagcacugugugugagagcuucacuuuccuagauuuuccuggcuggacaccaagacacaugacccuggcuauugacuuacaccuaagacuugagauguccauuuguagguggcaaucaaggaacuggguaagucguauuaugagguuauguccuggcagaauugcuuugcaguuguucaaggaauaaccauugauuuguuuccauaucugagucagauuuuagauacugugauaucuaacgugugcuuguaacaccaguuugaacuuguuaaggcuuuuuccuggcagccaggguucuuaauuauuauacauugcuugguaaaacaguuuugaaugugaauauucacagcugccuauguccauguauuaagaauccauuguauuuuaacuguggauucaugucucucucacuuucuucuuaaaaggucauuuacuacaugggagaaacauggauuuuggaauauuucuuggguaaguaagcaacuugaccuacuuuuacuaccuuagaagaguagaugauagaauuaccuugaugaaaaguaaacgccccucaugcgcagaggagagccgugggugaggaugacgggauuccuuaguguuagaaaggcaggcaccuggggcgucucagucacuuaggaggcguaucgcaagaguugcacgcaguggacaggaauuuggaccaugcuugagggcgcagauccuuauuuucauuuauugcugaagucugccaucucggccuuuaugaaaacaugauggcuuucuaauagagaucgucaucugaaucuaggucucgcuguugaugugaccagaauuagucagcuuuucugagcaucaaguuuuagccccuggaaaaaggaugaagccacccuguuuuuggaugaagaaauguuuauucuggcuuacaguucauagguuucaguccauggucagcuggcucuucuguuucuaaggcuaauaaggccucagagcaucguguugguuggagcagguaucagaggaggcuguuuaccucgucgagagaggagugcaguaaagacaguguagccuccgaggguauacauccgaggguauccauccaggacccugcuuccuucauacgggacccagcuccuaaguuggcauuaucucccaauaaucucucagcuuauuaacccaucaguagauuaaucuaaucacucccuaaagccuuaccucugaacaucaguucacugaggacugggccuguaacauuucaaauccaccauaguacacucaaggcucuguuaagguugauccuaagugaccagcuagaagaagcuccuguaaccagacauagcaucucagaccugcaacucuggcccuuggaagguugaggcaggaggauuacaaguuugaagccaucuuggauuccauacuaagacucagugacaaacaugcaucuauguaaugcuggacucucaccuucgucuuugucuucaaugucagcaacauuuaucuuuuuuagguggaauauaaauaauaacacuuggguugucacagaagaauuaaagcccuuaacagugaauuuggacuuccaaagaaacaauaagacuguuuucaaggcuacaaguuuuguuggauaugugggcauguugacaggauucaaaccaguaagaaauauguaacuuuauaaacaguuuuguguccugguuuuacugucugggagucuaagaaaaugaggacaaaaacagaauaugaagguaggcaugguggcaugcuucuucaguucuaacacuuuggaggcaggugucagugaguuuaaggccagucuggucuacauaguggugcccagaccagccagggcuacacacugagaccugucucagcagauggagaguuugaagcccuacuuuauucccuuguccuuaucacuuuucuaacucugagacuucacaccacagaaaaguagaaaggauccugugucuguugaggauacagagcaugugacuggcucucaaggucucagaguagaagugggugucaggcgugggucucuuguucacuuacguaagucauggucaguucaugacuuugcuuuucauuucuuuaaauguguggccauuaauucccuaacucauaucacaguccccaguagacaguuuaggucauuguauacagcuguccuggugcagagauggggccuuccggagcacacugacauuucugaccgcacugcuuugucuuucucagggacuguucagucuuucacuaaaugaacguuucaguauaaauggugguuaucugggugaguggaaugcauggaaaugcaaugggaaucucagucuuuggaagggagggcaguagucuaaccuccucaggccugugacacugucugcauuuccucucuucuagguauccuagaauggauguucggaaggaaagaugcccaguggguaggguuuaucacucgaucaguucuggaaaacaccacaaggugaagugauuuguugccuuauuaccaaauaucuguuauaacuuauuaaaauauaacaauauuugccaagucccaguuucacauccauuguggaacuguugugcauuucuuaggugagucuuugacauuuacaugaaaucauuccuguuuucuguguggucucuuaccaaaguaaugaauuggauuauuuagaaauauuagagauaucaauacuaggaaagauauccaaaaaauuuauuccaaaaaauuacaccauguacauaggaaaugcuauucaguaaaaucuuuauaagaugguaauacauuguuucuugucauggaaagaguaaaauauaaauuguaguacauaauaaccuagaaguugcagucuauuuauguguugaauaauaccaaauuguccuuagcacauauuaaguccacaugauuggacuaaauaagcauugaucuuaguuuuuaauacuuuccagggaauagaaguugguugucuuccuuauuauccacuccucuccuuaauaguccuuauuuucaaaguuacugcucccuguguuucagaaacuguucuccagucuugugguguguguguccuuuuguuguuuucuugaggcaggauuuaauuuauucagaccuggucuccaacucacucuauagccagugaugaccuugaacuccugauccuuaggccucuauuuuccaagugugaggauuaacagacacaccacuguagccuagaguuuaugugaaucuauagggagaguccagaguuuuguguaugccaggcaaguauucugucaacugagccacugccucggcuccucuacaccacuguaaucaaauuucccuuuccuuuguuguugaauaaaaugcgugggcagaaaagcuagcacgugacucuugagaucuccuucagaucagggguccuccuaaaauucccacgcaaaacgcauugguccuccaagaaucacuguucacuccccgucuuuaaaacaugguccuuggacagcugcuuccucagccuuucccaugaagcuccauuuuaucuaaaaaugcuuuauagccgggcgugguggcgcacgccuuuaaucccagcacuugggaggcagaggcaggcggauuucugaguucgaggccagccuggucuacagagugaguuccagaccaccagggauacacagagaaacccugucuaaaaaaaaaaaaaaaacaaaaaaaaccuuuauuuguccccauguguauagguauguaaaauauguuauacauaucagagacuugcuuuaauauaaugucaaauaguuacuguaaauuuacuuuaaaacaauucuuugguauacauaguauuuuaccauuaaagacaaaagcagauaugcauacuaaugacauggauauaccuucuauuucauaagaacaauuaagaccugacugagcaucuuucagaguugauugucaguguucagaaugacauuuuggaaguucuaucauaaucccuagucaaauuucauuucacauuauuuuuuauuaaacucaucaacaacucaaaauaguuuuaaaccuagaggcuggagugauggcucagugguuaagagaacugguucguguagaggucccagcuuugguucccaccacccauauggcaguucacagucaccugcaacuccaguuccuugggccuuaggccuucuuccauggcugcuacacacacacaugugcacauacacacaugcaggcacacacacauacacaugauaauacuuuuaaaaucucgaaugaaauucaacucaaggauaaacuaguuuuauacuuccaauugaagaaucauaguagaaaauuauugaaaggguugguuuucauaauuaagccauugcuuacauaugagcagaaagccugggagguauaguaauucucaacagcacguuuuauuccagcugcuguccugagugugggccgagguccagagcagaucaagugcacauucagaaccagggcuguaggggaguugcaacucaugagagcaccccagaaaugcuucagauuucguucauauucaugugauuuacaacuaauuuuuggucacugcacauucagaaaacuuuuaacuguugcucuguguguguguguguccccgucuguccacauucagcuaaauaacucgauuaaaggacugcugauaccuguuucccuuuaguuucuacaccuaaaacacagcacucaaucaaauaaaacugcuuacuuugaaaauguuucuauauaguuaugaagaagccaagaacacacugaccaagaccaagauaauggcgccaguauauuuuauccugggaggcaagaagucuggagaggguugugugaucacacgggaaagaaaagagucuuuggaugucuaugaguaaguauccuugauaaaggaaauaagaaaaaacaagaacccaggccaaugugaagccuaagagggaaucucucucuuuauaucuagacuugauccuaagcauggcagaugguaugugguacaaaccaauuaugacagguggaaaaacaccuuguuuauugaugaccgcagaacaccggccaagaagugucuaaaucacaccacacagaagguaugcggcaucgucauacauagaaaaaggcuacccauuaaggacugucuuauucugcugcuuucauuugaccuugagaaaucugcaaaccuauuucucucucuugacacacgguauggagcuuuugcugucaaacuuaaggaaugaauuuuugcugugauuuuuuuccuccuuaaguuaaugucaggcacuauucuuuaaaguuaaauaaauuucaaagcaaguggggagagaaaaaaaaaugauacauuagaauagucaccuuuguuuccagcagugacuccaagggagguggcuuuggaagauugaaaaauguuuccuuuuuuuuuuuuuuuuuuuuuuuuuucgagacaggguuucucuguauggcccuggcuguccugaaacccacuuuuguagaccaggcuggccucgagcucagaaauccgccugccucugccuccugagugcuugggauuaaaagcgugugccaccacgcccagcuaaauguuuucauuuuuaaugacccauuuguauguguaaaugcuacaggagaccuguauuuaacccacugaacacaacuguuuuuguauuuuagaaucucuccuuugcuaccaucuaugauguccuaucaacaaaaccuguccucaacaagguauguccucaacacacaaacacauguacagcuuucaggaaaguauuugcaccuauguugucucucuuaccuuagaucuuuuugagcauaguaauuaugucuaauuucggguuuguuauuauuucauucaucgacucauauuuugagacagagucucugugccccaaagucaagccuugaccucacuuuguagcccaggcugccuucagacauguaguccuucugccugagccuccugagugcugagacugcaaacaggcaccauccuucucagcuuuaaggucuggcuuuuuaaaaaaaaacgauuucaagugccugaaaccagcacuguaggaauguaguuaggaugcuguguauguuagggugcauacacacacacucucacuuucucucucucucucucucugggcaaugcugucucugucgucuuagcuuugcuugcauggcauuggacuaagucuaguuugacuucuccaugugucagaaauuacacacuguauuguuaacuaacaccuaacagcuugacuagacagacaaacugagguuucagguagagccagcccuaugucuuuucaggguggggcggcuccauaacuuuauucuguccuuuuaucuuucccugaaccauaaccaagaaaccuaaucagcccacuugcuuauagucauucuuuguacagaggucauuucaggauacauugcccuugacuaacccauuuucuuuguucuugccuaaacaggcugcauugccucugccuucuagaacaaaguccucuucccuuuagcauucgcaacuaaacagggacugucuccuugauuuaccuuggucaaccuaccauuucugcuuuggacaguauucccauguggcaucauaaugggguucauuguauggucugcaugagcaggggggugauggugugugcuuuggacugugugccuacaggguuuuuuuguuuuguuuuguuuuacuguaauggaaauggguuuaggauaagcauacucaaagcuccacaguguauccuugagcuuuccaugacugccaguuacacacuggagaggguuaaaugaaucuuaaaguguucaugauuacuauuaaauaucauuauaaaacaaauucuuucgggggggcacaaaugcuaauauguacaagaaaaucuuagacuugaaaauaucuuuaaaaugaaaauaacuuuuuuuuucagcugacuguauucacaaccuugauggauguuaccaaaggucaauuugaaagucaccuucgagauugcccagacccuuguauaggcuggugagcacacguuggccagccuugaggacguacugagacccgaagauguguugugcagagagcgugccuggucuccuuccauaggcuaaggcucaaggccucuugucuuuagucaggacuguccucaucauguuacauuguuuacaggcuguuuuguuguuuguuuguucugaugaucaucaucacuucgacucacagguaaauucuuuaagggacaccacauagaaauugccaguucauuucacuuugccacugcggaaaggguaacugugaccuccauggaacccaucaaaguucucugaugguguuugagucagcgcccugugugauuaauguaaaaguuacauuuucuuuuuuaaucuacauacuuauguuuuucuguacaccaguaguuuuccuuuuccugguucucucuuagaaccaaccugccauucaccuuugcugguggugacagcagugcaaugucgcuaugcuuggcuggaguaccucagauagacauuugauacuuauuuuaaugggcaaucaauagaccucugacucuagaaacaguguuuuggaggauuauaaaauaacuauuauacaaacacuauuuuuuuaaaaaagaauaaguguucucuuuuuccuaguuauucugccugccaguaaccccaggaagagucuagcuucaaaaacccacaaacucauuauuuuuaauucuuuuauguauaaucaauguaauguuuuuuccuucuaaucauauuuuuuuagauuuucauacaauauaguauuaauauuuuucagaaaucaauguauuuaugaaaacugcaaacagaacuuguucaucuuucuaaccuucacaguugacagugaagcauucuguacaguguggcagacuguauccauuuaguuuuggacagucugcggugucgugaugcgcaauaaacagucacugucagauaugucagcagucaugcaugcugacugggugugugccuguguugguuugagggugggggguuauuaucaagagauacaagcugaacauaauaccuagauuaaacaacaaggguuaugcaagcagguuacuaaacauaugacuuaaauggucacaaucugccaugacuaauacuuaccuccuaacccaguagugucgacccaguuugcagguaugcaaaagcagcucccccucacccacagacugugcccaggugcuucugcagggccuguaucaccaagaugguuuagggaaggaauaggaauucaugaggcuuuguacugaccuaggauaccaaggugggcaagguggugcauaagcacaaucugaauuugacaggugucagcagaagaaucagaaguucggggccagccugggauacaugggauagucuucaaaaucaaaauaauaaaaauagaauaagagucaauuaauuuuuuuaaauaacuugcaauuuugagccucuccuaggaaugaaaugagguagaacugauccauuuggugaucugcaggaggcccugacagcaccugauuucuacagacugcuuacuuagcaguacuucagcgacgugaacuaacuggcauuaagacuguaaguagccuguuuagaggugaagcaguuuuuagacaguguauguaguccaaauuuauuuauacaggugcuucuauaucgcugccuacauacaacuacauagacuaaaaagugaugaccagggagauguuagcuaaaauguugagagucauuucccccaguuaauggucagggauauuaagacucagaucggauccaaaacaaaaaaauaaauuaccugcuuaauauuuugguuuuguuuugaaaccuuagcuggccucaaacuugugauccuccugccucagucuccagagugccgauacucaaacuggguuuaggaauaugauuugaaauggagucccaca

SEQ ID NO: 4414 - RNA, 1138 nt, Mus musculus
gucucgagucggaucccagcagcagcugcggcggcucaggucuucaguugcucuuucugucucccuuucguuucuggaaacauggccucugguguggcugucucugauggugucaucaagguguucaaugacaugaagguucgcaagucuucaacaccagaagaagugaagaaacgcaagaaggcagugcucuuuugccugagugaggacaagaagaacaucauccuggaggagggcaaggagauccugguaggagauguggggcauacuguggacgaccccuacaccacuuuugucaagaugcugccagacaaggacugcugcuaugcacucuaugaugcaaccuaugagaccaaggagagcaagaaggaggaccugguguucaucuucugggcccccgagaaugcaccccuuaagagcaaaaugaucuaugccagcuccaaggaugccaucaagaagaagcugacaggaaucaagcaugaauuacaagcuaacugcuacgaggaggucaaggaccacugcacccuggcagagaaacuagguggcagcgcggucauuucccuggagggcaagccuuugugagccaccuccagcccccugccuggagcaucuuaacagccccagaccugcucuuggguguugcaggcugccccuuuccugccagaccugaggggcuggggggaucccagcagggggagggcuaucccuucaccccaguugccaaacaucccucccacccccuggaccguccuucccccuccaucccugacuguucuggccuucccaaacugcuuuugaucuucugauuccucuuggguugaagcagaccaagucccauccuaggcacccaguuuggggggagccuguauuuuuuuuaaugacaccccuacuccguaucccuccccaucccaugcugccaacuucuaaccacaauagugacucugugcuuaucuguuuaguucuguguguaaaugaaauguggaaaugacccucccugccccagcuggcuguccuccccuuucccuugaucuugaccacucauggaagcaggaccaguaagggaccuucaauuuaaaacaaaacaaaacaaaaaaacaauaaaaaggcuaauuaacaccaugaaaaaaaaaacuucaag

SEQ ID NO: 4415 - RNA, 1138 nt, Mus musculus
cuugaaguuuuuuuuuucaugguguuaauuagccuuuuuauuguuuuuuuguuuuguuuuguuuuaaauugaaggucccuuacugguccugcuuccaugaguggucaagaucaagggaaaggggaggacagccagcuggggcagggagggucauuuccacauuucauuuacacacagaacuaaacagauaagcacagagucacuauugugguuagaaguuggcagcaugggauggggagggauacggaguaggggugucauuaaaaaaaauacaggcuccccccaaacugggugccuaggaugggacuuggucugcuucaacccaagaggaaucagaagaucaaaagcaguuugggaaggccagaacagucagggauggagggggaaggacgguccagggggugggagggauguuuggcaacuggggugaagggauagcccucccccugcugggauccccccagccccucaggucuggcaggaaaggggcagccugcaacacccaagagcaggucuggggcuguuaagaugcuccaggcagggggcuggagguggcucacaaaggcuugcccuccagggaaaugaccgcgcugccaccuaguuucucugccagggugcagugguccuugaccuccucguagcaguuagcuuguaauucaugcuugauuccugucagcuucuucuugauggcauccuuggagcuggcauagaucauuuugcucuuaaggggugcauucucgggggcccagaagaugaacaccagguccuccuucuugcucuccuuggucucauagguugcaucauagagugcauagcagcaguccuugucuggcagcaucuugacaaaagugguguaggggucguccacaguaugccccacaucuccuaccaggaucuccuugcccuccuccaggaugauguucuucuuguccucacucaggcaaaagagcacugccuucuugcguuucuucacuucuucugguguugaagacuugcgaaccuucaugucauugaacaccuugaugacaccaucagagacagccacaccagaggccauguuuccagaaacgaaagggagacagaaagagcaacugaagaccugagccgccgcagcugcugcugggauccgacucgagac

SEQ ID NO: 4416 - RNA, 50521 nt, Mus musculus
ugaaaaaaaaugccauguauuuauaaaacuggccuaugacagauugacaggcaagaauggacagugacaacgcuguuuguuaaguggccagcacacacagcauagcucagauaaucaacuggguuaaaggcaggguaucaucuuucuauucuuggugcugaauagauuuuuaguaggcucuucauugcacaacuggguuuguggaaagucuuuggggagagggaagauuuuuuuuuuuuuuuguucgggguaaucugauaugugaugucuuugaauacaguaaccacguuaaugacuaggcugcuccuuggccuugucuuugcucaaggcucagggcaugucccucagauguggcagaugauaagagggucuguauucguccccucauucggaagacaaggggaaaagauaggucugagagcuucauggaaaggggucggagggaagcuguagaugagggacucaucugucgcauuguagaaggcuauguguccagagucauaguccaagaacacaccaacuuuaugcacggguucucggacauguugcccuuucaggggagaugaaacccagagacuguaaucgucgccaauuuuuaagccuaugagugagaagagguccccgggcgguuuggggagauuccccuuucuguucacagaguccuugcagauccccacuucccacuccgucuucuuucccacuuccacuucccaguagugucucccgcaggugaagaucugagcucccaacacaguugcagacugaucaaaucgcucuggguugucagguaauugcugccuggucccuccauaccgcacacuuuucagaucuucggacaaaagcagguaagcauuggcuguggcuggaucuagaguuauaucugcugcaagaagagaagagaaccaaucuuuugacauccuuggcaaccucccaaauauauuaauuuuaaccuaaauucuuaauagauaguccuauuauuauuuguuuuuugaagacaggagucuaaccaaguagcccaggcugggccuuaaacuuggcaguugucuaaccuuagcuucuuacgugcugagauuuagacaugacuaccaagcccagcuaggccuacuuuuuccuuuuuuuuauuagauauuaucuuuauuuauauuucaaauguuaucuccuucuuggguuccaccuccgaaaaccccauaucccauccccuccccacccccggccacugcucagcaaaccacccacuccugcuucccuguccuggcauuccccuacacuggggcaucgagccuucucagguccaagggccucuucuccuauugauauccaacaaggccauccucugcuacauauuuggccggagccgugggucacuccauauguacucuuugguuggugguuucguccuugggagcucuggagguacuggaugguucauauuguuguuucuccuauggggcugcagaccccuucagcuccuucaguccuuucucuagcuccuucauugaggaccuuguguucaguccaaugguuggcugugagcauccauuucuguauuuaucaggugcuggcagagccucucaggagacagcuauaucaggcuccugucagcaagaacuuguugacauccacaauaguaucuggguuugcugauuguaugugugauggauccccagauggggcagucucuggguggucuuuccuucagucucugcuccacacuuugucucuguaucuccucccauggauauuuuguugcccccaaaggauaaacaggcugagaaagaaauuagggaaacauccuucacaauagucacaaacaauauaaaguaucuucccauuacucuaaccaaacaagugaaagaucuguaugacaagaacuucaagucucaagauggaaaaaucucccaugcucauggauuggcaggauuaauauagucaaaaugaccaucuugccaaaagaaaucuacagauucaauacaauccccaucaaaauuccaacucaauucuucauagaguuagaaagagcaauuugcaaauucaucuggaaaaacaaaaaccuaggauagcaaaggcuauucucaauaaaagaacuucuagcugaaucaccaucccugacuucaagcuguacuacagagcaauggugauuaaaaacagcaugguauugguagagugacaggcagguaaaucaauggauuagaauuccaagaaaggaacccacacaccuauggucccuugaucuuugacaugggagcuaaaaccauccagugggaaaacgacagcauuuucaacaaauggugcugguucaacuggcaguuagcauguagaagaaugcaaauugaucuguucuuagcuccuuguacaaagcucaaauccaaguggauacaggaccuccacauaaaaccagauacacuaaaacuaauagaagagaaagugaggaagagacucaaacacaugggcacaggggaaaauuccugaacagaacaccaauagcuuaugcucuaaaaucaagaaucaacaaauguuacaauccuaaaucugauaggggacuaauacccaauauauaaaaagagcucaagaaacuggaauccagaaauucaaauaaccccauuaaaaaugggguacagaucuaaacaaagaauucucaacugaggaauaccgaauggcugagaagcaccugaaaaaauguucaacauccuuaaucauuagagaaaugcaaaucaaaacaaccuugagauuccaccucacaccaaucagaauggcuaagaucaaaaauucaggugacagccgaugcuggugaggauguagagaaagaggaacacuccuccauugcuggugggauugcaagcuuauacaaccacucuggaagucagucuggcgguuccucagaaaauuggacauaguacuacugcuagauccagcaauaccauuccugagcauauacccagaauauguuccaacugguaauaaggacacaugcuccacuauguucauagcagccuuauuuauaauagccagaagcuggaaagaacccagaugucccucaacagaggaauggauacagaaaaugugguacauuuacacaauggaguacuacucaguuauuaaaaacaaugaauuuaugaaguucuuggguaaauggauguaucuggaggauaucauccugagugagguaacccaaucacaaaagaagucacuagauauacacucacugauaaguggauauuagcccagaaacuugaaauacccaagauacaauuugcaaaacacaagaaaaucaaaaagaaggaagaccaacguguggauacuucauucauccuuagaauagggaacaaaauacccaugaaaggaguuacagagacaaaguuuggagcuaagacaaaagggauggacuauccagagacuaccccacccgaggauucaucccauaaucagccaccaaacccagacacuauugcauaugugagcaagauuuugcugaaggaacccuguuauaccugucucuugugaggcuaugccagugccugguaaacacagaaguggaugcacacagucaucuauaggauggaacacagggcccccaauggaggagcuagagaaaguacccaaggagcugaaggggucugcaacccuauagguggaacaacaauaugaccuaaccaguacccccagagcucaugucucuagcugcauaugcagcagaagauggccuaguuggccaucauugggaagagaggccuguaggucuugaaaacuuuauauaccccauuacaggggaaugccagggcaaagaagugggaguggguggguaggggagcagggcaugggaaggguauagggaacuuucgggauagcauuugaaauguaaauaaagaaaauaucuaauaaaauaaaaauuuuaaaaaaagaaaaaaaaagagaaucaacaaaugggaccucauaaaauugcaaagcuucuguaaggcaaaggacacugucaauaggacaaaacagaaaccaguagauucggaaaagaucuuuaccaacccuacauccaauagagggcuauuauccaauauacacaaagaacugaagaacuuagacuccaaagaaccaaauaacccuguugaaaaaugggguacacagcuaaagaaaaaauucucaacugaggaauaucgaaugccugagaagcaccuaaagaaauguucaacauucucugcuaggccuauuuuuuaacuuaggcguuaggcaggcaaacaaccccagcccuaaaguaauagcauaugaguucaaagccagccugggcuucauaaugaauggaagaacagccuggacuacacagcaauaucugguuucagaaccaaguuuguggccaaacucuauauaguuaaauuugagaccagcuugguuuauacuguaaaauucuauucuacagcaucuauuucuauucuuuuuuuuucuauaaacaaaaguuuucaauuuaauuucagugcauuugguaagaugaccuccuuuagaaaaaaaaaaaaguccaccucuaacuggacuugacaccuuaugucauuaacuccaauacuuaggaaucuuaggcaaguggauuaacaugaguuuaaggcuagcuugggcuaugucaugagacccaauuucaaaauaaacaaacagaacacagaacagaaucucccagcuuguuuuucacugcccauggaacaggcaguaaagguacaagaagaggcagaauagagucaugugaagagagaucaggcacaucugugaggaugagaggaaacugaguauaauaaacguuguguucuagacaguuuuagaauuccaguuuaucucucuacacaaggauacccuugcuguuagacauggcaggauuucugcacuuuggauagaaggcaaauggguaauuuguuacccuccuucuaagugcaaauuauuuccuaugcauuaauguauuuaaucauuguugcaauuauaauauucucauauuacaugcaacaauacauagggaauaaauaaaugacaagugcuagagagaaggcuccauaguuagaaguauaugaugcuucucccaaggagcagaguuagagucccagcacucaugucugauggugcacaacguucuagaaugccaucuccagggggccugacaccucuggccuccuugagcacccaaauucauguacacucacacacauauacucauagcuaauaguaaaucuuuaagaaaaauaaaaacuugaaaaacgggucagagguaucaaacucuugauggcaggccugccuaacaugcccagagcccugcguucuauccacaacacuuacaaacaaacaaacaaacaaacaaacaacccugguguggucacacaaacuuacaagcauagcacuuugaaaguggaggcaagagggucaagaucaaccuuaccuacguagggaguucuagaccagccuggcuacaugagaccuuguugaacaaauacaaaacaauuaacuaaacaaaacugaguccaaaagaaacuuuaaaaucguacuaauuaauuuuacuaagauuacaaaauaauggagaauuauaauaguaaauuuuuaauucgugguuuuccacuaugccauggucaaaugcagccuugugagaguuagcaucccggugacaaugucauacagcucaugugagcuacuaggccuucaucccuaccucaaacuuucacuggcugugagauaauuugcccccacugagguagauaagcauacaauaauguacuagacauucuagauccuuuaucugcauguagagugugcacacacccaucuccaaacaaugcaccuggcaaccucaggacccccuccuccccaacuuacaucaggcuauauauaccaucaucuuugaauaaugguaucaggcuauacauacccccaucuuugaacaaagauguuucccaucucagagguacaauccaauucaguuuccacucaaauauccccaaaguaucugggcaugacaaauagagaggccugccucaaacaaaguagaaucaaagacuuaacacccaagguuguccucugaccucuauacccauugacugguacaaauuccuacacucacacacauauacacacccguacaacaaucacucccacugccugcccacacacagggauuaaaacaaaagaauguaaccuagcuuuuguccuaacaggaaggauccccugcaagaggguuauugcaugugcuggguaugguguauacauaucaccgaacccuuugacaacaggcagagccugacagaacauccaacaagguuucuugugucuuggcucaagcauaggcaguguuuacaacuuggugccuuagcacugacucuagauacuauaacugggcgccuccugucagaagaaucuuuuaugcuagaagaagcugcccaagaacucagggguacccauaacaugugcugagcuuaacuauggaaaucccuggagauaugacaagaagacggacuuacugcugaauuuucgcagcaucucccucaucccagugaugugacacaggcucaguuccgugaugguggucucuggagacugaaacaacagggacucauaccuuccaagagaaaacagagccucauucucucugugacacauaccacauaaccugguccaaccuaucgguccauagcaucucuucgcaacaacauccacauacuauuccccacaccuucaguauuucaucagcaccagaucuccauagacuaauagacaccuaccgauccauggcuccuuugacuuccuagggauauaaagaaaagaagguuacucugcauucaucuccaucacuagcgaaucguaaaucgguccucaucccaaucucgcacuaguuaccuaaacucuacuuccaugauucuagcacaucuugagaggagguagcagauaggauaggagaguaaagccucagcuuuuucuaaggaugguuuuuaaugaacaugagauguuucucacucugaccagagaauaguuuguucucuuucuucacaucuaagcuuuaauuaaaacaaaagcaaaaacaaaucuuauuuguagggaguagggaaugcacuuggucacaacacaaauauggaggugagagggaaaauuaaagagaggcuguucucucagaccacgugaauccuagccaaggauggaagucacguggucagccuugacagcaaucaccucuacccacuaagugauagcuugcuagcacuuaaaaaguccuuucuuuaaaauguguuuuagcauauauucauuauguauaauaaugaauuucauccugauaauuucauacguguauguauuuugaugcauucagauauguaaauaauacauuuuuguguauccauauaugcacauaauuuuuaucuugucuucuuuccacucuuauuuaucccuuuccuauucccaacacauccacaauucuaaucacaugaccuuauuuguuucgugacccaaagaguuuaauuaggguuauuuauggggguggggaagggguuauguacagagaaugggcagcuuaccagugacuacaucaauaaaaaauaauaucacacacacacacacacacacacacacacagagcaaccacuaacugccuagacaugcucagagaugacuggggacuccuaagcccuccuuccuuuaaaauuugaauaucuaauaguugaggcaaaauauuaaccucaugugccaaggaaccagagaugagcaaagaaaaaugcuucagcgagagcugagaccaagcccaugucauguuuuaugauguucuuuagucauuuagaagacacaaaauuagauagcacuccuuauagagucuaaucaugaaugggaccugaagcagaaguuggcucuguggcuuauaacugagacgauguuaaugagugcaguagccuagggagguaguaggcaaagauugaacaguggcccuggcacacagaaugcauggauccugccaccuuuuagcugcagggcaaucaggucuccuuaacggccaucaaucugauuauuaaauauuugcuaucccuuuuguaagugaugaucaccuguaggcuacauaacacuaagacuuaacccucaucagaucuuugaaaagauuaaauucaccaugcccaccggcuuacaaauaaauugugaguuucuagacaaggcuaugugugcagaagcagauccagaagaaacuagucgucccugggcuuguuugugaaauguuuuuuguuuccuuuucacuuuguuugauuucuccuccuuuucaagaauuuuugauacccagauagauaccuuaaggaaaugacauuuaggcagaauuuaauuuuucagaugauuauagaaaaauguaguuccuauagcuugaaauacuaaaagccacugugugcucacagucagcuaauggauggaucacagggcccccaauggaggagcuagaaaaaguauccaaggagcuaaugggaucugcaacccuguaggugcaacuacauuaugaacuaaccaguaccccggagcucuugacucuagcugcauguguaucaaaagauggccuagucggccaucacuggaaagagaggcccauuggacaggcaaacuuuauaugccccaguacaggggaacgccagggccaaaaagugggagugggaagguaggggaguggggugaggguauggaggacuuuugggauagcauuggaaauguaauugaggaaaauacguaauaaaaaaaauuuuauaaaaaaaaaaauuuucccccaguguccucgugaauuuugucucaccucaaaagauucuaacgucaaguucugacagguagacucaauccgcccaaucauuuugccgaggcggcggauuugcugggucagcuggaucucauuuucccucagcuucuucauguucgccuucuccucccucuccaggagcuggagcuggagcuguuccucuuccuugaggaacuggugcaucuucauguauucagacacaacgaccugcuuacaagucuuugucuccuccugcuaucacaugugcagaaacauucacaagcacgcacacacacacauacacacacacaaacacacauguuagcaacaaaaacaguccuauaaugcauaaauuaucuugauaugaugggugaagaguaaaaaguuuugaaaggugcauauguacccaacagucaacaaaaucagauuuucuaaucuaagaacugucauuccuacugaacgaaacgaaagaagucaaaaagcgugacacauaguaaucagcacuaauuagaaauaagcugaaaucuaagaggaaaacaaugaaaacaaaauuaaaguuaauaguaggaaaguagaaaaaugaaauaaaauuuaaaaggaaaaaauuaugaaacaugaaugugugcguuauuagacaaauguugguuuuaaaaacaaacuuggcaucaaauuacauacuagaaauacaucacaaaauguugcacuaaauucgagauauaagccagccugguggcacaugcauguaaaacuagaacucagaaggcaaaagcagagguaggaggauuagauguaaauuugaggucagauuguucaucuccaugaucaguucccagauagccaggaccauagagcaagacucugucucacaaaacaaauaaaacaagaauucaaagugugcaaugaaucaucauuugaucucccaccacauuugaaaucccaggacuugggugguuaaggcagaaaaaaaaaaaaaaggcuaaccugggcuacauagggaagggcuguuuaaagcaaaauuccucauuuucuucauuuauuggaagacucaaauauucacauugagugcacuagcauguauggaugugugugugugugugugugugugugugugugugugugugugugacuguguguguguaccuguguguguguuugcauaauacaucugugcagaccauaggacagccucccacguaaucaaucuucaucuuugacuugguuugaaacaaggugucgcugcuguguacgucaggugagccugccauugagcuucgggggauuguuggaugucugccugccaucuccugguagggaucacgagggggcuauaaauacuuguccuuuuggcuuuuauguggguucugaauacccacacucaggucaugaggcuugcacggcaaaugcuuuuacccacugagcaaauuccccagcccuaauaccuauacugccugugccaugggaaacguuucguucuuugcuuuaacugcuaggcaauucaaguccaaaucugugaugaagcucgggcauuuguugcaguauaauccaaucuacuaugugccauuguccuguguucuuuacuuccuugucauuggcauacaauuucuacccugagcaucugagagacucauuuuuaaaacuaguuuccauccuaucucgaaaauacauugcuuguguuuuaaauaacauuaauuagauccaucauaaaagacuagccaagaaagauaaacaaguuaaaacuggggugaguuaacccgagcugaacugugauacuccccggugagcacacaguggcagucagccaaacagcaggguacugccuaugacuaugacucaaaaaugguccuuuccagaagagauggcucagugguuaagagcacugacugcucuuccagagguccugaguucaauucccagcaaccacauggcagcucacaaccaucuguaaugggaucugaugcccucuucuggugggucuaaaggcaguaacaaugcacucauauauauauauauauauguaauuaaaaaaaaaaaguccuuucccccugacaugucaccagguaucucacacacaagaugaaacacuagacagacacugaccuuacacaacaucacucguuccuucucaugguucaggauggccugaacuuccuucuucuuuuuccguaaaauauuuaugauaucuuggaguuuuuccugcaauagaaacaaaccccuuggcaaauaagcaggguauccagugguagaaagaucaggaaaacuagccauuggaaaaugacugaggcucucaaagagagagugaaagcaagaaccaugcuacaugaagauacgugcccauggcuguuaccgacagagaccuggaugagaguuaguggcuaggagcaguucuggguucugagauugccacugugcaucccaacuuacuuugugcugcuccucagccucacuugagaaacacgccuuguucgucccuugacuuggaggugagacauuaaugacacucugcucaucgucagagaacacccaacuaggcccuggcauucucccacagaugcucugcucauccucgcucugcagcaccugcgaucucagcugucugccaauauuagccagucuccccagccgcucguuggcuugaaaauguggggcucccaaaguccuccagcauucaggacaagauaaagguguguugugcuccucccaacucuugaggaggcacaucagacaaaagcugugcccacacucgguggucacuggacugcugaaauaauccaagcagaugaaacaggucagcucuucccugagguucuccaucaaaucuguuguggacauuuucucaugguuggacaucaggacaaggcuacacuucuggucugggauuacagaaguccucuucagucacagcugggugaugaucaggugcuguguuguuauuacaagaagcucuuguucuccucuguaccugauuacaccaaaugauacauacgcuccagcucuccagcacaaagccaauugugacuuaauguggaacuccugggcacugacucaucaccagccccaaccuuuuauugaauguuuuucuaugcaugccacaugcuaaaugcuaguaucugauauaauuggauugguggguuuuuuuuuaauuagcuaguuccuguauguaaauggcaccaugaaaccguuuaaacacaugggcuugggguucagaaaaugaauuacuuaguggaaaccacacaaaaauuguagaggucucugauucgugaauagaaaguauggucuacauccuucaguagaccgcacuugacaaaacuaguugagaaagaagaaaacuacaacguacauccuuuucccauuaaacccuuuucuuuguuucaccaaagcuuaagcuuuccacacaguaaucaaguacucugugcauuuguuugauuguauucauccuaauggagaacuauaccacugaacuauuccuugaccuuuccuaauggagaacuauaccauugaacuauuccuugaccuuagacgcacaaugaauugacacuuauauuuaucccuccacccugaaagaccacgaagcucacccagcugacaucaugaaaaguagcuaagugacacuugaagauuaccugaagacaucauugcaccauggauuggauagaaagaauccuaucuugguagaaauauaauguugcugcuuguuuucaccuucuagaaauguucaaacuagccauaaaccuccugacccucuuuuaauucuuacuuggcagaaacugagugggcagacauuuuucuguugauguuggaaaauguaaauguauaguacagugauuuauguauggugaucucuacaauuagugccaagugccauaaaaccagaaugucaugugaccgugaaucguucuugucaugcccuccuauaugauauuugcuagggaguauaucuuaagcgccauucagugcaccguaccauguguauauucccuggugcuauccugcuuggcaaccuucugcagaucuauauuaccaaagcuacccuauuaaccuuuugucccugacuuuuaagaauugaucugcuuccccaucccccacccauuucuuauuagcuauuagguguugucuuaucuucaacuuugacaaaccaaaacucaccuuucugaagucacugauccaucacuucuuggccugguggcagagauacagggugaagguguuuauucaaauauguuaaauaagugugauuugcacaccauuuucaaaauugggauucaaauuuaaacacaccaagagagguggcaucagugagacaccacaaaagcacccggcuuaggugauuuccagacugcuauuuggacacagcuucacaauagcuguuagaaacuagucauaagcaaaagucucccccaaaaauaaauauacaauaacucuaaauuaaaugucaucauaggaaaaaagguuuaugaaaugucaccacuauucaaugcaauucauaucccaaccuagaaggagucagaacaggucucacaguugaguuggagcgcaucauagagcccacauucugaaauggaauuagggaaugggcaucuucuacuuucaauucccacuauuguuccauugcucuucccucuuccaaauaaauaauugucuuuuuuuauaagcuucauaaaagaauaauugugccuuguucauuucuaaccaggagaauuuuucccaccuaucaagugauaaggaaguuuucaaaugagggauagugagccgugcccauaauucuagcgcucaggaggcugaaccaugaggauugcuuguuacaagucagccugggcuauggagcaaaguacaagcuagaccagccuacagcauagucagaccaucucaaaacauuaaaaauaaauguuuuaaaugaacaaacagaagagucacauuacugcacagugacagucuucacuuggcuggaaauagaucuuacaccuaauuaccuucuauaaaugauuaagaaaauugagguuccaauaaguugagcugaaccuccauucugaggucaaauugggaugggaaaacugggucuccucuucacagucuuuggucagcacacuacaucacauauugccuuuaacaugaaaaauucugauuaucucaaauaaaugaauucucucugauggugucagaaguaaguagacagcuaucauuaaggcaugaguuuuacacccaccggcacaacucuuucuuucuuggaaaugcagucuuuauaauuucuuuaaauaugcugcguagggucagucuggggugagcuaaaucccagagugacccagcccuccuaaaauauucaccacaaucccacaaggcacuaugcugccuaucaugacuccuaaagccaacaccucaaguaucuuacucuguagucuuaccucugugaugagucugugaugagguaaugcuaagagauaucccauggugacaacuguccaacugucgcccagauguggcuaaaguuggagcuguaugggaagacugggagggggcagugaguggacuggaaagugaauaaguuaaaaaaaaacuuuuaaaagaacuucaaaaauucaaagauaguaauauaaaggucuugcauauuaagggucauugggauagguugagcuuauuuggaaaauaucuuguaugaaagccuaguuuuaaaaauauaacugucauuucacaucagaguggaaaagauagauuauucaacuaaugguuuaggauaagugaguguagccaucuggaaaaauaaaguugaaucucuacaaacaacuuacccaauguguguuccacaugagacaggaugcuuguguguguuccucccaguuacagauuucagauuaauuugcauuguuuugucaccauuuugacuuauuuauuuuguuuuguuuuguuuuauauguguuuuguuuuagaucaggacuucaaaaccgucuacuguuuugcuauauuguuucucccaagaaaucagucugacccugggaagcuagguagauaaaagagguacgcaaaucaaacauuuacugaugauaaaucagaacaagauguuuuuuuaagcaauucuucgcaauaaugcaauuuuaccauuuauggaagaugaaaccaaaauuucauguuaacaaaauggaugugcucauuugucuuuacacacgggauaaaucuuagcuggauaguugguauugcgggauuagaucauucaaugcuuuucagaauuuauuuauuuacccauuuauuuauuuauuuauucuguuuuuuuauuuaguuuucuuugguuugguuugggagguuuuugcuucuuuguuuguuuguuuguuguuagaauccaucugacccaggaugucuucacacuugcuacauagcuuaagcuggccuugaacuccugguccuccuacuucaccucucaaguucugguauuauaaauguguacuaccaugcucagucugaucaauauguugauuuuacaaucaucaauuaugaaauaauaugagaugggagacauuuguuuagguagggccauuucagaaaucauugaaaauucuguccuaaucucaaacccaaauagacuuaacaagaacuaagaaaugggugccccuaaggagcuguaacacaagcauguaggacaugugacuacgaccuggaaacucaaggaagcuuaaggaagaaugcuccauguuugaggaagaacaacccagaagcuugauugcccacgacuguggcacacucacaucagcccagcaugcaggaaauuggacacagggugauuucugcaacaccagcuagcccgggccaaccacaaaaccuugucuuacucaaaagagaaggaggagcuggagaagaugaaaaagaacaagaagggaaaacaaggaagggaagaauuucuugagacguaaagcauguuuuaugauuacaaucuaggcuaagacagagaugucaaguccaugcugacaccaacuucgaaacacacuaucagucucucuuaaacauuaacucuuuuuauuuauuuauuuauuuuuauuacauauuuuccucaauuacauuuccaaugcuaucccaaaagucccccauacccucccccccacuucucuacccacucauucccauuuuuuuggcccuggcguuccccuguacuggggcauauaguuugcguguccaaugggccucucuuuccagugauggccgacuaggccaucuuuugauacaugugcagcuagagucaagagcuccaggguacugguuaguucauaauguuguuccaccuauaggguugcagaucccuuuagcuccuuggcuacuuucucuagcuccuccauugggagcccugugauccaucccuuagcugacugugagcauccacuucuguguuugcuaggccccggcauagucucacaagagacagcuauaucuggguccuuucagcaaaaucuugcuaguguaugcaauggugucagcguuuggaagcugauuaugggguggaucccuggauauggcagucucuacaugguccauccuuucgucucagcuccaaacuuugucucuguaacuccuuccauggguuaaacauuaacucuuauagugugguaaucccuauauuaaccccauguaugagacaccugagaagggaaaggaagagauagcaugcauugaauuagcauggaggacucagauggugguguucaauauuaccuggaaguugcuagaacucuaagcuagaaacacuuagaccaagacccaaccuaacugaaucaaaaacuccaguccuuaccuuuaaucccaguucuuuggaggcagaggcagguggaucacuaagaguuggaggccagccucgucucucgucuaaaaauaaaagaguuccaggacagccagaacucuauuacacagagaaaccuugucucaaaaagcaacacacacagacacacacacccucuggagcuggaccgagcacuccaguuuuaaacaagacccaggaccuuugaugauucugguguacuauaaaguuuggaaggcacagauuuugggaucaaaauugacuuaacucucuggguaauucuaacacuguaagaaaucuuaggaucaagucugcaacucaaaaauaauuuaugcauaacggcuggacuguuagauaucgggaggcuaaucucuaggacacuguuuuauacucccuccugccaaagccaucuugcuucucccguauuauagaguucccagcaugaacugcaagugaguagugaggcagaggguagagguuuaacuucucucucaggaaagcaucugaagaugaugacacauucugucucaagaggggacaaaugucugguguugaaagucagguugaggcuaggcaugugcuaaucuuugcacucagggaaacugaggcagaggauguauggcagaagacucucacaauagaacaucaccuuuuauuuauucauuaauacauucuuuuaucuauauuguuuucaugaaauacauugaucauauucuucccuuuccccaccaccucccaaguccucccuaccuccuuacccaccaaacuucaugcucucucucucucucucucucucaaaaaaaaaaaucaaaacaagcagacuaagagaaaaagaaccaaaaaaaccccaucagcaacaaaauguacuccuuuuuaaagauuguuauuuauuuacuguauguguauguacacgugugcucaaagacacacacacaugccaugauacaugugcagagaggaugacuuuuggaaguaguuuuuuccuucaucuuugucuccaugaucaaauucaaguccacagacuuagcagcaaacagcuuuaucuuuuacugguugacccauaucuccagaccaauaaugucacgguagacucagaaaaaugagcaauaacuaacuccacuugggguuuuucccaaggaaaaaggucucaaggcuggaaguguaauuaaaccauccugcucaaaugggaagacccaagugguacuaaaagucagaaaguguaauaaguuccugcuauauaggaagaggcuagccuauuaaaggaacuaguauaguggcuggacagucacaauugagagcuuacagcagaaugcgcauagugggccuacccagaaacaaaacccaguaugguuucuuuaauuuuaagauuuauuuauuauuauaucuaaguacguuguagcugucuucagacacagcagaagagggugucagaucucauuacgggugguggugagccacuaugugguugcuaggauuugaacucagggccuuuggaagaucagucagugcucuuaaccacugagccaucucaccagcuccccaagcccccaagcauagauucuaagaaauauuuaacgacucugcucaagcaucacuuuuuccaaccuaauaggguuuggagaaaggaaaguaacaaagccacuguugguaaguacacaaaauuacaaaagaaaguuaaucguuguucuuggauuauaucgaggccugaacuccuugaucuuccugccucagcucucaaauucugggauuauagaugugcacugcugugcccacuuugaucaauguuuuuauuuuaaaauuauaaauuccuaggauugcacuuuggacuauuugauuuuguuauuaugaaaagagucuuuaggcagaggugaguggguagaaggagagaagagagaggaaagaggagacagagagagagagacagagacagagacagagacagagacagagacagagacagaaagacagagagagauuagccaggcaacauaggacugugauuccagguaggagucaggaugaucauacuuucaaaggcuaccugggcaauuuagcaagaauuugucucaaaaauuaaaaagaagaugaggaaauuggcaguauaggucagcuugcucaaggcccuaaauucaauugcccuacugccaaggaaaaagagaaggagggagaggaagaagauaggaagaagaggcaagaaagaggaggaggagcaagagguggggagggaagagugggugccaggaagaggggaaguaaagaggaagaagaggaguaaaaagaagaaaauucuuuuaaaauuuuauuuauuauuguuaguguuaauuauauguaggagugcucugucugcacguacacuuccgugccagaagagggcaucagaucccuuuauagauggccaugagucaccaagugguugcugugaauugaacccagaaccucaaaaacccagccaauguucuuaacugccgagccaucucaccagcccaaaacggaaauguaauuucuuuuuuuuuuuuuaagauuuauuuauuguuauauguaaguacacuguagcugucuucagacacaccagaagaggguaucagaucucauuacggauguuugugagccaccaugugguugcugagauuugaacucaggaccuucagaagagcagucggugcucuuaaccgcugagccaucucgccugccuccagaaauguaauuucuuaaacuucuacuuuuagaaacugcaaaguccaagguuggaggagcuccuugguucagccuuugggccacagcuugccagcagauagcggcaugcugagcgcuagagcucgcuucuucagugacccccuaaagguuccuguauaagaagcucauuccccaacuuugugauguagagagcugacaaaaaaacaaaccaaacaaacaaaaauucuucaagauauauacccuagaggcuggggagauaggacuguguauaagagagcuugccugcgugcaaacacggaaacccaaacucaaaucgucaacacagcaguggauuccagucaaccuaaggcuaugggagcaauguggaaacaggaaaaccccugggguuugcuagguucguccuugggucagccuagcaagcuccagcuucgguagcagacccaguuucagagcuccagcuuccguagccgacccagucucggaggaauaagguugaaagcgguaaagcaggcacugggugucugcgcccucuucuggccugaacaugcauaugcucacauauguacuucucacaugugcauacacgcugcacucacaccuacauacacauuuuuuuaaaaaaagauuuauuuaguuaaugcuauuaguacacuguagcugucuucagacacaccagaagaggacaucagaccccauuacagauggucgucagccaccaugugguugcugggaauugaacucaggaccucuggaaaagcucuuaacagcugagccauuucuccagcccacacauuauuuuuuuuuuaagaagugagguuggaaagcaauuaagagcacuugcugcuguaacagaggagaaaaguuugauucccauuacauacauaaauagcucauaaucauguguaacuccagcugcugggacucugucaaccuguucugagaacuugacucugucaugcacacucuguacauauaggcacagacaaacacaugcauacacauaauuuaaaacauagaauaugagacaaccgaucaccuuccuggugagagcacagggguccgcccggcccgagaggaugggucacacggcccccaauggaggagcuagagaaauuacucaacgagcuaaagggaacugcaacccuauagguggaacaacauuaugaacuaaccaauacccaauugacucuagcugcauauguaucaaaagauggccuagucggccaucacugcaaagagaggcccauuggacuugcaaacuguauaugccccaguacaggggaaccccagggccaaaacgggggaguggguggguaguggauuggagggguggguauggcggacuuuugggauagcauugaaaauguaaaugaggcccuuccgcucggcucgagccccgggcuaccuugccagcagagucuugcccaacacccgcaagggcccacacuggacuccccacgggauccuaagaccucuggugaguggaacacagcgccugccccaauccaaucgcacggaaccugagacugcgguacauagggaagcaggcuacccgggcuugaucugggacacaaaccccuuccacuccacucgagccccgggcuaccuugccagcagagucuugcccaacacucacaagggcccacacaggauuccacacgagauccuaagaccucuagugaguggaacacaacuucugccaggagucugguucgaacaccagauaucuggguaccugcccugcaagaagagagcuugccugcagagaauacucugcccacugaaacuaaggagagugcuacccuccaggucugcuuauagaggcuaacagagacaccugaagaacaagcucuuaacagugacaacuaaaacagcuagcuucagagauuaccagauggcgaaaggcaaacguaagaauccuacuaacagaaaucaagaccacucaccaucaucagaacgcagcacucccaccccaccuaguccugggcaccccaacacaaccgaaaaucuagacccagauuuaaaaacauuucucaugaugaugauagaggacaucaagaaggacuuucauaagucacuuaaagaauuacaggagagcacugcuaaagaguuacaggcccuuacagaaaagcaggaaaacacagccaaacagguagaaaucauuaaagaaaaacaggaaaacacauccaaacaggugauggaaaugaacaaaaccauauuagaaauaaaaggggaaguagacacaauaaagaaaacccaaagcgaggcaacgcuggagauagaaacccuaggaaagagaucuggaaccauagaugcgagcaucagcaacagaauacaagaaauggaagagagaaucucaggugcagaagauuccauagagaacaucggcacaacaaucaaagaaaauacaaaaugcaaaaggauccuaacucaaaacauccagguaaugcaggacacaaugagaagaccaaaccuacggauaauaggaauugaugagaaugaagauuuucaacuuaaagggccagcuaauaucuucaacaaaauaauagaagaaaacuucccaaacauaaaaaaagagauguccaugaucauacaagaagccuacagaacuccaaauagacuggaccagaaaagaaauuccucccgacacauaauaaucagaacaacaaaugcacuaaauaaagauagaauauuaaaagcaguaagggagaaaggucaaguaacauauaaaggaaggccuaucagaauuacaccagacuuuucaccagagacuaugaaagccagaagagccuggacagauguuauacagacacuaagagaacacaaaugccagcccaggcuacuauacccggccaaacucucaauuaccauagauggagaaaccaaaguauuccacgacaaaaccaaauucacacauuaucuuuccaagaauccagcccuucaaaggauaauaacagaaaagaagcaauacaaggacggaaaucacgcccuagaacaaccaagaaaguaaucauucaacaaaccaaaaagaagacagccacaagaacagaaugccaauucuaacaacaaaaauaaaaggaagcaacaauuacuuuuccuuaauaucucuuaguaucaauggacucaauuccccaauaaaaagacauagacuuacagacuggcuacacaaagaggacccaacauucugcugcuuauaggaaacccaucucacggaaaaagacagacacuaccucagagugaaagacuggaaaacaguuuuccaaacaaauggucugaagaaagaagcuggaguaauaucuaauaucgaauaaaaucgauuuccaacccaaaguuaucaaaaaagacaaggagggacacuucauacucaucaaagguaaaauccuccaagaggaacucucaauucugaauaucuacgcaccaaaugcaagggcagccacauucguuagagacacuuuaguaaagcucaaagcauacauugcaccucacacaauaauagugggagacuucaacacaccacuuucuucaaaggacagaucguggaaacagaaacuaaacagggacacagugaaacuaacagaaguuaugaaacaaauggaccugacagauaucuacagaacauuuuauccuaaaacaaaaggauauaccuucuucucagcaccucacgggaccuucuccaaaauugaccauauaauuggucaaaaaacaggccucaauagauacaaaaauauagaaauugucccauguauccugucagaccaccauggccuaagacugaucuucaauaacaacauaaauaauggaaagccaacauucacguggaaacugaauaacacucuucucaaugauaccuuggucaaggaaggaauaaagaaagaaauuaaagacuuuuuagaguuuaaugaaaaugaagccacaacguaaccaaaccuaugggacacaaugaaagcauuucuaagagggaaacucauagcucugagugccuccaagaaaaaacgggagacagcacauacuagcagcuugacaacacaucuaaaagcucuagaaaaaaaggaagcaaauucacccaagagggguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguuaaccaucuaaacagucccauaucaccuaaagaaauagaagcaguuauuaauagucucccagccaaaaaaagcccaggaccagacggguuuagugcagaguucuaucagaccuucaaagaagaucuaauuccaguucugcacaaacuauuucacaaaauagaaguagaagguacucuacccaacucauuuuaugaagccacuauuacucugauaccuaaaccacagaaagacccaaaaaaaauagagaacuucagaccaauaccucuuaugaauaucgaugcaaaaauccucaauaaaauucuugcuaaccgaauccaagaacauauuaaagcaaucauccauccugaccaaguagguuuuauuccagggaugcagggaugguuuaauauaugaaaauccaucaauguaauccauuauauaaacaaacucaaagacaaaaaccacaugaucaucucguuagaugcagaaaaagcauuugacaagauccaacacccauucaugagaaaaguuuuggaaagaucaggaauucaaggcccauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauauuauaguauauauaagugacccuaaaaauucuaccagagaacuccuaaaccugauaaacagcuucguugaaguagcuggauauaaaauaaacucaaacaagucaauggccuuucucuauauaaagaauaaacaggcugagaaagaaauuagggaaacaacacccuucucaauagucacaaauaauauaaaauaucuuggcgugacucuaacuaaggaagugaaagaucuguaugauaaaaacuucaaaucucugaagaaagaaauuaaggaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuggaaggagcaauuugcaaauuugucuggaauaacaaaaaaccuaggauagcaaaaagucuucucaaggauaaaagaacuucuggcggaaucaccaugccagaccuaaagcuuuacuacagagcaauugugauaaaaacugcaugguacugguauagagacagacaaguagaccaauggaauagaauugaagauccagaaaugaacccacacaccuauggucacuugaucuucgacaagggagcuaaaaccauccaguggaagaaagacagcauuuucaacaauuggugcuggcacaacugguuguuaucguguagaagaaugcgaauugauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcguggauguggagaaagaggaacacuccuccauuguuggugggagugcaggcuuguacaaccacucuggaaaucagucuggcgguuccucagaaaacuggacauaguacuaccggaggauccagcaauaccucuccugggcauauauccagaagaugccccaacugguaagaaggacacaugcuccacuauguucauagcagccuuauuuauaauagccagaagcuggaaagaaccuagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaagaaacucacacaauauguacucacugauaaauggauauuagccccaaaccuaggauacccaagauauaagauauaauuugcuaaacacaugaaacucaagaagaaugaagacugaaguguggacucuaugccccuccuuagauuugggaacaaaacacccauggaaggaguuacagagacaaaguuuggagcugagaugaaaggauggaccauguagagacugccauauccagggauccaccccauaaucagcauccaaacgcugacaccauugcauacacuagcaagauuuuaucgaaaggacccagauguagcugucucuugugagacuaugccggggccuagcaaacacagaaguggaugcucacagucagcuaauggauggaucacagggcucccaauggaggagcuagagaaaguagccaaggagcuaaagggaucugcaacccuauagguggaacaacauuaugaacuaaccaguaccccggagcucuugacucuagcugcacauauaucaaaagauggccuagucggccaucacuggaaagagaggcccauuggacuugcaaacuuuauaugccccaguacaggggaacaccagggccaaaaagggggagugggugggcaggggaguggggguggguggauaugggagacuuuugguauagcauuggaaauguaaaugagcuaaauaccuaauaaaaaauggaaaaaaaaagaaaauguaaacgaggaaaauaccuaauaacaauaaaauuaaauuuuaaaaaaacauagaaugaaagaaagaaagaaagaaagaaagaaagaaagaaaggaaggaaggaaggaaggaaggaaggaaggaaggaaggaaggaagaaagaaagaaagaaagaaagaaagaaagaaagaaagaaagaaagaaagaaagaaagaaagaaagacagacagacagacagacagacagacagacagacagacaggaaggaaggaaggaaggaaggaaggaaggaaggaaggaaggaaggaaggaaggaaggaaggaaggaagccagauagugguggugcacgccuuuaaucccagcacuugggaggcagaggcagacaaauuucugaguucgaggccagccuggucuacagagugaguuucaggauagacagagcaauacagagaaagccuaucucgaaaaaacaaaugaacaaauaaauaaaugaauaaauaaaauguucuuauuuauguuuuguuguuuucaauccaucccucucacaacuuccacuccguccucucuucccaguaccugcuccccaaccucccuuuaaccaagaucccaucguccuugaguuuccuucagaguagagcaggccucccacggaucuccacugaacaagacacaagauacaaugagacuaggcacaugcucucagaucaaagcuggaugaggcaaccuaguaggaggaaagggguccuaagagcagaugaaagagauuaaauuaaaaugaaaaucuuaaaacaaaaaaauuaaaagugcagccuaguagagguggcaucuuagguuugggcagugugaggggacugugagguccuggucucuucuuauuccugcuugccaaccacgaaaugaggggcucuguugcucuccauguucucacuucauugugugcugccuugccacagaucccaaagcaaggccaaccaacaacaggcuggaacagguuaaccuaaagaaccuuguuuuaucucuaaguuaccuaaaguauuugcuaagguaucagaugagcagcuaacugauagcugcuguaugacuuugugggguggccagagacgguacggucagucagaaaucuagacaauagugcagugucagacuccaguuagcacagcccuuucuguaagaaccgaugaagacaucccuugaaaauggcuucaguuccccuuaggacaacaugcacacacauggaaaaaccauucaagauccagcucucucucauacuaagaaccaagcuucuaaccuugagcaucccaaccaucacacuccauuaaaacaaagcaaguuguccaggggaacaaaucagcagggcuuugcaaauauaaaggcauuuuuauuucauuuccgaguaaguucauauucacagacugguaugaucagagguuagugacugugacgauuggguucaaaauaauuaaaacugucacagagcuugacaguugguugcagcucucagcuaaaagcuaaacuggggugaugggagugggaauagagaggagugaacuuuccuaauggaauuuaaaggagacuagaagugcuagcacgugauuaacuagagauuugcaaagcggguagucgcuuggaguccaucacaagauucuugcuuaacugaguggauguguccaguuauaaagagaggauaguacauuuuuaucauucauagacaucacauauggcuuugagauaccuguaggauaccugaauagagauuucuagugaguacauacacauaugagucgaaugaucagaagaaauaucuaaacuuuaaauaaaggcuuggcaucaaggaggcaacuggggagucaccaagauggcucagcaaguaaaggcaggcacauacacacacacacacacacacacacacacacacacacacacauacacacacuacagauagauagauagaaagauagauagguagguagauagaugcugagaaagaaggcaauugaaaaccacaguacaaauaguuaucccugaaaaucaucauguaaaauggaaaaguccagguuauauuuuauaguugcugcuauuuuuguuuaaaauacagucuaaguagagucagaugggcucaccucagccucucguuagccuugaguacuggagucaggugcagccaagagagauucgagcaucuuccuggcaaacuggaggcaaaagaccauuuuugcuuuacuggcucuccuccugcaccaggugccucgggacugaaauccucuccuuucuaggggaaagggccucuauacuaacacacuaaaaagucucccaugaacuucccccagcaagggcaagggcaaagucuggguagggaugagacuguuaauggcuuaucuacuguaucucacacuaccacuucaccuauugugaacucugcucucaacuccuccugccccucauaaccuccaucacccuaucguagccuacgacugucuucagaacuacucacgguacccauccaccaacccuggcaacauccucaaggacucaccccaucuuucucaguucccugggggacaauacccacucaaugguauccuugggggacaaaccuucauccccaagucacaucacuaaucuucaagccaagaguucugggccagugguacccagagucccaugggauuuaacuucaaaucacaggaagugugugauucuuuuccugaccaggauuuugagaugauucccaauggacccccaagauuuuucaccuccccacagacuucuccaauauuggggucgaguauccagaccuuugcaccuucccaggauguaagcagugacauccauccugauaaggcaacagaaaaggagcugacaggaaauggcaugggcuugguaggcagucuggagcuggggaagagcauccagaaguaaagguguguaccugucuccucuguagagacuaagaggucucuauccuggucccugaucacacagugagcuaucuagaugauccuucacaucuuccugaucaccuggacaacucuccaauugccagugaagauucccuccagcccuuugacucucuggcagcagagccagugaguggaggacuuuaugguauagaugacacagagcugaugcgugcaggagacaagcugucucuggaggauaacccuccauuguucuucucucaguaaugcuaaugccuuuagucucuuggcagaugacagcuaaauaucaaccuccaucuuugucagcccuaccuccccaucugucugucguaagggauaacagcuuuggccugaauaguggcaaugacucugaacaggaagaaguagagacccagucuucaaacuuccaacauccccuaacugagucagccccugaccagccaccuaguacucaacuaaacccagcugucucaucaacagccucuucagcaaccuccuuggcagcaccugcagaaagcucuccagcugucucuccaguagcaugcucucuugucccuccugaagucuuuccagcagucucuccagcuuccucaccugcucucccagccaucucuuugggagccuccaugacagcuccagugauuucuccucaagguuccccucaaccuucuccagcagcugccuuccagacagucuccccaacaaguaauaaugucaguagugccccugaagcuugugcugauugagaaaagauaacuggagaaguagccgcagucuuuguauugauguacugaagagacauauugcuacccaagaaguuugucuuccccuccaguauggaugguaaagagaagugugcaugaagaaguucagccauccuaugggguugcaaaccccuucagcuccuucaguccuuucuccaacuccuccaucagggacacuaugcauaguucaaugguugaaugcaagcaugcaccucuuuauuuuucagccucugacagagucucucaggagacagcuauaucaagcuccugucagcaagcccuucuugccauccacaauaguguccggguuugguaacuguauaugagauggauccccaaguggggcagucucuggauggccuuuccuucagucucugcuccacaguuugucuccguauuuucucccauaagcauuuuguucccuccucuaagaaggacugaagcauccacacuuuggucuuccuucuacuugagcuucauguggucugugaauuaaccagaccccucccagagcucccagguacuaaaccaccaaccaaagaguacacauagaggaacccaugacuccagcagcauguguagcagaggaugaccuugucgggcaucaaugagaggagaggcccuuuguccugggaaggcuugaugccccaguguagguuaaugccaggguggggaggcagaagugugugugugggugggggagcacccucauggaaacaggaguaggggggauaggauacggaguuucuggaggagaaacagggaaaggggcuaacaucugaaauguaaauaaagaaaauauucgauaaaagaaaaaaagaaagaaagcaaaccaagaaagaaaaaaaaaaaaggacagccauugguggcagggggagacuugguauuguggccccugugggaagaaaaugaagcaauuuccaaaaguuaucaaauaccugagccaaaaugugguacacagugucugccaugagcacuucagcuucagucucugcaugccugcuggagauuugaagaaagagauacaccagagagcuugcaguggguccaguuaucagcagaggggauuucuuucagaauucaagcaauuacuagcaaaugaagcugaccucgaaacaaugagaaggcuaagaacaaggagguucccaaagugaagcgggaccaugcuuggccuccuaagaucaaaaugcccgaguggcugaauaaaacagacaauagacuuccaaagaaacuggaaacucaagaaacacugagugaagagaauaacacaaagaugacuaaaagcaaaaagacgaggcagaaggcacagcggggagagagucgacuccugcccaagggcagcccaagcagaggugcuugcagaguuugaaaagaaaugacuucccuuaugguuuacaggccagaagcaagaggaagcaagacacgaaaaacuuaaagcugaaggacgaggagaagaaauucaaggcugagaaagcaaagaugaagacaaagcaggagaagcugaaggaaaagguaaagagggaaaggaagagcccagagccaggccauccuguagagcagacaagaccuugccacacagaggcggcugguggggcggcagaggcaguggguuaucuuggaggagaugaagaagcccacuggggauaugugucuggcugacugaccaccagccucugccugacuucacacccauugcugguuugacgcuguccagcagggcuuucucagauuguuugaccauuuguggaguuccugcauaguuuuggcaaagugcuaggcuuugaccuuaccaaagauguuccuagucugagaguccugcaggagggacuuuuaugucaaggugacagcuuggacaaagugcaagaccugcugguauagcuccugaaggcugcacuccacgauccuggucugcccuccuccugucagucccuaaagaucuugggggggaaaggugucagagagcucauugaccagaggcaaugugucugagauacugcgcugcuuccucguggcauagagagcagagccauccuucuaugacagucugcggacccaaccuuuucaggcccagucaucucaacagaaggcugcucuuccagccuuccuugugccugagcucaacaguuccgccauuaucaucaaugagauugacacgacucuguagaguaugucuagcuacaggaaaaacaaauggauuguugaaggccgacuccagggaccaaaaacuguucuggccaagcaaaccagguggccugagguuaugauggaaggggcagaagacgaccugggacagaggugcaguucuccgaucauggaggaaacuagugacagagaagaggaggaagaggagguaaauacaacagcugucaauggccacaggggucaaagagauggagagguugauguugcaacaucuaucauuccagagcgggagugccagauagaaaaacucaguaagcaucagcucuucuucuucuucuucuucuucuucuucuucuucuucuucuucuucuucuucuucuucuucuucuucuucuucuucuucuucuuccucuuccucuuccucuuccucuuccucuucuucuucuucuucuuuucuucuucuucuucuucuucuucuucuucuuggcaugugccaccaccgcccggcugcaucagcucuucuuuagaaaaaaacugcuucacucaucccagaugcuccaggcagugucauugguuaaaaaccgcuauagacaccauuacuggguauuacuguguuucccugguaucuuugcugaagggucagaggagugcacaguuacugacaauggaacaaagcaagaaacugaguccuugauggaagcagucacuuccaauacccagcucuacccgagucucuguaaagagagaauuaacuaacuccaaccccucuacuucuccugccggguccagaagaccaccucgaaaaccuaagccugggucuccgcagccucagcuccuucaguucaccauuagggaacaugauucagaacaagcccagacucaagcucaccccggaccucagccccaaucucaaccucagaccccuacccagccccgucuuuagucaagucgcggguuccuagagccggaagguucccuguucucucugggucagagccagcacgacuucagccaguccgccuuccugucuuggcugagccagacucagagccacaacuuccuguugaucagcucaguccucacgccugacagcagcccaggaaaacuagacucugcucuaccucaguccuuggaggagcccgagccugaugagacacaacccugcccugguccucaaggucccugguuuuaucuucucagcccagauaccccgugaugcucacugcuccuacaccaucacgucccccacaguuucagaggaccaaccugcucccucccuccagcugccugccuccucggaaccaaugaauacacccggugcugcccauccuuguucuccagugcuacucucuuccacccacuugccuggauggggccauaggaggccaucgggggacucugaaaaaaugccagagucccacagggcugggacaaccaaagcggagagggagaccuccuagcaaguucuucaaacagguggagcagcauuacuuaaaccagcugacaccccaggcuauucccccuugagaugugcucaugcauagcuuuuuuuuuaauucauuuuuguagugcuagcgaucaaacccacagcuuucuguaugcaaaucaaaccccccaccaagugagcuacaucuaaggcaagcacccacccgaccaacuggacagucccugcucuugugaucguaggcagcaggcgaaagucaaaguucaaugaaccacugaacaugcgugagagaacugcccccucacacacacacacacacacacacacacacacacacacacacauacacuggaaagugaaaccaacugacaggcgacaugcaaagucgaggggcauuuaauuagaacguccuguggguuuaaaugggacauuccaccagaacacugggauuuguuuccauguugguaaaaucagguaaaccgaguacuugacgcagugacgaggggaccuguucccacaguaaccagcaaccccacccauucugucuagggaaggguuuggguuguugagaacagcacaaggcuucccuauguagccuauauuugcuuugaacucauaauuuuguagcccaacuaaccucaaauuuagugaacuuccuacaucagccugacaaauguuaggaugagaagguaggcgagagguuugcuuugcuuuucuucugaaagucacauucugccuuugccacacuaaccccaggaucuccucauuuccccaaacugccugucaaguaaaggucguuucuggaaagcauugccucauuacuuacuacauauuuggugguugcugaaacuucugucuuuggcucugguguguguguguguguguguguguguguguguguguguguguguauuaacauuuuuaagcaucuagguugaguugaauaguuauugaauuuucugcucuaacacaacaaaacacuuauuuuuaguacgugauuuggcagagugugaggagucuuguuuguuuuaugggaaagcacguugcauugaguaaaaaugucuaugugguggggaaaauaucauuuuaucaggaucaaacucuagguguaaaugaaaaaguuacucaaguauauuaauagcaaaauaauaugcaaaacuuaccuaacggcgugugcaugcacguccauaauccugcaugugugaccuguauuguugagaaggagggauguuucaaucuucauuaguagaaguaacaaaggucauagggucacuaauguauaauuaaaaauucagagguuccuaggagcaagagaguuuggcucagcaguuucgaguauauacagcucuaaaagaagauacuguuuauuuccuaacaccuacaucagguggaguacuaccacauguaacugcagcuacugagaaaucuugacccuucuggucugcuugaacacacaauuaaaaauaaaaauaauaauaauaaaucggggcuggagaaauagcucagcagcugcccuuccagaagacccagguucaauuuccagcacccacauggcugcucauaacuguguacaacuccaguuucaggggaucuaacacccugacacuuacaugcaugcaggcaaaacaccaaagcccauaaaauaaaaauaaaucauguuuaaaauaauaauaauacaaauaaaaauaaaccuuauaaagaaaaugauggggcugaagagauggcucaguugaccagaacuaauaucccacccaccaagggauaguuaccaacccacuguaauuccagcuccaagggauuuggcaccaaaaaacauauaacaggcacacaaacauguguacauauacaaaaaucaaaauaaaucuuuaacaagagaagaggaauccaguaugccauacuugggccucuucuaggguuccagucaacaaccuagaagauuagguucauuaugaaccuuuaagcaggcugcaaaacaaguaggcuauauaaaauuuuguuucaaaaacaaauaauaauaauaaauaauagcagcaauguuaugauagcagugggcacgaugguguaugccuaugguccaggcaugcagaaggcagaagcagauuguuacaaguccaagccaguuuuuauuaccagucaaaugaaagcacuacacaugauaguaaauaccuuuugguuccagauacucaggaagcugaggcuggaggauucuggugugggaaccuaguuuggguuccagugcuagaccuuaucucagugaggaaaagaaaaauguacuugcuuagagagguuuaaaugaagacauuuacuauaaggcugaaaaaguaguuauuuagugucauaggguuuccaugacugugaagagacaccaugaccaaggcaacucuuauuagagacagcauucacuuggggcuggcuuacagguucagagguucagucuguuaucaucauggcaagaaauauggcagacuccagacagacacaguuuuggagaaggagucaauagaucuacaucuagucaagaaaagccugucuucagacaauuaggaugagggucuugaagcccacccucacagugacacacuucccccaacaagacaauaccuucuucuuacagugccauuuacugggccaagcauauucaaaaccaccacauuuaauaucuaugcggcccuagguucaaucaccaaaaugugugugugugugugugugugugugugugugugugugugugugugugugugaauauuuguuguauguuugugucugugcugaaauugaugacuaaagauuuauaaaugcccuaaaacaugguagaauuucauuucuaacaugucuguuggacugugucugaaugagaugacuauuuuucuuagaagguaaauaaaauccaucuuuacuguaggcaggcaccugacaaucagagagcagugacagagagaacaaaggcaaauuggaaucuucucugagaaucaguauagcgauuuccccaggauuuuuagaugccagaaccacagacucauuggccagggauuccuuaaauaguacuauucgguucucagagaguuggccuuuaguguagaauuaugucacugauuucccucuuucugaggucuucccuuuugcacagaggcacaccccagcaucccaggaucuccaacugggaugcagccauucuuagaauguagcuuccaugaucgcaugugccaauucuucauuaaauccucuuuccucuaccaacauacuacaugcuccugauucugucucucaagggacgcuucaccaauaaaaugaaaugacaguuauccacuagucaucaaauaggaaucuuuucaagaaugaauguuaagauaacaaaaugcagagucggaaugcaggagucugucagacucuacaggagagaccucugugggacauacuuguggaagaucuagccugagagcagaaaaaaaaaaacugaaaccauaagcaauuuguguucauuuaacuaaacaugugaagaaguucacaucacugucuuguaugaacagggauagcaauaaacaaaaugaauauuugcaaaauaaauaccuugagucucuaacagccuuuuaacucaggaaagguugcccccuucaagaaagaagguaaauuuuauuccuccauuauggaaaagaaaaucaaauaccaccugaggauacuuuuauuuuggguugaguucucauccacagcuauccuaggcuugcuugagacuaccucucgagacuaauaaaauaguuuugugacugagaacacaauucuugaucuguucuccagaucuguuuucuguuucauccacuauaaaaugagagugcugcuuagagaauccgucucuaaccccauuucuuuucuucccucaggcagcaagaagcaguucacugaaauaagugccuguacucauuuucuguugaaugguaacagauuacaagaaguuuagcauccuagcacacggcaccuauucaugagcucacagcucuauggaucugcuguccagccuggggugacuugauccucuguucaugucucaagaggucaaaauaagauaguggccaggacauauucucaucugaaaucugugcucaauccccucgguuauacaacugaccagcugcugccaucucauuuuauacuuuuuuaaagguuauuuuuaauuguguauguguguguguguguggggggggggguauggguucauguuugcaaaugcccacagaggcuagucacuggaugcuccaagcacugcaacuacaagcguuuauagcugccuaauauagguucugcaaacucaguuugaugccucugcaagaacagucugugcucuuagcccccaagccuucucucuagccucugaaagaugccauucucuugauagcagauggugguuguuuguacugacucaucccuccucagaaauuauauaccauccuggcauggugguucacaccgcucaucccugcacucaagaggcugaagcgcacaagacaacgaaaggacauaugugcuaaugguauccaaaaggaggaauggagaagaggaacuauuuucuguuaagaauucucuaaacuugcugcaugugguguagucccagcacuuaugaggcaaaggcaggcaaaucuuugagagcaaggccagugugguuuagacagugaguccagaacagcuagggcuacauaaagaagcccugucacaauaaaucaaucaaucaaucaaucaaucaaacaaacaaacaaacaaacagaaaaaaaaagacuuacuaaacuaagacuaacagcuagggcuacacaaggaaacccugucacaauaaauaaauaaauaaauaaauaaauaaauaaauaaauaaauaaauaaauaaauaaauaaauaaauaaaucagaaaaaaaaaaaaaagacugacuaaacugagacuaacucugucuaauaguagacacuauuccaggauuguuaacuucccuggggugguuuacagucuaaggaugauuagaaaggacaagcgcuuucuugguaaagcuaagcaaucuuuuucuucacgauggauagaucccuguguggggaaccagucuuaucucacugugucaauugauuuggaguguagagguaacagagccaagugggacagggaagaagugaguggaugaauaccuuucauccuccaacuugggaggugggaacagaagaaucaagaauuuaaguuuauucuugucuacacagccuguuuagaggcagccucgaaacuaaggauauauggacaugagaaaaacccauacugacagauuauuuuguucuggugcggagauucuuuaaugauaggcaugcacuguacuaacugagccacauccuuaaccccacaaugacacauacgaugauucugucccuaugggaacuuagaaauuaaccucuggacuguauuauugggaggggggcaguugugggagagaagcauggguuagaaacaggaaucuguaaggugccuucaaguagucagaauaguuuucucuggcugagacucagaauuugcucaagcauuuggcaaacaacacuugcuacaacgagguaugcuacuuacuauucaggaacuauguugcuauacaaccguaucagagacagcucacuagcucacuugccaaguuugacaugaagacacugcaucuuauugccugggaacccacaagcuacuccagccaggaaagcagguuggcuaagcagaacuucaucuaucguugcuuuucuucaagcccgauccccaagucccaucccaagcucuguauccaacaguuguugucggccacuuucucccucacucuaucuaaaaucucucacacagaauuuccccuccuaaauucucccccaccccccacuccuugcuuuauuccaacguaaagccacagcagguauuucuugggaggcgaaagguuacuccagcaagggaagccacuaagcuaacugaacaccugcaucucuugcucuguccauucccccagucucagccccagcucuguagcagacgccaugcaauggccucuucuuacuuuuugccuccauucccaggaaacaaagcaaauccugcaggaacacucggcuucccucccuccuguggacccccucaggccacccucacuccuagccauuacuaagcucucaauaccuagauauauaauguacccagaauacucaauggcucccccuuucaggaucccagaagaguuuuggaccagacaacacacagccaccacacucuccuaagaaccacagauagaaacagaaaccaaggcgcaaaacccaagaaagauaaauccagauaucagcaccuagaaucucuccaaacucagaugcugagaugccaguguaaaaacacaaucaauaacaaccagaucaauauggcuccacaagaauccaacgauccuaccacaguaggcccugaguauuacaccauagcugaaacacauacacacacgcacccuuaaaauagccuuuuugaauaugacugagguccuuagagaggaaaugaauaaaucccuuagagaaaucugugaaaacacaaacaguggaaggaaaucaauaaaauaauuucaagaccagaaauuggaaauagaaucaauaaugaaaacccagaccaggggaaaucuggaaaugaaaauuuuaggcucucaagcaggaacuuuagaggcaagccucaccaacacaauauaagagguugaagggagaaucucaggaauugaagacacauucgaagaaauggauacauaggucaaggaaacuguuaaaucuaaaacuucuccugcccuggaauaccugggaaaucugggacacuaugaaaagaucaaaccuaagacuaauagaaauagagggaagagaaaaaaacacaggucaaaggcacagaaaacauuuucaacaaaaccagagcagaaaauauccuugaccuaaagaagaaaauauuuaucaagguacaagaagcguacagaacaccaaauacauuggaccauaaaagaaagucacuacacacuaucugaccaccacaauuaaaacuggcuaucaauaacaauagaaauaaacagaaaucuuacaaauucauggaaacagaacaacucucuacuuaaugaaguuaagagagaaugaaagagaaggaaugaaauaaaagacuuucuggaauugaaaagaaaugaauacccaacuacugcaaacuuguaggacgcaaugaaggcugaucuaagaugcaagaucauagcacuaauugguaccuacaguuaaaaacaugacaagaucucauacuaauaacaauacuccugacaacuuuagaacaaaaggaauaaaucacacccaaaaggaauaaauacuaaaaaaacaaaauaaguauugaaacucaaggcuaaaaucaauaaaauagaaacaaacagaaaauaaagcaaagagccaaugaaagaaagaguugguucuuugagaaaauaaguaagauuagcaaaccuugccaggcgugguggcgcacgccuuuaaucccagcacucaggaggcagaggcaggcugauuucugaguucgaggccaaccuggucuacaaaguaaguuccaggcagccagggcugcacagagaaacccugucucgaaaaaaaaaagauuggcaaaccuuacccaaauagacuaaagucuagagagauguccaaacuaacaaaauuagaaaugagaggcagaacauaacaaguaccagggaaacccagagaauccuaaggacauccuuucaaaaucuauacuccacuaaauugaaaaaucuuuaaaaaaaauacuuuucucaauauauaacucuuguuaaagcuaaaucaagaucagguaagcaguuugucugucugucugucuguuuguuuuucaagacaggguuuuucugccuaugcagccauagccauccuggagcucacucuguagacauggcuggccuagaucuaaaagaucucccugccucuaccucacaaguucugagaauagagaacugugccaccaccacccagcuuuagauaagcaacuuaaagagaccuauaacccuuaaugaaauagaugcagucauuaaaaaucucccaaccaaaaauagcccagaacaagaucguuuuaacauggaauucaaccagauuuuaaaaaaaguuaaugucagugcuccuucaaguauuccacaaaauagaaacauaaggcacuuugcccaauucauuauguaaggccacaguugcccugauguccaaaucacaaaaagacacaaaaaaguacaagaauuacagacaaauuucccuugugaacauauacacaaaauuucucccaaaaaaaaacuugcaaacugaauccaagaauucaccaaaacgaucauccaccauuaucaaguaaacuucaucccaaacauguagggaugguucagcauagacaaauugauaaauauaauccaccauauaaacaaacugaaaggaaaaaaaaacuauaugaucauuucauucguugcugaaaaagccuuugauaaaauccaauaccccuucgugauaaaugucuuggagagaucaaggauacagagaaauaccuaaacauaauaaagccaauuuauagcaagcccauagccaaucaacaucaauuuaaauggagagaagcucaaagcaauucacuaaaaucaggaacaugacaagguuauccauucuauccauaccuuuucauuauauuucuugacuucuuagcuagagcaauaagaaaacugaaugagaucaguuuggaaaagaauuggaaaagaagaauuggaaaagaagaagucaaaguaucuuuauuugcagaugauaugauaguauauauaacugaccccaccccaaaaaaaauuccccugugaaaauucuacaauugauaaaaacuuugagcaauaucagcagauacaaaauuaacucacaaaaaucaguagcccuccuauacacaaaugacaaauugacugagaaagaaaucagggaaacaacacuuuuugacaacagacucaaauaauauaaugucuugaaguaagucuaaccaagcaagugaaagacuuguaagauuaaaacuuuaagacauggaagaaagaaaucaaagaagauauaaaagauaaaaugaucuguugugcucguggauugcugagauuuauauaguaaaaguagccauccuaccaaaagcaaucuucaaauucaaugcaaucccaacauauuucuucacagaucuugaaaggacaauuuucagcuucauaaggaaaggcacacacacacacacacacacacacacacacacacacacacacacacacacauggauaucuaaaauaauccugaaaaauaaaagaacugcuggagguaucaccaucucuaauuucaagcuauacugcaaagcuauaguaacaaaagcagcaugguauugguacaacaacagggaugcugguccaugcaauugaauugaaaucccagacauaagcucacacacuuauggacacuugguuuuugauaaagcauucagaaauacacacugaaauaagaaaggaucuucaacaaauggugcugguaaaccagacagcuacauguagaagagacauuuccucaaccauguuuguugcugcucuauucaaaacaaccagaaacuggaaacaaccuagauguuccugaacggaagaaggggaaaagaaaauguggaacaucuacagaauagaguauuacucagcccuuaagaaaaacuaaaaucaugaaauuuacagguaaauggguagaacacgaaaaaaaaaucaacuucaguaauauuaucuuagaccagaaaaaaagaaauaugauguauauuggcguauauguggauauuaguugagcuaaaaugguguccugccugcaagaaaugcuagugcaaugguggcacaaaacuuguaggaguagccaacuguccuaggcaggcuuuguauuccugcacaaaacaucaugaucaagaagcaaguuagggaggaaaguguuuauccaacuuacacuuccacaucacuguuccucaccaaaggaagucgggucuagaacucaaacagggcaggaacuuagggguaggagcugauguagaggccauggaggggugcugcuuaguggauugcuuccccuggcuuacucagcuugcuuucuuauagaacccaggacuaccagccagcccagguagugcccuccccccuugaucacuaauugaaaaaauuccuuacaguuggaucucauggaggcauuuccucaagggaaaaugugauaagucccgcuugugucaaguugccacacaaaaccagccaguacaccaaccaacaccugauuugacuuaaaacccacuccaugagaugggacccacauucaguacugcuugggugaccaagagguuaagacuagauagcccaaugaccucaaguaaaaccaaauacuguuguucuggaaagaaaggaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagagggagagggagggagggaggaaggaaggaaggaaggaaggaaggaaggaaggaaggaaggaaggaaagaaggaaggaaggaaggaaggaaaagccacuaccaacaagaacagcaauaagcugauuccuaagauuauucugcuaguauucugcuuuauucauagaucagugccuuguccagucaccaucaguaaagugccccucugcagcagaggaaaacacagagacccacagccagaagugaugucaagaaugggagaccuugucccauaugaacucgcagaggcagcaugcacaggcccugcacagcuucguacuuccuccucugcauauacauuaugguuuccagcuuagcguuuuuugugggauucuugaguuuacaaacaaguggauuucugacucucuggcccucucuugggcucuuguccuccuccuccccccaccaugcauuauuuuugcuguuguuguuuuagcuuauuuuauuauuaucccuuagaagccugcuuguuuauuaaugagaaauggagagaaaauggaucugaaugggaaggaaggagaggaggaacuggaaggaauagagggaggucaagccauaaucaggauguuaugcccagaucccaagguccuacagaccaccaggaguccaacugguaugcaaaagugagagucuuuauucaagcucaagcucggacccuccaaccucucuagcauuguggaugguguggaaggugcuggcugguagaagccuugccuauuaucaugguucacggccaggucagagacuucccaucuugguaguuacaugauugauugacauuuguuuggugugcuucuacuggcuaguaaugauuucagcuuggaaugaacaauggcugcuagcuuaauuaaucuacuuuaagucauuagguauuuuccccuuaagaacugauugguuguugcuauggguauaguagcuauaugcucugggaaauugugauuguuaccaaaugguuccuggaacaaguuggguuuuuuuuuuuuucgguagcugaauucauucaaagggcaaguuaaucaaaaaauggaaucugaaagcaaaauggaguuuguaauguuaagcugggcccuucauugauauuuuaugugaggggggaucuauuuucaauaaauggaaaaacaaaaccucugcaccuuaucucaguguggugguggugcacaccuuuaaucccaucacucgggagaggcagaggcaggcagaucucuaugaguuugaggucagcuuggucuacauagcaaguucaaggucagcaaaugguacauagauccugucaaaacacaaaacaaauccacccacccagacaaacaaaaucuuuucuugagaguauaaaagggacagaauuauuuuuaaguuuuagaaucugaaaaaucuaaguugaggcugauauccuuguacaaagccgagucuuagaaagcaggcacuugucaggcuaguuuagggcagcagauuaggguggaguuucguuuuguuucgagacaggcuuucacucuguagccuuaauaaggccuaaauuggccuuaaacuccgagucuccuaugcugagauuuuaggugugucccgccacacccgaucucugucaucuuucaugaucaugaauguccuauuacuaacaaagaaucaguagcucccaucuaauucauacccaacuaaacccaacaaauagcuggguaagucuuacuauccaucauucuuaucaucauaguauuuucgaucuugaugcucuuuuuauccuggcaaacuuugacuuuuaucacagucccgacagcuaacuagcacugauaaaaucauuauugccgugucccccuuucuaacacucaccuuaccauuuuaacaagaauacaaaaaaaaaaauccuuucucacucgagugagaguuucauggucacuugggcagagagagcccccuccccccuaagcugagcagugugaaauucagacaaggaauuaaggauguuaaagaaaagccuuuguucacgcuacuucagaauaauacgcaggcuaauaucauguuagauuuaccuuguugugauuggagagaagacaguaccuaacucugauuuuguugucguuugucuccugaccaccuuugcuuauuuuuuuucaugcaaugaggacaguuuaaagaacaauacugaauuuuccauuuucaguaacccugaccuucauaaaucaccccagcuacauucaauucucugagacuagcacccagauuuuguucaacaaaaugagaaaaaccuuauuuuuuuuuucaagaaaaaccaucuacucaaacugacuguugcugauauaauaccaguuaguuaagcaguuucgggaaacuuuguuuucuccaaauccaggaguuuugacaaucccuucugacaaugcggucaguugucuuuccacgugugugcuucgggguccugaggccugcugcaguaaccagcuggcccuaggcauuaacugcagcacuuggaagauccaaucagaaggaucaggaguuccagaccagccucagcagcauugcaaacucaaggccagccugggauauaugagaccuccuucaaauucaagaccacaggaaaccugccucaaaacaaauaagcaaacaaacaaaguauaagcaaaauaaauguggcaaguauaaaugagcacccacugacuucaaaggcaacugucauggcuguucuugguugucaacuugacuacaucucaaauuaacugauccauaccuucugcuggaagccuacauaagggccuggaggaaggcagcuuuugcccuuugucugcucugaccuugcuaacaaguccauuccuuuacuggcauuagugccuacuucuuuagaauuccagcauacacucaagaccagguggaauguucagccuccaggacugaacaacuaccggauucuuagaccuuccauucauaggcagccauuguuggaguacguggaccaaacccugaaagucaggcaaauaaauccccuuuucacuuagagagggauucauucuauaaguuuuguuacucuagagcagcaguucucaaccuguuagggguuggagguaggggauuaaaugacccuuucacaggggucaucuaagaucaucagaagacacagauauucagaauggcuaagaucaaaaaugcaggugacagcagaugcuggugagaauguggagaaagaggagcacuccuccauugauggugggaccgcaagcugguacaaccacucuggaaaucaauuaugugguuccucagaaaauuagaaauaguucuacuuaaagacccagcuauaccacuccugggcauauacccaaaagauggcccaacauauaacaaggacacaugcuacgcuauguuuauagcagccuuauuuauaguagccaggagcuggaaagaacccagaugucucucaaaaacggauacagaaaaugugguacauuuacacaguggaguacuacucagcuauuaaaaaacaaugauuucaugacauucacaggcaaauggauggaacuagaaaauaucauccugagugagguaacucagucacaaaagaacacacaugguauguacucacugacaaguggauaguaaccccaaagcucagaauacccacaauacaauucacagaccaccugaagcucaagaagaaagaccaaaguguggaugcuucaauccuacauagaaaggggagcaaaauaaucaccggaaguagagggagggagggaccuuugagggagagaagagggagaguguaaaaagggaagcaggaucagguauggggagggacagaagagaaguacagaaggccaggaaauugaauagaaauauccauuggacugagcuggggaaccccaguggaagagguaggggaagggcugaaggagcugaaagguaaguggaccucugaauucaagaccagacuugucuauacagcauguuccagaccagccacagcuagacagugagaacuuguuccaaaaagcaagcgacuuuggaggccacaagggggcaccgguucccuugaacuggaguaacaggcagugguccgcagccuaacuugaauuacugugaauuuaacucugguccuuugcaagagccuuaagcacuggucaaucuuucuugucccuacuucuaaugaacaggacaaacuuagagaaaacaagacagcuagaagccaguccuuccuuucagagcauggugcugucuguacacaugaaauuuucagcacuauggaaucugaggcaggagugccacaaguuuaaacucagcuuucuauauauagcaaaaggcuggugacacaggccuuuaaucccagcacuugggaggcagaggcagguggauuucugaguucaaggccagccuggucuacaaagugaguuccaggagagccaggacuauacagagaaacccugucuuguugaaacucucucucucucucucucucucucucucucucucucucucucucucucucacacacacacacacacacacacacacacacacacaaggcugucucaaaacccaaaaagggggcaggucaaaaucucacacauguuuuuugccccaaggcuuagaagaaaagagauuggguauauuuuuaaaaagaaaauccucuccagacuaaagaaauagggaaaaaaaaaaaagaagaaggugguuuaucugagaaagcaagcgugaggaauucaguuuagggagaagguacagagaaucucuccagacaggagagccacggugcuagaugccuagugcugaaucugaucuggaagaucaggagagccagguaggaggauuugcugguugucaugccaacugcuuaaaaaaaaauaaaauuagauuuaaaacccucucuccuuugcuuagcaaggauuggcgcaugacauaaucccugucagagacaggacuguaagauuagggaacuagagagauuuuccucuucacugggcccgccccuuccucccccacacccccuccugagacaaaguccuuaggcaggcgguuaucucccugcaaagcagugacccuucccugaagcaaacauucuggagaaccaagugagucauucuucucuagugaaaaagcauuagcaguuaaagauaagaggcugaggcugaggaaaacaagacagauccugcaaaguagucucauggucugcauuccuauuaaugaucaccacacauagggcacaacaucuuaaaaguaccuuucucuuuuguuuuauaguuuuuaaauuugcuuuuaauuaccuuaaggaauuaaaaaaauacauuuugcuuuaguuggcccccuuccucucccuccaucucccugggggacuccuccauuaaacccuuccaucucugcuguuccauuuuccucuuucacaccccaucccaauguaugcucucucuucucucucucucucucucucucucucucucucucucucucucucucucucucucucucucucucucucucucucccccccccccgugucugucugucugucugucugucugucugucugucugucugucugucuuuuauaaaucaggcuggucucgaacucaauccacagacauccuccugccucugcugucccccucccaccaugcuaggacuaaaggcaugcacugcuacacacagcuuuuuacuauuauuauuauuauauaaaauucgaggaugaauggauagauuaguagugguuuaucuguuuucagaaucucugugauccaagcuggguaggaacucaccucuuauccuggguccacuucaaauuugcagcaauccuccugacucagccuuuccaauucagggacuaucagcaaugugcuauccaaucugucugggccugagaucacacccaaggucuguguuuuaccg

SEQ ID NO: 4417 - RNA, 50521 nt, Mus musculus
cgguaaaacacagaccuugggugugaucucaggcccagacagauuggauagcacauugcugauagucccugaauuggaaaggcugagucaggaggauugcugcaaauuugaaguggacccaggauaagaggugaguuccuacccagcuuggaucacagagauucugaaaacagauaaaccacuacuaaucuauccauucauccucgaauuuuauauaauaauaauaauaguaaaaagcuguguguagcagugcaugccuuuaguccuagcauggugggagggggacagcagaggcaggaggaugucuguggauugaguucgagaccagccugauuuauaaaagacagacagacagacagacagacagacagacagacagacagacagacacgggggggggggagagagagagagagagagagagagagagagagagagagagagagagagagagagagagagagagagagagagaagagagagcauacauugggauggggugugaaagaggaaaauggaacagcagagauggaaggguuuaauggaggagucccccagggagauggagggagaggaagggggccaacuaaagcaaaauguauuuuuuuaauuccuuaagguaauuaaaagcaaauuuaaaaacuauaaaacaaaagagaaagguacuuuuaagauguugugcccuauguguggugaucauuaauaggaaugcagaccaugagacuacuuugcaggaucugucuuguuuuccucagccucagccucuuaucuuuaacugcuaaugcuuuuucacuagagaagaaugacucacuugguucuccagaauguuugcuucagggaagggucacugcuuugcagggagauaaccgccugccuaaggacuuugucucaggagggggugugggggaggaaggggcgggcccagugaagaggaaaaucucucuaguucccuaaucuuacaguccugucucugacagggauuaugucaugcgccaauccuugcuaagcaaaggagagaggguuuuaaaucuaauuuuauuuuuuuuuaagcaguuggcaugacaaccagcaaauccuccuaccuggcucuccugaucuuccagaucagauucagcacuaggcaucuagcaccguggcucuccugucuggagagauucucuguaccuucucccuaaacugaauuccucacgcuugcuuucucagauaaaccaccuucuucuuuuuuuuuuuucccuauuucuuuagucuggagaggauuuucuuuuuaaaaauauacccaaucucuuuucuucuaagccuuggggcaaaaaacaugugugagauuuugaccugcccccuuuuuggguuuugagacagccuugugugugugugugugugugugugugugugugugugagagagagagagagagagagagagagagagagagagagagagagagagaguuucaacaagacaggguuucucuguauaguccuggcucuccuggaacucacuuuguagaccaggcuggccuugaacucagaaauccaccugccucugccucccaagugcugggauuaaaggccugugucaccagccuuuugcuauauauagaaagcugaguuuaaacuuguggcacuccugccucagauuccauagugcugaaaauuucauguguacagacagcaccaugcucugaaaggaaggacuggcuucuagcugucuuguuuucucuaaguuuguccuguucauuagaaguagggacaagaaagauugaccagugcuuaaggcucuugcaaaggaccagaguuaaauucacaguaauucaaguuaggcugcggaccacugccuguuacuccaguucaagggaaccggugcccccuuguggccuccaaagucgcuugcuuuuuggaacaaguucucacugucuagcuguggcuggucuggaacaugcuguauagacaagucuggucuugaauucagagguccacuuaccuuucagcuccuucagcccuuccccuaccucuuccacugggguuccccagcucaguccaauggauauuucuauucaauuuccuggccuucuguacuucucuucugucccuccccauaccugauccugcuucccuuuuuacacucucccucuucucucccucaaaggucccucccucccucuacuuccggugauuauuuugcuccccuuucuauguaggauugaagcauccacacuuuggucuuucuucuugagcuucagguggucugugaauuguauuguggguauucugagcuuugggguuacuauccacuugucagugaguacauaccauguguguucuuuugugacugaguuaccucacucaggaugauauuuucuaguuccauccauuugccugugaaugucaugaaaucauuguuuuuuaauagcugaguaguacuccacuguguaaauguaccacauuuucuguauccguuuuugagagacaucuggguucuuuccagcuccuggcuacuauaaauaaggcugcuauaaacauagcguagcauguguccuuguuauauguugggccaucuuuuggguauaugcccaggagugguauagcugggucuuuaaguagaacuauuucuaauuuucugaggaaccacauaauugauuuccagagugguuguaccagcuugcggucccaccaucaauggaggagugcuccucuuucuccacauucucaccagcaucugcugucaccugcauuuuugaucuuagccauucugaauaucugugucuucugaugaucuuagaugaccccugugaaagggucauuuaauccccuaccuccaaccccuaacagguugagaacugcugcucuagaguaacaaaacuuauagaaugaaucccucucuaagugaaaaggggauuuauuugccugacuuucaggguuugguccacguacuccaacaauggcugccuaugaauggaaggucuaagaauccgguaguuguucaguccuggaggcugaacauuccaccuggucuugaguguaugcuggaauucuaaagaaguaggcacuaaugccaguaaaggaauggacuuguuagcaaggucagagcagacaaagggcaaaagcugccuuccuccaggcccuuauguaggcuuccagcagaagguauggaucaguuaauuugagauguagucaaguugacaaccaagaacagccaugacaguugccuuugaagucagugggugcucauuuauacuugccacauuuauuuugcuuauacuuuguuuguuugcuuauuuguuuugaggcagguuuccuguggucuugaauuugaaggaggucucauauaucccaggcuggccuugaguuugcaaugcugcugaggcuggucuggaacuccugauccuucugauuggaucuuccaagugcugcaguuaaugccuagggccagcugguuacugcagcaggccucaggaccccgaagcacacacguggaaagacaacugaccgcauugucagaagggauugucaaaacuccuggauuuggagaaaacaaaguuucccgaaacugcuuaacuaacugguauuauaucagcaacagucaguuugaguagaugguuuuucuugaaaaaaaaaauaagguuuuucucauuuuguugaacaaaaucugggugcuagucucagagaauugaauguagcuggggugauuuaugaaggucaggguuacugaaaauggaaaauucaguauuguucuuuaaacuguccucauugcaugaaaaaaaauaagcaaagguggucaggagacaaacgacaacaaaaucagaguuagguacugucuucucuccaaucacaacaagguaaaucuaacaugauauuagccugcguauuauucugaaguagcgugaacaaaggcuuuucuuuaacauccuuaauuccuugucugaauuucacacugcucagcuuaggggggagggggcucucucugcccaagugaccaugaaacucucacucgagugagaaaggauuuuuuuuuuuguauucuuguuaaaaugguaaggugaguguuagaaagggggacacggcaauaaugauuuuaucagugcuaguuagcugucgggacugugauaaaagucaaaguuugccaggauaaaaagagcaucaagaucgaaaauacuaugaugauaagaaugauggauaguaagacuuacccagcuauuuguuggguuuaguuggguaugaauuagaugggagcuacugauucuuuguuaguaauaggacauucaugaucaugaaagaugacagagaucggguguggcgggacacaccuaaaaucucagcauaggagacucggaguuuaaggccaauuuaggccuuauuaaggcuacagagugaaagccugucucgaaacaaaacgaaacuccacccuaaucugcugcccuaaacuagccugacaagugccugcuuucuaagacucggcuuuguacaaggauaucagccucaacuuagauuuuucagauucuaaaacuuaaaaauaauucugucccuuuuauacucucaagaaaagauuuuguuugucuggguggguggauuuguuuuguguuuugacaggaucuauguaccauuugcugaccuugaacuugcuauguagaccaagcugaccucaaacucauagagaucugccugccucugccucucccgagugaugggauuaaaggugugcaccaccaccacacugagauaaggugcagagguuuuguuuuuccauuuauugaaaauagauccccccucacauaaaauaucaaugaagggcccagcuuaacauuacaaacuccauuuugcuuucagauuccauuuuuugauuaacuugcccuuugaaugaauucagcuaccgaaaaaaaaaaaaacccaacuuguuccaggaaccauuugguaacaaucacaauuucccagagcauauagcuacuauacccauagcaacaaccaaucaguucuuaaggggaaaauaccuaaugacuuaaaguagauuaauuaagcuagcagccauuguucauuccaagcugaaaucauuacuagccaguagaagcacaccaaacaaaugucaaucaaucauguaacuaccaagaugggaagucucugaccuggccgugaaccaugauaauaggcaaggcuucuaccagccagcaccuuccacaccauccacaaugcuagagagguuggaggguccgagcuugagcuugaauaaagacucucacuuuugcauaccaguuggacuccugguggucuguaggaccuugggaucugggcauaacauccugauuauggcuugaccucccucuauuccuuccaguuccuccucuccuuccuucccauucagauccauuuucucuccauuucucauuaauaaacaagcaggcuucuaagggauaauaauaaaauaagcuaaaacaacaacagcaaaaauaaugcaugguggggggaggaggaggacaagagcccaagagagggccagagagucagaaauccacuuguuuguaaacucaagaaucccacaaaaaacgcuaagcuggaaaccauaauguauaugcagaggaggaaguacgaagcugugcagggccugugcaugcugccucugcgaguucauaugggacaaggucucccauucuugacaucacuucuggcugugggucucuguguuuuccucugcugcagaggggcacuuuacugauggugacuggacaaggcacugaucuaugaauaaagcagaauacuagcagaauaaucuuaggaaucagcuuauugcuguucuuguugguaguggcuuuuccuuccuuccuuccuuccuucuuuccuuccuuccuuccuuccuuccuuccuuccuuccuuccuuccuuccucccucccucccucucccucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuccuuucuuuccagaacaacaguauuugguuuuacuugaggucauugggcuaucuagucuuaaccucuuggucacccaagcaguacugaaugugggucccaucucauggaguggguuuuaagucaaaucagguguugguugguguacuggcugguuuuguguggcaacuugacacaagcgggacuuaucacauuuucccuugaggaaaugccuccaugagauccaacuguaaggaauuuuuucaauuagugaucaaggggggagggcacuaccugggcuggcugguaguccuggguucuauaagaaagcaagcugaguaagccaggggaagcaauccacuaagcagcaccccuccauggccucuacaucagcuccuaccccuaaguuccugcccuguuugaguucuagacccgacuuccuuuggugaggaacagugauguggaaguguaaguuggauaaacacuuuccucccuaacuugcuucuugaucaugauguuuugugcaggaauacaaagccugccuaggacaguuggcuacuccuacaaguuuugugccaccauugcacuagcauuucuugcaggcaggacaccauuuuagcucaacuaauauccacauauacgccaauauacaucauauuucuuuuuuucuggucuaagauaauauuacugaaguugauuuuuuuuucguguucuacccauuuaccuguaaauuucaugauuuuaguuuuucuuaagggcugaguaauacucuauucuguagauguuccacauuuucuuuuccccuucuuccguucaggaacaucuagguuguuuccaguuucugguuguuuugaauagagcagcaacaaacaugguugaggaaaugucucuucuacauguagcugucugguuuaccagcaccauuuguugaagauccuuucuuauuucaguguguauuucugaaugcuuuaucaaaaaccaaguguccauaagugugugagcuuaugucugggauuucaauucaauugcauggaccagcaucccuguuguuguaccaauaccaugcugcuuuuguuacuauagcuuugcaguauagcuugaaauuagagauggugauaccuccagcaguucuuuuauuuuucaggauuauuuuagauauccaugugugugugugugugugugugugugugugugugugugugugugugugugugccuuuccuuaugaagcugaaaauuguccuuucaagaucugugaagaaauauguugggauugcauugaauuugaagauugcuuuugguaggauggcuacuuuuacuauauaaaucucagcaauccacgagcacaacagaucauuuuaucuuuuauaucuucuuugauuucuuucuuccaugucuuaaaguuuuaaucuuacaagucuuucacuugcuugguuagacuuacuucaagacauuauauuauuugagucuguugucaaaaaguguuguuucccugauuucuuucucagucaauuugucauuuguguauaggagggcuacugauuuuugugaguuaauuuuguaucugcugauauugcucaaaguuuuuaucaauuguagaauuuucacaggggaauuuuuuuugggguggggucaguuauauauacuaucauaucaucugcaaauaaagauacuuugacuucuucuuuuccaauucuucuuuuccaauucuuuuccaaacugaucucauucaguuuucuuauugcucuagcuaagaagucaagaaauauaaugaaaagguauggauagaauggauaaccuugucauguuccugauuuuagugaauugcuuugagcuucucuccauuuaaauugauguugauuggcuaugggcuugcuauaaauuggcuuuauuauguuuagguauuucucuguauccuugaucucuccaagacauuuaucacgaagggguauuggauuuuaucaaaggcuuuuucagcaacgaaugaaaugaucauauaguuuuuuuuuccuuucaguuuguuuauaugguggauuauauuuaucaauuugucuaugcugaaccaucccuacauguuugggaugaaguuuacuugauaaugguggaugaucguuuuggugaauucuuggauucaguuugcaaguuuuuuuuugggagaaauuuuguguauauguucacaagggaaauuugucuguaauucuuguacuuuuuugugucuuuuugugauuuggacaucagggcaacuguggccuuacauaaugaauugggcaaagugccuuauguuucuauuuuguggaauacuugaaggagcacugacauuaacuuuuuuuaaaaucugguugaauuccauguuaaaacgaucuuguucugggcuauuuuugguugggagauuuuuaaugacugcaucuauuucauuaaggguuauaggucucuuuaaguugcuuaucuaaagcuggguggugguggcacaguucucuauucucagaacuugugagguagaggcagggagaucuuuuagaucuaggccagccaugucuacagagugagcuccaggauggcuauggcugcauaggcagaaaaacccugucuugaaaaacaaacagacagacagacagacaaacugcuuaccugaucuugauuuagcuuuaacaagaguuauauauugagaaaaguauuuuuuuuaaagauuuuucaauuuaguggaguauagauuuugaaaggauguccuuaggauucucuggguuucccugguacuuguuauguucugccucucauuucuaauuuuguuaguuuggacaucucucuagacuuuagucuauuuggguaagguuugccaaucuuuuuuuuuucgagacaggguuucucugugcagcccuggcugccuggaacuuacuuuguagaccagguuggccucgaacucagaaaucagccugccucugccuccugagugcugggauuaaaggcgugcgccaccacgccuggcaagguuugcuaaucuuacuuauuuucucaaagaaccaacucuuucuuucauuggcucuuugcuuuauuuucuguuuguuucuauuuuauugauuuuagccuugaguuucaauacuuauuuuguuuuuuuaguauuuauuccuuuugggugugauuuauuccuuuuguucuaaaguugucaggaguauuguuauuaguaugagaucuugucauguuuuuaacuguagguaccaauuagugcuaugaucuugcaucuuagaucagccuucauugcguccuacaaguuugcaguaguuggguauucauuucuuuucaauuccagaaagucuuuuauuucauuccuucucuuucauucucucuuaacuucauuaaguagagaguuguucuguuuccaugaauuuguaagauuucuguuuauuucuauuguuauugauagccaguuuuaauugugguggucagauaguguguagugacuuucuuuuaugguccaauguauuugguguucuguacgcuucuuguaccuugauaaauauuuucuucuuuaggucaaggauauuuucugcucugguuuuguugaaaauguuuucugugccuuugaccuguguuuuuuucucuucccucuauuucuauuagucuuagguuugaucuuuucauagugucccagauuucccagguauuccagggcaggagaaguuuuagauuuaacaguuuccuugaccuauguauccauuucuucgaaugugucuucaauuccugagauucucccuucaaccucuuauauuguguuggugaggcuugccucuaaaguuccugcuugagagccuaaaauuuucauuuccagauuuccccuggucuggguuuucauuauugauucuauuuccaauuucuggucuugaaauuauuuuauugauuuccuuccacuguuuguguuuucacagauuucucuaagggauuuauucauuuccucucuaaggaccucagucauauucaaaaaggcuauuuuaagggugcguguguguauguguuucagcuaugguguaauacucagggccuacugugguaggaucguuggauucuuguggagccauauugaucugguuguuauugauuguguuuuuacacuggcaucucagcaucugaguuuggagagauucuaggugcugauaucuggauuuaucuuucuuggguuuugcgccuugguuucuguuucuaucugugguucuuaggagagugugguggcuguguguugucugguccaaaacucuucugggauccugaaagggggagccauugaguauucuggguacauuauauaucuagguauugagagcuuaguaauggcuaggagugaggguggccugaggggguccacaggagggagggaagccgaguguuccugcaggauuugcuuuguuuccugggaauggaggcaaaaaguaagaagaggccauugcauggcgucugcuacagagcuggggcugagacugggggaauggacagagcaagagaugcagguguucaguuagcuuaguggcuucccuugcuggaguaaccuuucgccucccaagaaauaccugcuguggcuuuacguuggaauaaagcaaggaguggggggugggggagaauuuaggaggggaaauucugugugagagauuuuagauagagugagggagaaaguggccgacaacaacuguuggauacagagcuugggaugggacuuggggaucgggcuugaagaaaagcaacgauagaugaaguucugcuuagccaaccugcuuuccuggcuggaguagcuuguggguucccaggcaauaagaugcagugucuucaugucaaacuuggcaagugagcuagugagcugucucugauacgguuguauagcaacauaguuccugaauaguaaguagcauaccucguuguagcaaguguuguuugccaaaugcuugagcaaauucugagucucagccagagaaaacuauucugacuacuugaaggcaccuuacagauuccuguuucuaacccaugcuucucucccacaacugccccccucccaauaauacaguccagagguuaauuucuaaguucccauagggacagaaucaucguaugugucauugugggguuaaggauguggcucaguuaguacagugcaugccuaucauuaaagaaucuccgcaccagaacaaaauaaucugucaguauggguuuuucucauguccauauauccuuaguuucgaggcugccucuaaacaggcuguguagacaagaauaaacuuaaauucuugauucuucuguucccaccucccaaguuggaggaugaaagguauucauccacucacuucuucccugucccacuuggcucuguuaccucuacacuccaaaucaauugacacagugagauaagacugguuccccacacagggaucuauccaucgugaagaaaaagauugcuuagcuuuaccaagaaagcgcuuguccuuucuaaucauccuuagacuguaaaccaccccagggaaguuaacaauccuggaauagugucuacuauuagacagaguuagucucaguuuagucagucuuuuuuuuuuuuuucugauuuauuuauuuauuuauuuauuuauuuauuuauuuauuuauuuauuuauuuauuuauuuauuuauuuauugugacaggguuuccuuguguagcccuagcuguuagucuuaguuuaguaagucuuuuuuuuucuguuuguuuguuuguuuguuugauugauugauugauugauugauuuauugugacagggcuucuuuauguagcccuagcuguucuggacucacugucuaaaccacacuggccuugcucucaaagauuugccugccuuugccucauaagugcugggacuacaccacaugcagcaaguuuagagaauucuuaacagaaaauaguuccucuucuccauuccuccuuuuggauaccauuagcacauauguccuuucguugucuugugcgcuucagccucuugagugcagggaugagcggugugaaccaccaugccaggaugguauauaauuucugaggagggaugagucaguacaaacaaccaccaucugcuaucaagagaauggcaucuuucagaggcuagagagaaggcuugggggcuaagagcacagacuguucuugcagaggcaucaaacugaguuugcagaaccuauauuaggcagcuauaaacgcuuguaguugcagugcuuggagcauccagugacuagccucugugggcauuugcaaacaugaacccauacccccccccccacacacacacacacauacacaauuaaaaauaaccuuuaaaaaaguauaaaaugagauggcagcagcuggucaguuguauaaccgaggggauugagcacagauuucagaugagaauauguccuggccacuaucuuauuuugaccucuugagacaugaacagaggaucaagucaccccaggcuggacagcagauccauagagcugugagcucaugaauaggugccgugugcuaggaugcuaaacuucuuguaaucuguuaccauucaacagaaaaugaguacaggcacuuauuucagugaacugcuucuugcugccugagggaagaaaagaaaugggguuagagacggauucucuaagcagcacucucauuuuauaguggaugaaacagaaaacagaucuggagaacagaucaagaauuguguucucagucacaaaacuauuuuauuagucucgagagguagucucaagcaagccuaggauagcuguggaugagaacucaacccaaaauaaaaguauccucaggugguauuugauuuucuuuuccauaauggaggaauaaaauuuaccuucuuucuugaagggggcaaccuuuccugaguuaaaaggcuguuagagacucaagguauuuauuuugcaaauauucauuuuguuuauugcuaucccuguucauacaagacagugaugugaacuucuucacauguuuaguuaaaugaacacaaauugcuuaugguuucaguuuuuuuuuuucugcucucaggcuagaucuuccacaaguaugucccacagaggucucuccuguagagucugacagacuccugcauuccgacucugcauuuuguuaucuuaacauucauucuugaaaagauuccuauuugaugacuaguggauaacugucauuucauuuuauuggugaagcgucccuugagagacagaaucaggagcauguaguauguugguagaggaaagaggauuuaaugaagaauuggcacaugcgaucauggaagcuacauucuaagaauggcugcaucccaguuggagauccugggaugcuggggugugccucugugcaaaagggaagaccucagaaagagggaaaucagugacauaauucuacacuaaaggccaacucucugagaaccgaauaguacuauuuaaggaaucccuggccaaugagucugugguucuggcaucuaaaaauccuggggaaaucgcuauacugauucucagagaagauuccaauuugccuuuguucucucugucacugcucucugauugucaggugccugccuacaguaaagauggauuuuauuuaccuucuaagaaaaauagucaucucauucagacacaguccaacagacauguuagaaaugaaauucuaccauguuuuagggcauuuauaaaucuuuagucaucaauuucagcacagacacaaacauacaacaaauauucacacacacacacacacacacacacacacacacacacacacacacacacacauuuuggugauugaaccuagggccgcauagauauuaaauguggugguuuugaauaugcuuggcccaguaaauggcacuguaagaagaagguauugucuuguugggggaagugugucacugugagggugggcuucaagacccucauccuaauugucugaagacaggcuuuucuugacuagauguagaucuauugacuccuucuccaaaacugugucugucuggagucugccauauuucuugccaugaugauaacagacugaaccucugaaccuguaagccagccccaagugaaugcugucucuaauaagaguugccuuggucauggugucucuucacagucauggaaacccuaugacacuaaauaacuacuuuuucagccuuauaguaaaugucuucauuuaaaccucucuaagcaaguacauuuuucuuuuccucacugagauaaggucuagcacuggaacccaaacuagguucccacaccagaauccuccagccucagcuuccugaguaucuggaaccaaaagguauuuacuaucauguguagugcuuucauuugacugguaauaaaaacuggcuuggacuuguaacaaucugcuucugccuucugcaugccuggaccauaggcauacaccaucgugcccacugcuaucauaacauugcugcuauuauuuauuauuauuauuuguuuuugaaacaaaauuuuauauagccuacuuguuuugcagccugcuuaaagguucauaaugaaccuaaucuucuagguuguugacuggaacccuagaagaggcccaaguauggcauacuggauuccucuucucuuguuaaagauuuauuuugauuuuuguauauguacacauguuugugugccuguuauauguuuuuuggugccaaaucccuuggagcuggaauuacaguggguugguaacuaucccuuggugggugggauauuaguucuggucaacugagccaucucuucagccccaucauuuucuuuauaagguuuauuuuuauuuguauuauuauuauuuuaaacaugauuuauuuuuauuuuaugggcuuugguguuuugccugcaugcauguaagugucaggguguuagauccccugaaacuggaguuguacacaguuaugagcagccaugugggugcuggaaauugaaccugggucuucuggaagggcagcugcugagcuauuucuccagccccgauuuauuauuauuauuuuuauuuuuaauuguguguucaagcagaccagaagggucaagauuucucaguagcugcaguuacaugugguaguacuccaccugauguagguguuaggaaauaaacaguaucuucuuuuagagcuguauauacucgaaacugcugagccaaacucucuugcuccuaggaaccucugaauuuuuaauuauacauuagugacccuaugaccuuuguuacuucuacuaaugaagauugaaacaucccuccuucucaacaauacaggucacacaugcaggauuauggacgugcaugcacacgccguuagguaaguuuugcauauuauuuugcuauuaauauacuugaguaacuuuuucauuuacaccuagaguuugauccugauaaaaugauauuuuccccaccacauagacauuuuuacucaaugcaacgugcuuucccauaaaacaaacaagacuccucacacucugccaaaucacguacuaaaaauaaguguuuuguuguguuagagcagaaaauucaauaacuauucaacucaaccuagaugcuuaaaaauguuaauacacacacacacacacacacacacacacacacacacacacacaccagagccaaagacagaaguuucagcaaccaccaaauauguaguaaguaaugaggcaaugcuuuccagaaacgaccuuuacuugacaggcaguuuggggaaaugaggagauccugggguuaguguggcaaaggcagaaugugacuuucagaagaaaagcaaagcaaaccucucgccuaccuucucauccuaacauuugucaggcugauguaggaaguucacuaaauuugagguuaguugggcuacaaaauuaugaguucaaagcaaauauaggcuacauagggaagccuugugcuguucucaacaacccaaacccuucccuagacagaaugggugggguugcugguuacugugggaacagguccccucgucacugcgucaaguacucgguuuaccugauuuuaccaacauggaaacaaaucccaguguucugguggaaugucccauuuaaacccacaggacguucuaauuaaaugccccucgacuuugcaugucgccugucaguugguuucacuuuccaguguaugugugugugugugugugugugugugugugugugugugugugagggggcaguucucucacgcauguucagugguucauugaacuuugacuuucgccugcugccuacgaucacaagagcagggacuguccaguuggucgggugggugcuugccuuagauguagcucacuuggugggggguuugauuugcauacagaaagcuguggguuugaucgcuagcacuacaaaaaugaauuaaaaaaaaagcuaugcaugagcacaucucaagggggaauagccuggggugucagcugguuuaaguaaugcugcuccaccuguuugaagaacuugcuaggaggucucccucuccgcuuugguugucccagcccugugggacucuggcauuuuuucagagucccccgauggccuccuauggccccauccaggcaaguggguggaagagaguagcacuggagaacaaggaugggcagcaccggguguauucauugguuccgaggaggcaggcagcuggagggagggagcagguugguccucugaaacugugggggacgugaugguguaggagcagugagcaucacgggguaucugggcugagaagauaaaaccagggaccuugaggaccagggcaggguugugucucaucaggcucgggcuccuccaaggacugagguagagcagagucuaguuuuccugggcugcugucaggcgugaggacugagcugaucaacaggaaguuguggcucugagucuggcucagccaagacaggaaggcggacuggcugaagucgugcuggcucugacccagagagaacagggaaccuuccggcucuaggaacccgcgacuugacuaaagacggggcuggguaggggucugagguugagauuggggcugagguccggggugagcuugagucugggcuuguucugaaucauguucccuaauggugaacugaaggagcugaggcugcggagacccaggcuuagguuuucgagguggucuucuggacccggcaggagaaguagagggguuggaguuaguuaauucucucuuuacagagacucggguagagcuggguauuggaagugacugcuuccaucaaggacucaguuucuugcuuuguuccauugucaguaacugugcacuccucugacccuucagcaaagauaccagggaaacacaguaauacccaguaauggugucuauagcgguuuuuaaccaaugacacugccuggagcaucugggaugagugaagcaguuuuuuucuaaagaagagcugaugcagccgggcggugguggcacaugccaagaagaagaagaagaagaagaagaagaagaaaagaagaagaagaagaagaggaagaggaagaggaagaggaagaggaagaagaagaagaagaagaagaagaagaagaagaagaagaagaagaagaagaagaagaagaagaagaagaagaagaagaagaagagcugaugcuuacugaguuuuucuaucuggcacucccgcucuggaaugauagauguugcaacaucaaccucuccaucucuuugaccccuguggccauugacagcuguuguauuuaccuccucuuccuccucuucucugucacuaguuuccuccaugaucggagaacugcaccucugucccaggucgucuucugccccuuccaucauaaccucaggccaccugguuugcuuggccagaacaguuuuuggucccuggagucggccuucaacaauccauuuguuuuuccuguagcuagacauacucuacagagucgugucaaucucauugaugauaauggcggaacuguugagcucaggcacaaggaaggcuggaagagcagccuucuguugagaugacugggccugaaaagguuggguccgcagacugucauagaaggauggcucugcucucuaugccacgaggaagcagcgcaguaucucagacacauugccucuggucaaugagcucucugacaccuuucccccccaagaucuuuagggacugacaggaggagggcagaccaggaucguggagugcagccuucaggagcuauaccagcaggucuugcacuuuguccaagcugucaccuugacauaaaagucccuccugcaggacucucagacuaggaacaucuuugguaaggucaaagccuagcacuuugccaaaacuaugcaggaacuccacaaauggucaaacaaucugagaaagcccugcuggacagcgucaaaccagcaaugggugugaagucaggcagaggcugguggucagucagccagacacauauccccagugggcuucuucaucuccuccaagauaacccacugccucugccgccccaccagccgccucuguguggcaaggucuugucugcucuacaggauggccuggcucugggcucuuccuuucccucuuuaccuuuuccuucagcuucuccugcuuugucuucaucuuugcuuucucagccuugaauuucuucuccucguccuucagcuuuaaguuuuucgugucuugcuuccucuugcuucuggccuguaaaccauaagggaagucauuucuuuucaaacucugcaagcaccucugcuugggcugcccuugggcaggagucgacucucuccccgcugugccuucugccucgucuuuuugcuuuuagucaucuuuguguuauucucuucacucaguguuucuugaguuuccaguuucuuuggaagucuauugucuguuuuauucagccacucgggcauuuugaucuuaggaggccaagcauggucccgcuucacuuugggaaccuccuuguucuuagccuucucauuguuucgaggucagcuucauuugcuaguaauugcuugaauucugaaagaaauccccucugcugauaacuggacccacugcaagcucucugguguaucucuuucuucaaaucuccagcaggcaugcagagacugaagcugaagugcucauggcagacacuguguaccacauuuuggcucagguauuugauaacuuuuggaaauugcuucauuuucuucccacaggggccacaauaccaagucucccccugccaccaauggcuguccuuuuuuuuuuuucuuucuugguuugcuuucuuucuuuuuuucuuuuaucgaauauuuucuuuauuuacauuucagauguuagccccuuucccuguuucuccuccagaaacuccguauccuauccccccuacuccuguuuccaugagggugcucccccacccacacacacacuucugccuccccacccuggcauuaaccuacacuggggcaucaagccuucccaggacaaagggccucuccucucauugaugcccgacaaggucauccucugcuacacaugcugcuggagucauggguuccucuauguguacucuuugguuggugguuuaguaccugggagcucugggaggggucugguuaauucacagaccacaugaagcucaaguagaaggaagaccaaaguguggaugcuucaguccuucuuagaggagggaacaaaaugcuuaugggagaaaauacggagacaaacuguggagcagagacugaaggaaaggccauccagagacugccccacuuggggauccaucucauauacaguuaccaaacccggacacuauuguggauggcaagaagggcuugcugacaggagcuugauauagcugucuccugagagacucugucagaggcugaaaaauaaagaggugcaugcuugcauucaaccauugaacuaugcauagugucccugauggaggaguuggagaaaggacugaaggagcugaagggguuugcaaccccauaggauggcugaacuucuucaugcacacuucucuuuaccauccauacuggaggggaagacaaacuucuuggguagcaauaugucucuucaguacaucaauacaaagacugcggcuacuucuccaguuaucuuuucucaaucagcacaagcuucaggggcacuacugacauuauuacuuguuggggagacugucuggaaggcagcugcuggagaagguugaggggaaccuugaggagaaaucacuggagcugucauggaggcucccaaagagauggcugggagagcaggugaggaagcuggagagacugcuggaaagacuucaggagggacaagagagcaugcuacuggagagacagcuggagagcuuucugcaggugcugccaaggagguugcugaagaggcuguugaugagacagcuggguuuaguugaguacuagguggcuggucaggggcugacucaguuaggggauguuggaaguuugaagacugggucucuacuucuuccuguucagagucauugccacuauucaggccaaagcuguuaucccuuacgacagacagauggggagguagggcugacaaagauggagguugauauuuagcugucaucugccaagagacuaaaggcauuagcauuacugagagaagaacaauggaggguuauccuccagagacagcuugucuccugcacgcaucagcucugugucaucuauaccauaaaguccuccacucacuggcucugcugccagagagucaaagggcuggagggaaucuucacuggcaauuggagaguuguccaggugaucaggaagaugugaaggaucaucuagauagcucacugugugaucagggaccaggauagagaccucuuagucucuacagaggagacagguacacaccuuuacuucuggaugcucuuccccagcuccagacugccuaccaagcccaugccauuuccugucagcuccuuuucuguugccuuaucaggauggaugucacugcuuacauccugggaaggugcaaaggucuggauacucgaccccaauauuggagaagucuguggggaggugaaaaaucuuggggguccauugggaaucaucucaaaauccuggucaggaaaagaaucacacacuuccugugauuugaaguuaaaucccaugggacucuggguaccacuggcccagaacucuuggcuugaagauuagugaugugacuuggggaugaagguuugucccccaaggauaccauugaguggguauugucccccagggaacugagaaagauggggugaguccuugaggauguugccaggguugguggauggguaccgugaguaguucugaagacagucguaggcuacgauagggugauggagguuaugaggggcaggaggaguugagagcagaguucacaauaggugaagugguagugugagauacaguagauaagccauuaacagucucaucccuacccagacuuugcccuugcccuugcugggggaaguucaugggagacuuuuuaguguguuaguauagaggcccuuuccccuagaaaggagaggauuucagucccgaggcaccuggugcaggaggagagccaguaaagcaaaaauggucuuuugccuccaguuugccaggaagaugcucgaaucucucuuggcugcaccugacuccaguacucaaggcuaacgagaggcugaggugagcccaucugacucuacuuagacuguauuuuaaacaaaaauagcagcaacuauaaaauauaaccuggacuuuuccauuuuacaugaugauuuucagggauaacuauuuguacugugguuuucaauugccuucuuucucagcaucuaucuaccuaccuaucuaucuuucuaucuaucuaucuguaguguguguauguguguguguguguguguguguguguguguguguguguguaugugccugccuuuacuugcugagccaucuuggugacuccccaguugccuccuugaugccaagccuuuauuuaaaguuuagauauuucuucugaucauucgacucauauguguauguacucacuagaaaucucuauucagguauccuacagguaucucaaagccauaugugaugucuaugaaugauaaaaauguacuauccucucuuuauaacuggacacauccacucaguuaagcaagaaucuugugauggacuccaagcgacuacccgcuuugcaaaucucuaguuaaucacgugcuagcacuucuagucuccuuuaaauuccauuaggaaaguucacuccucucuauucccacucccaucaccccaguuuagcuuuuagcugagagcugcaaccaacugucaagcucugugacaguuuuaauuauuuugaacccaaucgucacagucacuaaccucugaucauaccagucugugaauaugaacuuacucggaaaugaaauaaaaaugccuuuauauuugcaaagcccugcugauuuguuccccuggacaacuugcuuuguuuuaauggagugugaugguugggaugcucaagguuagaagcuugguucuuaguaugagagagagcuggaucuugaaugguuuuuccaugugugugcauguuguccuaaggggaacugaagccauuuucaagggaugucuucaucgguucuuacagaaagggcugugcuaacuggagucugacacugcacuauugucuagauuucugacugaccguaccgucucuggccaccccacaaagucauacagcagcuaucaguuagcugcucaucugauaccuuagcaaauacuuuagguaacuuagagauaaaacaagguucuuuagguuaaccuguuccagccuguuguugguuggccuugcuuugggaucuguggcaaggcagcacacaaugaagugagaacauggagagcaacagagccccucauuucgugguuggcaagcaggaauaagaagagaccaggaccucacaguccccucacacugcccaaaccuaagaugccaccucuacuaggcugcacuuuuaauuuuuuuguuuuaagauuuucauuuuaauuuaaucucuuucaucugcucuuaggaccccuuuccuccuacuagguugccucauccagcuuugaucugagagcaugugccuagucucauuguaucuugugucuuguucaguggagauccgugggaggccugcucuacucugaaggaaacucaaggacgaugggaucuugguuaaagggagguuggggagcagguacugggaagagaggacggaguggaaguugugagagggauggauugaaaacaacaaaacauaaauaagaacauuuuauuuauucauuuauuuauuuguucauuuguuuuuucgagauaggcuuucucuguauugcucugucuauccugaaacucacucuguagaccaggcuggccucgaacucagaaauuugucugccucugccucccaagugcugggauuaaaggcgugcaccaccacuaucuggcuuccuuccuuccuuccuuccuuccuuccuuccuuccuuccuuccuuccuuccuuccuuccuuccuuccugucugucugucugucugucugucugucugucugucugucuuucuuucuuucuuucuuucuuucuuucuuucuuucuuucuuucuuucuuucuuucuuucuuucuuccuuccuuccuuccuuccuuccuuccuuccuuccuuccuuccuuucuuucuuucuuucuuucuuucuuucuuucuuucauucuauguuuuuuuaaaauuuaauuuuauuguuauuagguauuuuccucguuuacauuuucuuuuuuuuuccauuuuuuauuagguauuuagcucauuuacauuuccaaugcuauaccaaaagucucccauauccacccacccccacuccccugcccacccacucccccuuuuuggcccugguguuccccuguacuggggcauauaaaguuugcaaguccaaugggccucucuuuccagugauggccgacuaggccaucuuuugauauaugugcagcuagagucaagagcuccgggguacugguuaguucauaauguuguuccaccuauaggguugcagaucccuuuagcuccuuggcuacuuucucuagcuccuccauugggagcccugugauccauccauuagcugacugugagcauccacuucuguguuugcuaggccccggcauagucucacaagagacagcuacaucuggguccuuucgauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaaaucuaaggaggggcauagaguccacacuucagucuucauucuucuugaguuucauguguuuagcaaauuauaucuuauaucuuggguauccuagguuuggggcuaauauccauuuaucagugaguacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccaguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucaauucgcauucuucuacacgauaacaaccaguugugccagcaccaauuguugaaaaugcugucuuucuuccacuggaugguuuuagcucccuugucgaagaucaagugaccauagguguguggguucauuucuggaucuucaauucuauuccauuggucuacuugucugucucuauaccaguaccaugcaguuuuuaucacaauugcucuguaguaaagcuuuaggucuggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuuccuuaauuucuuucuucagagauuugaaguuuuuaucauacagaucuuucacuuccuuaguuagagucacgccaagauauuuuauauuauuugugacuauugagaaggguguuguuucccuaauuucuuucucagccuguuuauucuuuauauagagaaaggccauugacuuguuugaguuuauuuuauauccagcuacuucaacgaagcuguuuaucagguuuaggaguucucugguagaauuuuuagggucacuuauauauacuauaauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuucucaugaauggguguuggaucuugucaaaugcuuuuucugcaucuaacgagaugaucaugugguuuuugucuuugaguuuguuuauauaauggauuacauugauggauuuucauauauuaaaccaucccugcaucccuggaauaaaaccuacuuggucaggauggaugauugcuuuaauauguucuuggauucgguuagcaagaauuuuauugaggauuuuugcaucgauauucauaagagguauuggucugaaguucucuauuuuuuuugggucuuucugugguuuagguaucagaguaauaguggcuucauaaaaugaguuggguagaguaccuucuacuucuauuuugugaaauaguuugugcagaacuggaauuagaucuucuuugaaggucugauagaacucugcacuaaacccgucugguccugggcuuuuuuuggcugggagacuauuaauaacugcuucuauuucuuuaggugauaugggacuguuuagaugguuaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuaccccucuugggugaauuugcuuccuuuuuuucuagagcuuuuagauguguugucaagcugcuaguaugugcugucucccguuuuuucuuggaggcacucagagcuaugaguuucccucuuagaaaugcuuucauugugucccauagguuugguuacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugacaggauacaugggacaauuucuauauuuuuguaucuauugaggccuguuuuuugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaacgaauguggcugcccuugcauuuggugcguagauauucagaauugagaguuccucuuggaggauuuuaccuuugaugaguaugaagugucccuccuugucuuuuuugauaacuuuggguuggaaaucgauuuuauucgauauuagauauuacuccagcuucuuucuucagaccauuuguuuggaaaacuguuuuccagucuuucacucugagguagugucugucuuuuuccgugagauggguuuccuauaagcagcagaauguuggguccucuuuguguagccagucuguaagucuaugucuuuuuauuggggaauugaguccauugauacuaagagauauuaaggaaaaguaauuguugcuuccuuuuauuuuuguuguuagaauuggcauucuguucuuguggcugucuucuuuuugguuuguugaaugauuacuuucuugguuguucuagggcgugauuuccguccuuguauugcuucuuuucuguuauuauccuuugaagggcuggauucuuggaaagauaaugugugaauuugguuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaggcuucuuguaugaucauggacaucucuuuuuuuauguuugggaaguuuucuucuauuauuuuguugaagauauuagcuggcccuuuaaguugaaaaucuucauucucaucaauuccuauuauccguagguuuggucuucucauuguguccugcauuaccuggauguuuugaguuaggauccuuuugcauuuuguauuuucuuugauuguugugccgauguucucuauggaaucuucugcaccugagauucucucuuccauuucuuguauucuguugcugaugcucgcaucuaugguuccagaucucuuuccuaggguuucuaucuccagcguugccucgcuuuggguuuucuuuauugugucuacuuccccuuuuauuucuaauaugguuuuguucauuuccaucaccuguuuggauguguuuuccuguuuuucuuuaaugauuucuaccuguuuggcuguguuuuccugcuuuucuguaagggccuguaacucuuuagcagugcucuccuguaauucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugauuucuguuaguaggauucuuacguuugccuuucgccaucugguaaucucugaagcuagcuguuuuaguugucacuguuaagagcuuguucuucaggugucucuguuagccucuauaagcagaccuggaggguagcacucuccuuaguuucagugggcagaguauucucugcaggcaagcucucuucuugcagggcagguacccagauaucugguguucgaaccagacuccuggcagaaguuguguuccacucacuagaggucuuaggaucucguguggaauccugugugggcccuugugaguguugggcaagacucugcuggcaagguagcccggggcucgaguggaguggaagggguuugugucccagaucaagcccggguagccugcuucccuauguaccgcagucucagguuccgugcgauuggauuggggcaggcgcuguguuccacucaccagaggucuuaggaucccguggggaguccagugugggcccuugcggguguugggcaagacucugcuggcaagguagcccggggcucgagccgagcggaagggccucauuuacauuuucaaugcuaucccaaaaguccgccauacccaccccuccaauccacuacccacccacucccccguuuuggcccugggguuccccuguacuggggcauauacaguuugcaaguccaaugggccucucuuugcagugauggccgacuaggccaucuuuugauacauaugcagcuagagucaauuggguauugguuaguucauaauguuguuccaccuauaggguugcaguucccuuuagcucguugaguaauuucucuagcuccuccauugggggccgugugacccauccucucgggccgggcggaccccugugcucucaccaggaaggugaucgguugucucauauucuauguuuuaaauuauguguaugcauguguuugucugugccuauauguacagagugugcaugacagagucaaguucucagaacagguugacagagucccagcagcuggaguuacacaugauuaugagcuauuuauguauguaaugggaaucaaacuuuucuccucuguuacagcagcaagugcucuuaauugcuuuccaaccucacuucuuaaaaaaaaaauaaugugugggcuggagaaauggcucagcuguuaagagcuuuuccagagguccugaguucaauucccagcaaccacaugguggcugacgaccaucuguaauggggucugauguccucuucuggugugucugaagacagcuacaguguacuaauagcauuaacuaaauaaaucuuuuuuuaaaaaaauguguauguaggugugagugcagcguguaugcacaugugagaaguacauaugugagcauaugcauguucaggccagaagagggcgcagacacccagugccugcuuuaccgcuuucaaccuuauuccuccgagacugggucggcuacggaagcuggagcucugaaacugggucugcuaccgaagcuggagcuugcuaggcugacccaaggacgaaccuagcaaaccccagggguuuuccuguuuccacauugcucccauagccuuagguugacuggaauccacugcuguguugacgauuugaguuuggguuuccguguuugcacgcaggcaagcucucuuauacacaguccuaucuccccagccucuaggguauauaucuugaagaauuuuuguuuguuugguuuguuuuuuugucagcucucuacaucacaaaguuggggaaugagcuucuuauacaggaaccuuuagggggucacugaagaagcgagcucuagcgcucagcaugccgcuaucugcuggcaagcuguggcccaaaggcugaaccaaggagcuccuccaaccuuggacuuugcaguuucuaaaaguagaaguuuaagaaauuacauuucuggaggcaggcgagauggcucagcgguuaagagcaccgacugcucuucugaagguccugaguucaaaucucagcaaccacaugguggcucacaaacauccguaaugagaucugauacccucuucuggugugucugaagacagcuacaguguacuuacauauaacaauaaauaaaucuuaaaaaaaaaaaaagaaauuacauuuccguuuugggcuggugagauggcucggcaguuaagaacauuggcuggguuuuugagguucuggguucaauucacagcaaccacuuggugacucauggccaucuauaaagggaucugaugcccucuucuggcacggaaguguacgugcagacagagcacuccuacauauaauuaacacuaacaauaauaaauaaaauuuuaaaagaauuuucuucuuuuuacuccucuucuuccucuuuacuuccccucuuccuggcacccacucuucccuccccaccucuugcuccuccuccucuuucuugccucuucuuccuaucuucuuccucucccuccuucucuuuuuccuuggcaguagggcaauugaauuuagggccuugagcaagcugaccuauacugccaauuuccucaucuucuuuuuaauuuuugagacaaauucuugcuaaauugcccagguagccuuugaaaguaugaucauccugacuccuaccuggaaucacaguccuauguugccuggcuaaucucucucugucuuucugucucugucucugucucugucucugucucugucucugucucucucucucugucuccucuuuccucucucuucucuccuucuacccacucaccucugccuaaagacucuuuucauaauaacaaaaucaaauaguccaaagugcaauccuaggaauuuauaauuuuaaaauaaaaacauugaucaaagugggcacagcagugcacaucuauaaucccagaauuugagagcugaggcaggaagaucaaggaguucaggccucgauauaauccaagaacaacgauuaacuuucuuuuguaauuuuguguacuuaccaacaguggcuuuguuacuuuccuuucuccaaacccuauuagguuggaaaaagugaugcuugagcagagucguuaaauauuucuuagaaucuaugcuugggggcuuggggagcuggugagauggcucagugguuaagagcacugacugaucuuccaaaggcccugaguucaaauccuagcaaccacauaguggcucaccaccacccguaaugagaucugacacccucuucugcugugucugaagacagcuacaacguacuuagauauaauaauaaauaaaucuuaaaauuaaagaaaccauacuggguuuuguuucuggguaggcccacuaugcgcauucugcuguaagcucucaauugugacuguccagccacuauacuaguuccuuuaauaggcuagccucuuccuauauagcaggaacuuauuacacuuucugacuuuuaguaccacuugggucuucccauuugagcaggaugguuuaauuacacuuccagccuugagaccuuuuuccuugggaaaaaccccaaguggaguuaguuauugcucauuuuucugagucuaccgugacauuauuggucuggagauaugggucaaccaguaaaagauaaagcuguuugcugcuaagucuguggacuugaauuugaucauggagacaaagaugaaggaaaaaacuacuuccaaaagucauccucucugcacauguaucauggcaugugugugugucuuugagcacacguguacauacacauacaguaaauaaauaacaaucuuuaaaaaggaguacauuuuguugcugaugggguuuuuuugguucuuuuucucuuagucugcuuguuuugauuuuuuuuuuugagagagagagagagagagagagcaugaaguuugguggguaaggagguagggaggacuugggaggugguggggaaagggaagaauaugaucaauguauuucaugaaaacaauauagauaaaagaauguauuaaugaauaaauaaaaggugauguucuauugugagagucuucugccauacauccucugccucaguuucccugagugcaaagauuagcacaugccuagccucaaccugacuuucaacaccagacauuuguccccucuugagacagaaugugucaucaucuucagaugcuuuccugagagagaaguuaaaccucuacccucugccucacuacucacuugcaguucaugcugggaacucuauaauacgggagaagcaagauggcuuuggcaggagggaguauaaaacaguguccuagagauuagccucccgauaucuaacaguccagccguuaugcauaaauuauuuuugaguugcagacuugauccuaagauuucuuacaguguuagaauuacccagagaguuaagucaauuuugaucccaaaaucugugccuuccaaacuuuauaguacaccagaaucaucaaagguccugggucuuguuuaaaacuggagugcucgguccagcuccagagggugugugugucuguguguguugcuuuuugagacaagguuucucuguguaauagaguucuggcuguccuggaacucuuuuauuuuuagacgagagacgaggcuggccuccaacucuuagugauccaccugccucugccuccaaagaacugggauuaaagguaaggacuggaguuuuugauucaguuagguugggucuuggucuaaguguuucuagcuuagaguucuagcaacuuccagguaauauugaacaccaccaucugaguccuccaugcuaauucaaugcaugcuaucucuuccuuucccuucucaggugucucauacaugggguuaauauagggauuaccacacuauaagaguuaauguuuaacccauggaaggaguuacagagacaaaguuuggagcugagacgaaaggauggaccauguagagacugccauauccagggauccaccccauaaucagcuuccaaacgcugacaccauugcauacacuagcaagauuuugcugaaaggacccagauauagcugucucuugugagacuaugccggggccuagcaaacacagaaguggaugcucacagucagcuaagggauggaucacagggcucccaauggaggagcuagagaaaguagccaaggagcuaaagggaucugcaacccuauagguggaacaacauuaugaacuaaccaguacccuggagcucuugacucuagcugcacauguaucaaaagauggccuagucggccaucacuggaaagagaggcccauuggacacgcaaacuauaugccccaguacaggggaacgccagggccaaaaaaaugggaaugaguggguagagaagugggggggaggguaugggggacuuuugggauagcauuggaaauguaauugaggaaaauauguaauaaaaauaaauaaauaaauaaaaagaguuaauguuuaagagagacugauaguguguuucgaaguuggugucagcauggacuugacaucucugucuuagccuagauuguaaucauaaaacaugcuuuacgucucaagaaauucuucccuuccuuguuuucccuucuuguucuuuuucaucuucuccagcuccuccuucucuuuugaguaagacaagguuuugugguuggcccgggcuagcugguguugcagaaaucacccuguguccaauuuccugcaugcugggcugaugugagugugccacagucgugggcaaucaagcuucuggguuguucuuccucaaacauggagcauucuuccuuaagcuuccuugaguuuccaggucguagucacauguccuacaugcuuguguuacagcuccuuaggggcacccauuucuuaguucuuguuaagucuauuuggguuugagauuaggacagaauuuucaaugauuucugaaauggcccuaccuaaacaaaugucucccaucucauauuauuucauaauugaugauuguaaaaucaacauauugaucagacugagcaugguaguacacauuuauaauaccagaacuugagaggugaaguaggaggaccaggaguucaaggccagcuuaagcuauguagcaagugugaagacauccugggucagauggauucuaacaacaaacaaacaaacaaagaagcaaaaaccucccaaaccaaaccaaagaaaacuaaauaaaaaaacagaauaaauaaauaaauaaauggguaaauaaauaaauucugaaaagcauugaaugaucuaaucccgcaauaccaacuauccagcuaagauuuaucccguguguaaagacaaaugagcacauccauuuuguuaacaugaaauuuugguuucaucuuccauaaaugguaaaauugcauuauugcgaagaauugcuuaaaaaaacaucuuguucugauuuaucaucaguaaauguuugauuugcguaccucuuuuaucuaccuagcuucccagggucagacugauuucuugggagaaacaauauagcaaaacaguagacgguuuugaaguccugaucuaaaacaaaacacauauaaaacaaaacaaaacaaaauaaauaagucaaaauggugacaaaacaaugcaaauuaaucugaaaucuguaacugggaggaacacacacaagcauccugucucauguggaacacacauuggguaaguuguuuguagagauucaacuuuauuuuuccagauggcuacacucacuuauccuaaaccauuaguugaauaaucuaucuuuuccacucugaugugaaaugacaguuauauuuuuaaaacuaggcuuucauacaagauauuuuccaaauaagcucaaccuaucccaaugacccuuaauaugcaagaccuuuauauuacuaucuuugaauuuuugaaguucuuuuaaaaguuuuuuuuuaacuuauucacuuuccaguccacucacugcccccucccagucuucccauacagcuccaacuuuagccacaucugggcgacaguuggacaguugucaccaugggauaucucuuagcauuaccucaucacagacucaucacagagguaagacuacagaguaagauacuugagguguuggcuuuaggagucaugauaggcagcauagugccuugugggauuguggugaauauuuuaggagggcugggucacucugggauuuagcucaccccagacugacccuacgcagcauauuuaaagaaauuauaaagacugcauuuccaagaaagaaagaguugugccgguggguguaaaacucaugccuuaaugauagcugucuacuuacuucugacaccaucagagagaauucauuuauuugagauaaucagaauuuuucauguuaaaggcaauaugugauguagugugcugaccaaagacugugaagaggagacccaguuuucccaucccaauuugaccucagaauggagguucagcucaacuuauuggaaccucaauuuucuuaaucauuuauagaagguaauuagguguaagaucuauuuccagccaagugaagacugucacugugcaguaaugugacucuucuguuuguucauuuaaaacauuuauuuuuaauguuuugagauggucugacuaugcuguaggcuggucuagcuuguacuuugcuccauagcccaggcugacuuguaacaagcaauccucaugguucagccuccugagcgcuagaauuaugggcacggcucacuaucccucauuugaaaacuuccuuaucacuugauaggugggaaaaauucuccugguuagaaaugaacaaggcacaauuauucuuuuaugaagcuuauaaaaaaagacaauuauuuauuuggaagagggaagagcaauggaacaauagugggaauugaaaguagaagaugcccauucccuaauuccauuucagaaugugggcucuaugaugcgcuccaacucaacugugagaccuguucugacuccuucuagguugggauaugaauugcauugaauaguggugacauuucauaaaccuuuuuuccuaugaugacauuuaauuuagaguuauuguauauuuauuuuugggggagacuuuugcuuaugacuaguuucuaacagcuauugugaagcuguguccaaauagcagucuggaaaucaccuaagccgggugcuuuuguggugucucacugaugccaccucucuugguguguuuaaauuugaaucccaauuuugaaaauggugugcaaaucacacuuauuuaacauauuugaauaaacaccuucacccuguaucucugccaccaggccaagaagugauggaucagugacuucagaaaggugaguuuugguuugucaaaguugaagauaagacaacaccuaauagcuaauaagaaaugggugggggauggggaagcagaucaauucuuaaaagucagggacaaaagguuaauaggguagcuuugguaauauagaucugcagaagguugccaagcaggauagcaccagggaauauacacaugguacggugcacugaauggcgcuuaagauauacucccuagcaaauaucauauaggagggcaugacaagaacgauucacggucacaugacauucugguuuuauggcacuuggcacuaauuguagagaucaccauacauaaaucacuguacuauacauuuacauuuuccaacaucaacagaaaaaugucugcccacucaguuucugccaaguaagaauuaaaagagggucaggagguuuauggcuaguuugaacauuucuagaaggugaaaacaagcagcaacauuauauuucuaccaagauaggauucuuucuauccaauccauggugcaaugaugucuucagguaaucuucaagugucacuuagcuacuuuucaugaugucagcugggugagcuucguggucuuucaggguggagggauaaauauaagugucaauucauugugcgucuaaggucaaggaauaguucaaugguauaguucuccauuaggaaaggucaaggaauaguucagugguauaguucuccauuaggaugaauacaaucaaacaaaugcacagaguacuugauuacuguguggaaagcuuaagcuuuggugaaacaaagaaaaggguuuaaugggaaaaggauguacguuguaguuuucuucuuucucaacuaguuuugucaagugcggucuacugaaggauguagaccauacuuucuauucacgaaucagagaccucuacaauuuuugugugguuuccacuaaguaauucauuuucugaaccccaagcccauguguuuaaacgguuucauggugccauuuacauacaggaacuagcuaauuaaaaaaaaacccaccaauccaauuauaucagauacuagcauuuagcauguggcaugcauagaaaaacauucaauaaaagguuggggcuggugaugagucagugcccaggaguuccacauuaagucacaauuggcuuugugcuggagagcuggagcguauguaucauuugguguaaucagguacagaggagaacaagagcuucuuguaauaacaacacagcaccugaucaucacccagcugugacugaagaggacuucuguaaucccagaccagaaguguagccuuguccugauguccaaccaugagaaaauguccacaacagauuugauggagaaccucagggaagagcugaccuguuucaucugcuuggauuauuucagcaguccagugaccaccgagugugggcacagcuuuugucugaugugccuccucaagaguugggaggagcacaacacaccuuuaucuuguccugaaugcuggaggacuuugggagccccacauuuucaagccaacgagcggcuggggagacuggcuaauauuggcagacagcugagaucgcaggugcugcagagcgaggaugagcagagcaucugugggagaaugccagggccuaguuggguguucucugacgaugagcagagugucauuaaugucucaccuccaagucaagggacgaacaaggcguguuucucaagugaggcugaggagcagcacaaaguaaguugggaugcacaguggcaaucucagaacccagaacugcuccuagccacuaacucucauccaggucucugucgguaacagccaugggcacguaucuucauguagcaugguucuugcuuucacucucucuuugagagccucagucauuuuccaauggcuaguuuuccugaucuuucuaccacuggauacccugcuuauuugccaagggguuuguuucuauugcaggaaaaacuccaagauaucauaaauauuuuacggaaaaagaagaaggaaguucaggccauccugaaccaugagaaggaacgagugauguuguguaaggucagugucugucuaguguuucaucuugugugugagauaccuggugacaugucagggggaaaggacuuuuuuuuuuuaauuacauauauauauauauauaugagugcauuguuacugccuuuagacccaccagaagagggcaucagaucccauuacagaugguugugagcugccaugugguugcugggaauugaacucaggaccucuggaagagcagucagugcucuuaaccacugagccaucucuucuggaaaggaccauuuuugagucauagucauaggcaguacccugcuguuuggcugacugccacugugugcucaccggggaguaucacaguucagcucggguuaacucaccccaguuuuaacuuguuuaucuuucuuggcuagucuuuuaugauggaucuaauuaauguuauuuaaaacacaagcaauguauuuucgagauaggauggaaacuaguuuuaaaaaugagucucucagaugcucaggguagaaauuguaugccaaugacaaggaaguaaagaacacaggacaauggcacauaguagauuggauuauacugcaacaaaugcccgagcuucaucacagauuuggacuugaauugccuagcaguuaaagcaaagaacgaaacguuucccauggcacaggcaguauagguauuagggcuggggaauuugcucaguggguaaaagcauuugccgugcaagccucaugaccugaguguggguauucagaacccacauaaaagccaaaaggacaaguauuuauagcccccucgugaucccuaccaggagauggcaggcagacauccaacaaucccccgaagcucaauggcaggcucaccugacguacacagcagcgacaccuuguuucaaaccaagucaaagaugaagauugauuacgugggaggcuguccuauggucugcacagauguauuaugcaaacacacacacagguacacacacacagucacacacacacacacacacacacacacacacacacacacacacauccauacaugcuagugcacucaaugugaauauuugagucuuccaauaaaugaagaaaaugaggaauuuugcuuuaaacagcccuucccuauguagcccagguuagccuuuuuuuuuuuuuucugccuuaaccacccaaguccugggauuucaaauguggugggagaucaaaugaugauucauugcacacuuugaauucuuguuuuauuuguuuugugagacagagucuugcucuaugguccuggcuaucugggaacugaucauggagaugaacaaucugaccucaaauuuacaucuaauccuccuaccucugcuuuugccuucugaguucuaguuuuacaugcaugugccaccaggcuggcuuauaucucgaauuuagugcaacauuuugugauguauuucuaguauguaauuugaugccaaguuuguuuuuaaaaccaacauuugucuaauaacgcacacauucauguuucauaauuuuuuccuuuuaaauuuuauuucauuuuucuacuuuccuacuauuaacuuuaauuuuguuuucauuguuuuccucuuagauuucagcuuauuucuaauuagugcugauuacuaugugucacgcuuuuugacuucuuucguuucguucaguaggaaugacaguucuuagauuagaaaaucugauuuuguugacuguuggguacauaugcaccuuucaaaacuuuuuacucuucacccaucauaucaagauaauuuaugcauuauaggacuguuuuuguugcuaacauguguguuuguguguguguaugugugugugugcgugcuugugaauguuucugcacaugugauagcaggaggagacaaagacuuguaagcaggucguugugucugaauacaugaagaugcaccaguuccucaaggaagaggaacagcuccagcuccagcuccuggagagggaggagaaggcgaacaugaagaagcugagggaaaaugagauccagcugacccagcaaauccgccgccucggcaaaaugauugggcggauugagucuaccugucagaacuugacguuagaaucuuuugaggugagacaaaauucacgaggacacugggggaaaauuuuuuuuuuuauaaaauuuuuuuuauuacguauuuuccucaauuacauuuccaaugcuaucccaaaaguccuccauacccucaccccacuccccuaccuucccacucccacuuuuuggcccuggcguuccccuguacuggggcauauaaaguuugccuguccaaugggccucucuuuccagugauggccgacuaggccaucuuuugauacacaugcagcuagagucaagagcuccgggguacugguuaguucauaauguaguugcaccuacaggguugcagaucccauuagcuccuuggauacuuuuucuagcuccuccauugggggcccugugauccauccauuagcugacugugagcacacaguggcuuuuaguauuucaagcuauaggaacuacauuuuucuauaaucaucugaaaaauuaaauucugccuaaaugucauuuccuuaagguaucuaucuggguaucaaaaauucuugaaaaggaggagaaaucaaacaaagugaaaaggaaacaaaaaacauuucacaaacaagcccagggacgacuaguuucuucuggaucugcuucugcacacauagccuugucuagaaacucacaauuuauuuguaagccggugggcauggugaauuuaaucuuuucaaagaucugaugaggguuaagucuuaguguuauguagccuacaggugaucaucacuuacaaaagggauagcaaauauuuaauaaucagauugauggccguuaaggagaccugauugcccugcagcuaaaagguggcaggauccaugcauucugugugccagggccacuguucaaucuuugccuacuaccucccuaggcuacugcacucauuaacaucgucucaguuauaagccacagagccaacuucugcuucaggucccauucaugauuagacucuauaaggagugcuaucuaauuuugugucuucuaaaugacuaaagaacaucauaaaacaugacaugggcuuggucucagcucucgcugaagcauuuuucuuugcucaucucugguuccuuggcacaugagguuaauauuuugccucaacuauuagauauucaaauuuuaaaggaaggagggcuuaggaguccccagucaucucugagcaugucuaggcaguuagugguugcucugugugugugugugugugugugugugugugauauuauuuuuuauugauguagucacugguaagcugcccauucucuguacauaaccccuuccccacccccauaaauaacccuaauuaaacucuuugggucacgaaacaaauaaggucaugugauuagaauuguggauguguugggaauaggaaagggauaaauaagaguggaaagaagacaagauaaaaauuaugugcauauauggauacacaaaaauguauuauuuacauaucugaaugcaucaaaauacauacacguaugaaauuaucaggaugaaauucauuauuauacauaaugaauauaugcuaaaacacauuuuaaagaaaggacuuuuuaagugcuagcaagcuaucacuuaguggguagaggugauugcugucaaggcugaccacgugacuuccauccuuggcuaggauucacguggucugagagaacagccucucuuuaauuuucccucucaccuccauauuuguguugugaccaagugcauucccuacucccuacaaauaagauuuguuuuugcuuuuguuuuaauuaaagcuuagaugugaagaaagagaacaaacuauucucuggucagagugagaaacaucucauguucauuaaaaaccauccuuagaaaaagcugaggcuuuacucuccuauccuaucugcuaccuccucucaagaugugcuagaaucauggaaguagaguuuagguaacuagugcgagauugggaugaggaccgauuuacgauucgcuagugauggagaugaaugcagaguaaccuucuuuucuuuauaucccuaggaagucaaaggagccauggaucgguaggugucuauuagucuauggagaucuggugcugaugaaauacugaagguguggggaauaguauguggauguuguugcgaagagaugcuauggaccgauagguuggaccagguuaugugguaugugucacagagagaaugaggcucuguuuucucuuggaagguaugagucccuguuguuucagucuccagagaccaccaucacggaacugagccugugucacaucacugggaugagggagaugcugcgaaaauucagcaguaaguccgucuucuugucauaucuccagggauuuccauaguuaagcucagcacauguuauggguaccccugaguucuugggcagcuucuucuagcauaaaagauucuucugacaggaggcgcccaguuauaguaucuagagucagugcuaaggcaccaaguuguaaacacugccuaugcuugagccaagacacaagaaaccuuguuggauguucugucaggcucugccuguugucaaaggguucggugauauguauacaccauacccagcacaugcaauaacccucuugcaggggauccuuccuguuaggacaaaagcuagguuacauucuuuuguuuuaaucccugugugugggcaggcagugggagugauuguuguacggguguguauaugugugugaguguaggaauuuguaccagucaauggguauagaggucagaggacaaccuuggguguuaagucuuugauucuacuuuguuugaggcaggccucucuauuugucaugcccagauacuuuggggauauuugaguggaaacugaauuggauuguaccucugagaugggaaacaucuuuguucaaagauggggguauguauagccugauaccauuauucaaagaugaugguauauauagccugauguaaguuggggaggaggggguccugagguugccaggugcauuguuuggagaugggugugugcacacucuacaugcagauaaaggaucuagaaugucuaguacauuauuguaugcuuaucuaccucagugggggcaaauuaucucacagccagugaaaguuugagguagggaugaaggccuaguagcucacaugagcuguaugacauugucaccgggaugcuaacucucacaaggcugcauuugaccauggcauaguggaaaaccacgaauuaaaaauuuacuauuauaauucuccauuauuuuguaaucuuaguaaaauuaauuaguacgauuuuaaaguuucuuuuggacucaguuuuguuuaguuaauuguuuuguauuuguucaacaaggucucauguagccaggcuggucuagaacucccuacguagguaagguugaucuugacccucuugccuccacuuucaaagugcuaugcuuguaaguuugugugaccacaccaggguuguuuguuuguuuguuuguuuguuuguaaguguuguggauagaacgcagggcucugggcauguuaggcaggccugccaucaagaguuugauaccucugacccguuuuucaaguuuuuauuuuucuuaaagauuuacuauuagcuaugaguauaugugugugaguguacaugaauuugggugcucaaggaggccagaggugucaggcccccuggagauggcauucuagaacguugugcaccaucagacaugagugcugggacucuaacucugcuccuugggagaagcaucauauacuucuaacuauggagccuucucucuagcacuugucauuuauuuauucccuauguauuguugcauguaauaugagaauauuauaauugcaacaaugauuaaauacauuaaugcauaggaaauaauuugcacuuagaaggaggguaacaaauuacccauuugccuucuauccaaagugcagaaauccugccaugucuaacagcaaggguauccuuguguagagagauaaacuggaauucuaaaacugucuagaacacaacguuuauuauacucaguuuccucucauccucacagaugugccugaucucucuucacaugacucuauucugccucuucuuguaccuuuacugccuguuccaugggcagugaaaaacaagcugggagauucuguucuguguucuguuuguuuauuuugaaauugggucucaugacauagcccaagcuagccuuaaacucauguuaauccacuugccuaagauuccuaaguauuggaguuaaugacauaaggugucaaguccaguuagagguggacuuuuuuuuuuuucuaaaggaggucaucuuaccaaaugcacugaaauuaaauugaaaacuuuuguuuauagaaaaaaaaagaauagaaauagaugcuguagaauagaauuuuacaguauaaaccaagcuggucucaaauuuaacuauauagaguuuggccacaaacuugguucugaaaccagauauugcuguguaguccaggcuguucuuccauucauuaugaagcccaggcuggcuuugaacucauaugcuauuacuuuagggcugggguuguuugccugccuaacgccuaaguuaaaaaauaggccuagcagagaauguugaacauuucuuuaggugcuucucaggcauucgauauuccucaguugagaauuuuuucuuuagcuguguaccccauuuuucaacaggguuauuugguucuuuggagucuaaguucuucaguucuuuguguauauuggauaauagcccucuauuggauguaggguugguaaagaucuuuuccgaaucuacugguuucuguuuuguccuauugacaguguccuuugccuuacagaagcuuugcaauuuuaugaggucccauuuguugauucucuuuuuuuuucuuuuuuuaaaauuuuuauuuuauuagauauuuucuuuauuuacauuucaaaugcuaucccgaaaguucccuauacccuucccaugcccugcuccccuacccacccacucccacuucuuugcccuggcauuccccuguaaugggguauauaaaguuuucaagaccuacaggccucucuucccaaugauggccaacuaggccaucuucugcugcauaugcagcuagagacaugagcucuggggguacugguuaggucauauuguuguuccaccuauaggguugcagaccccuucagcuccuuggguacuuucucuagcuccuccauugggggcccuguguuccauccuauagaugacugugugcauccacuucuguguuuaccaggcacuggcauagccucacaagagacagguauaacaggguuccuucagcaaaaucuugcucacauaugcaauagugucuggguuugguggcugauuaugggaugaauccucgggugggguagucucuggauaguccaucccuuuugucuuagcuccaaacuuugucucuguaacuccuuucauggguauuuuguucccuauucuaaggaugaaugaaguauccacacguuggucuuccuucuuuuugauuuucuuguguuuugcaaauuguaucuuggguauuucaaguuucugggcuaauauccacuuaucagugaguguauaucuagugacuucuuuugugauuggguuaccucacucaggaugauauccuccagauacauccauuuacccaagaacuucauaaauucauuguuuuuaauaacugaguaguacuccauuguguaaauguaccacauuuucuguauccauuccucuguugagggacaucuggguucuuuccagcuucuggcuauuauaaauaaggcugcuaugaacauaguggagcauguguccuuauuaccaguuggaacauauucuggguauaugcucaggaaugguauugcuggaucuagcaguaguacuauguccaauuuucugaggaaccgccagacugacuuccagagugguuguauaagcuugcaaucccaccagcaauggaggaguguuccucuuucucuacauccucaccagcaucggcugucaccugaauuuuugaucuuagccauucugauuggugugagguggaaucucaagguuguuuugauuugcauuucucuaaugauuaaggauguugaacauuuuuucaggugcuucucagccauucgguauuccucaguugagaauucuuuguuuagaucuguaccccauuuuuaaugggguuauuugaauuucuggauuccaguuucuugagcucuuuuuauauauuggguauuaguccccuaucagauuuaggauuguaacauuuguugauucuugauuuuagagcauaagcuauugguguucuguucaggaauuuuccccugugcccauguguuugagucucuuccucacuuucucuucuauuaguuuuaguguaucugguuuuauguggagguccuguauccacuuggauuugagcuuuguacaaggagcuaagaacagaucaauuugcauucuucuacaugcuaacugccaguugaaccagcaccauuuguugaaaaugcugucguuuucccacuggaugguuuuagcucccaugucaaagaucaagggaccauagguguguggguuccuuucuuggaauucuaauccauugauuuaccugccugucacucuaccaauaccaugcuguuuuuaaucaccauugcucuguaguacagcuugaagucagggauggugauucagcuagaaguucuuuuauugagaauagccuuugcuauccuagguuuuuguuuuuccagaugaauuugcaaauugcucuuucuaacucuaugaagaauugaguuggaauuuugauggggauuguauugaaucuguagauuucuuuuggcaagauggucauuuugacuauauuaauccugccaauccaugagcaugggagauuuuuccaucuugagacuugaaguucuugucauacagaucuuucacuuguuugguuagaguaaugggaagauacuuuauauuguuugugacuauugugaaggauguuucccuaauuucuuucucagccuguuuauccuuugggggcaacaaaauauccaugggaggagauacagagacaaaguguggagcagagacugaaggaaagaccacccagagacugccccaucuggggauccaucacacauacaaucagcaaacccagauacuauuguggaugucaacaaguucuugcugacaggagccugauauagcugucuccugagaggcucugccagcaccugauaaauacagaaauggaugcucacagccaaccauuggacugaacacaagguccucaaugaaggagcuagagaaaggacugaaggagcugaaggggucugcagccccauaggagaaacaacaauaugaaccauccaguaccuccagagcucccaaggacgaaaccaccaaccaaagaguacauauggagugacccacggcuccggccaaauauguagcagaggauggccuuguuggauaucaauaggagaagaggcccuuggaccugagaaggcucgaugccccaguguaggggaaugccaggacagggaagcaggagugggugguuugcugagcaguggccggggguggggaggggaugggauaugggguuuucggagguggaacccaagaaggagauaacauuugaaauauaaauaaagauaauaucuaauaaaaaaaaggaaaaaguaggccuagcugggcuugguagucaugucuaaaucucagcacguaagaagcuaagguuagacaacugccaaguuuaaggcccagccugggcuacuugguuagacuccugucuucaaaaaacaaauaauaauaggacuaucuauuaagaauuuagguuaaaauuaauauauuugggagguugccaaggaugucaaaagauugguucucuucucuucuugcagcagauauaacucuagauccagccacagccaaugcuuaccugcuuuuguccgaagaucugaaaagugugcgguauggagggaccaggcagcaauuaccugacaacccagagcgauuugaucagucugcaacuguguugggagcucagaucuucaccugcgggagacacuacugggaaguggaagugggaaagaagacggagugggaaguggggaucugcaaggacucugugaacagaaaggggaaucuccccaaaccgcccggggaccucuucucacucauaggcuuaaaaauuggcgacgauuacagucucuggguuucaucuccccugaaagggcaacauguccgagaacccgugcauaaaguugguguguucuuggacuaugacucuggacacauagccuucuacaaugcgacagaugagucccucaucuacagcuucccuccgaccccuuuccaugaagcucucagaccuaucuuuuccccuugucuuccgaaugaggggacgaauacagacccucuuaucaucugccacaucugagggacaugcccugagccuugagcaaagacaaggccaaggagcagccuagucauuaacgugguuacuguauucaaagacaucacauaucagauuaccccgaacaaaaaaaaaaaaaaaucuucccucuccccaaagacuuuccacaaacccaguugugcaaugaagagccuacuaaaaaucuauucagcaccaagaauagaaagaugauacccugccuuuaacccaguugauuaucugagcuaugcugugugugcuggccacuuaacaaacagcguugucacuguccauucuugccugucaaucugucauaggccaguuuuauaaauacauggcauuuuuuuuca

SEQ ID NO: 4418 - RNA, 20580 nt, Mus musculus
gauguggcuaaaguuggagcuguaugggaagacugggagggggcagugaguggacuggaaagugaauaaguuaaaaaaaaacuuuuaaaagaacuucaaaaauucaaagauaguaauauaaaggucuugcauauuaagggucauugggauagguugagcuuauuuggaaaauaucuuguaugaaagccuaguuuuaaaaauauaacugucauuucacaucagaguggaaaagauagauuauucaacuaaugguuuaggauaagugaguguagccaucuggaaaaauaaaguugaaucucuacaaacaacuuacccaauguguguuccacaugagacaggaugcuuguguguguuccucccaguuacagauuucagauuaauuugcauuguuuugucaccauuuugacuuauuuauuuuguuuuguuuuguuuuauauguguuuuguuuuagaucaggacuucaaaaccgucuacuguuuugcuauauuguuucucccaagaaaucagucugacccugggaagcuagguagauaaaagagguacgcaaaucaaacauuuacugaugauaaaucagaacaagauguuuuuuuaagcaauucuucgcaauaaugcaauuuuaccauuuauggaagaugaaaccaaaauuucauguuaacaaaauggaugugcucauuugucuuuacacacgggauaaaucuuagcuggauaguugguauugcgggauuagaucauucaaugcuuuucagaauuuauuuauuuacccauuuauuuauuuauuuauucuguuuuuuuauuuaguuuucuuugguuugguuugggagguuuuugcuucuuuguuuguuuguuuguuguuagaauccaucugacccaggaugucuucacacuugcuacauagcuuaagcuggccuugaacuccugguccuccuacuucaccucucaaguucugguauuauaaauguguacuaccaugcucagucugaucaauauguugauuuuacaaucaucaauuaugaaauaauaugagaugggagacauuuguuuagguagggccauuucagaaaucauugaaaauucuguccuaaucucaaacccaaauagacuuaacaagaacuaagaaaugggugccccuaaggagcuguaacacaagcauguaggacaugugacuacgaccuggaaacucaaggaagcuuaaggaagaaugcuccauguuugaggaagaacaacccagaagcuugauugcccacgacuguggcacacucacaucagcccagcaugcaggaaauuggacacagggugauuucugcaacaccagcuagcccgggccaaccacaaaaccuugucuuacucaaaagagaaggaggagcuggagaagaugaaaaagaacaagaagggaaaacaaggaagggaagaauuucuugagacguaaagcauguuuuaugauuacaaucuaggcuaagacagagaugucaaguccaugcugacaccaacuucgaaacacacuaucagucucucuuaaacauuaacucuuuuuauuuauuuauuuauuuuuauuacauauuuuccucaauuacauuuccaaugcuaucccaaaagucccccauacccucccccccacuucucuacccacucauucccauuuuuuuggcccuggcguuccccuguacuggggcauauaguuugcguguccaaugggccucucuuuccagugauggccgacuaggccaucuuuugauacaugugcagcuagagucaagagcuccaggguacugguuaguucauaauguuguuccaccuauaggguugcagaucccuuuagcuccuuggcuacuuucucuagcuccuccauugggagcccugugauccaucccuuagcugacugugagcauccacuucuguguuugcuaggccccggcauagucucacaagagacagcuauaucuggguccuuucagcaaaaucuugcuaguguaugcaauggugucagcguuuggaagcugauuaugggguggaucccuggauauggcagucucuacaugguccauccuuucgucucagcuccaaacuuugucucuguaacuccuuccauggguuaaacauuaacucuuauagugugguaaucccuauauuaaccccauguaugagacaccugagaagggaaaggaagagauagcaugcauugaauuagcauggaggacucagauggugguguucaauauuaccuggaaguugcuagaacucuaagcuagaaacacuuagaccaagacccaaccuaacugaaucaaaaacuccaguccuuaccuuuaaucccaguucuuuggaggcagaggcagguggaucacuaagaguuggaggccagccucgucucucgucuaaaaauaaaagaguuccaggacagccagaacucuauuacacagagaaaccuugucucaaaaagcaacacacacagacacacacacccucuggagcuggaccgagcacuccaguuuuaaacaagacccaggaccuuugaugauucugguguacuauaaaguuuggaaggcacagauuuugggaucaaaauugacuuaacucucuggguaauucuaacacuguaagaaaucuuaggaucaagucugcaacucaaaaauaauuuaugcauaacggcuggacuguuagauaucgggaggcuaaucucuaggacacuguuuuauacucccuccugccaaagccaucuugcuucucccguauuauagaguucccagcaugaacugcaagugaguagugaggcagaggguagagguuuaacuucucucucaggaaagcaucugaagaugaugacacauucugucucaagaggggacaaaugucugguguugaaagucagguugaggcuaggcaugugcuaaucuuugcacucagggaaacugaggcagaggauguauggcagaagacucucacaauagaacaucaccuuuuauuuauucauuaauacauucuuuuaucuauauuguuuucaugaaauacauugaucauauucuucccuuuccccaccaccucccaaguccucccuaccuccuuacccaccaaacuucaugcucucucucucucucucucucucaaaaaaaaaaaucaaaacaagcagacuaagagaaaaagaaccaaaaaaaccccaucagcaacaaaauguacuccuuuuuaaagauuguuauuuauuuacuguauguguauguacacgugugcucaaagacacacacacaugccaugauacaugugcagagaggaugacuuuuggaaguaguuuuuuccuucaucuuugucuccaugaucaaauucaaguccacagacuuagcagcaaacagcuuuaucuuuuacugguugacccauaucuccagaccaauaaugucacgguagacucagaaaaaugagcaauaacuaacuccacuugggguuuuucccaaggaaaaaggucucaaggcuggaaguguaauuaaaccauccugcucaaaugggaagacccaagugguacuaaaagucagaaaguguaauaaguuccugcuauauaggaagaggcuagccuauuaaaggaacuaguauaguggcuggacagucacaauugagagcuuacagcagaaugcgcauagugggccuacccagaaacaaaacccaguaugguuucuuuaauuuuaagauuuauuuauuauuauaucuaaguacguuguagcugucuucagacacagcagaagagggugucagaucucauuacgggugguggugagccacuaugugguugcuaggauuugaacucagggccuuuggaagaucagucagugcucuuaaccacugagccaucucaccagcuccccaagcccccaagcauagauucuaagaaauauuuaacgacucugcucaagcaucacuuuuuccaaccuaauaggguuuggagaaaggaaaguaacaaagccacuguugguaaguacacaaaauuacaaaagaaaguuaaucguuguucuuggauuauaucgaggccugaacuccuugaucuuccugccucagcucucaaauucugggauuauagaugugcacugcugugcccacuuugaucaauguuuuuauuuuaaaauuauaaauuccuaggauugcacuuuggacuauuugauuuuguuauuaugaaaagagucuuuaggcagaggugaguggguagaaggagagaagagagaggaaagaggagacagagagagagagacagagacagagacagagacagagacagagacagagacagaaagacagagagagauuagccaggcaacauaggacugugauuccagguaggagucaggaugaucauacuuucaaaggcuaccugggcaauuuagcaagaauuugucucaaaaauuaaaaagaagaugaggaaauuggcaguauaggucagcuugcucaaggcccuaaauucaauugcccuacugccaaggaaaaagagaaggagggagaggaagaagauaggaagaagaggcaagaaagaggaggaggagcaagagguggggagggaagagugggugccaggaagaggggaaguaaagaggaagaagaggaguaaaaagaagaaaauucuuuuaaaauuuuauuuauuauuguuaguguuaauuauauguaggagugcucugucugcacguacacuuccgugccagaagagggcaucagaucccuuuauagauggccaugagucaccaagugguugcugugaauugaacccagaaccucaaaaacccagccaauguucuuaacugccgagccaucucaccagcccaaaacggaaauguaauuucuuuuuuuuuuuuuaagauuuauuuauuguuauauguaaguacacuguagcugucuucagacacaccagaagaggguaucagaucucauuacggauguuugugagccaccaugugguugcugagauuugaacucaggaccuucagaagagcagucggugcucuuaaccgcugagccaucucgccugccuccagaaauguaauuucuuaaacuucuacuuuuagaaacugcaaaguccaagguuggaggagcuccuugguucagccuuugggccacagcuugccagcagauagcggcaugcugagcgcuagagcucgcuucuucagugacccccuaaagguuccuguauaagaagcucauuccccaacuuugugauguagagagcugacaaaaaaacaaaccaaacaaacaaaaauucuucaagauauauacccuagaggcuggggagauaggacuguguauaagagagcuugccugcgugcaaacacggaaacccaaacucaaaucgucaacacagcaguggauuccagucaaccuaaggcuaugggagcaauguggaaacaggaaaaccccugggguuugcuagguucguccuugggucagccuagcaagcuccagcuucgguagcagacccaguuucagagcuccagcuuccguagccgacccagucucggaggaauaagguugaaagcgguaaagcaggcacugggugucugcgcccucuucuggccugaacaugcauaugcucacauauguacuucucacaugugcauacacgcugcacucacaccuacauacacauuuuuuuaaaaaaagauuuauuuaguuaaugcuauuaguacacuguagcugucuucagacacaccagaagaggacaucagaccccauuacagauggucgucagccaccaugugguugcugggaauugaacucaggaccucuggaaaagcucuuaacagcugagccauuucuccagcccacacauuauuuuuuuuuuaagaagugagguuggaaagcaauuaagagcacuugcugcuguaacagaggagaaaaguuugauucccauuacauacauaaauagcucauaaucauguguaacuccagcugcugggacucugucaaccuguucugagaacuugacucugucaugcacacucuguacauauaggcacagacaaacacaugcauacacauaauuuaaaacauagaauaugagacaaccgaucaccuuccuggugagagcacagggguccgcccggcccgagaggaugggucacacggcccccaauggaggagcuagagaaauuacucaacgagcuaaagggaacugcaacccuauagguggaacaacauuaugaacuaaccaauacccaauugacucuagcugcauauguaucaaaagauggccuagucggccaucacugcaaagagaggcccauuggacuugcaaacuguauaugccccaguacaggggaaccccagggccaaaacgggggaguggguggguaguggauuggagggguggguauggcggacuuuugggauagcauugaaaauguaaaugaggcccuuccgcucggcucgagccccgggcuaccuugccagcagagucuugcccaacacccgcaagggcccacacuggacuccccacgggauccuaagaccucuggugaguggaacacagcgccugccccaauccaaucgcacggaaccugagacugcgguacauagggaagcaggcuacccgggcuugaucugggacacaaaccccuuccacuccacucgagccccgggcuaccuugccagcagagucuugcccaacacucacaagggcccacacaggauuccacacgagauccuaagaccucuagugaguggaacacaacuucugccaggagucugguucgaacaccagauaucuggguaccugcccugcaagaagagagcuugccugcagagaauacucugcccacugaaacuaaggagagugcuacccuccaggucugcuuauagaggcuaacagagacaccugaagaacaagcucuuaacagugacaacuaaaacagcuagcuucagagauuaccagauggcgaaaggcaaacguaagaauccuacuaacagaaaucaagaccacucaccaucaucagaacgcagcacucccaccccaccuaguccugggcaccccaacacaaccgaaaaucuagacccagauuuaaaaacauuucucaugaugaugauagaggacaucaagaaggacuuucauaagucacuuaaagaauuacaggagagcacugcuaaagaguuacaggcccuuacagaaaagcaggaaaacacagccaaacagguagaaaucauuaaagaaaaacaggaaaacacauccaaacaggugauggaaaugaacaaaaccauauuagaaauaaaaggggaaguagacacaauaaagaaaacccaaagcgaggcaacgcuggagauagaaacccuaggaaagagaucuggaaccauagaugcgagcaucagcaacagaauacaagaaauggaagagagaaucucaggugcagaagauuccauagagaacaucggcacaacaaucaaagaaaauacaaaaugcaaaaggauccuaacucaaaacauccagguaaugcaggacacaaugagaagaccaaaccuacggauaauaggaauugaugagaaugaagauuuucaacuuaaagggccagcuaauaucuucaacaaaauaauagaagaaaacuucccaaacauaaaaaaagagauguccaugaucauacaagaagccuacagaacuccaaauagacuggaccagaaaagaaauuccucccgacacauaauaaucagaacaacaaaugcacuaaauaaagauagaauauuaaaagcaguaagggagaaaggucaaguaacauauaaaggaaggccuaucagaauuacaccagacuuuucaccagagacuaugaaagccagaagagccuggacagauguuauacagacacuaagagaacacaaaugccagcccaggcuacuauacccggccaaacucucaauuaccauagauggagaaaccaaaguauuccacgacaaaaccaaauucacacauuaucuuuccaagaauccagcccuucaaaggauaauaacagaaaagaagcaauacaaggacggaaaucacgcccuagaacaaccaagaaaguaaucauucaacaaaccaaaaagaagacagccacaagaacagaaugccaauucuaacaacaaaaauaaaaggaagcaacaauuacuuuuccuuaauaucucuuaguaucaauggacucaauuccccaauaaaaagacauagacuuacagacuggcuacacaaagaggacccaacauucugcugcuuauaggaaacccaucucacggaaaaagacagacacuaccucagagugaaagacuggaaaacaguuuuccaaacaaauggucugaagaaagaagcuggaguaauaucuaauaucgaauaaaaucgauuuccaacccaaaguuaucaaaaaagacaaggagggacacuucauacucaucaaagguaaaauccuccaagaggaacucucaauucugaauaucuacgcaccaaaugcaagggcagccacauucguuagagacacuuuaguaaagcucaaagcauacauugcaccucacacaauaauagugggagacuucaacacaccacuuucuucaaaggacagaucguggaaacagaaacuaaacagggacacagugaaacuaacagaaguuaugaaacaaauggaccugacagauaucuacagaacauuuuauccuaaaacaaaaggauauaccuucuucucagcaccucacgggaccuucuccaaaauugaccauauaauuggucaaaaaacaggccucaauagauacaaaaauauagaaauugucccauguauccugucagaccaccauggccuaagacugaucuucaauaacaacauaaauaauggaaagccaacauucacguggaaacugaauaacacucuucucaaugauaccuuggucaaggaaggaauaaagaaagaaauuaaagacuuuuuagaguuuaaugaaaaugaagccacaacguaaccaaaccuaugggacacaaugaaagcauuucuaagagggaaacucauagcucugagugccuccaagaaaaaacgggagacagcacauacuagcagcuugacaacacaucuaaaagcucuagaaaaaaaggaagcaaauucacccaagagggguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguuaaccaucuaaacagucccauaucaccuaaagaaauagaagcaguuauuaauagucucccagccaaaaaaagcccaggaccagacggguuuagugcagaguucuaucagaccuucaaagaagaucuaauuccaguucugcacaaacuauuucacaaaauagaaguagaagguacucuacccaacucauuuuaugaagccacuauuacucugauaccuaaaccacagaaagacccaaaaaaaauagagaacuucagaccaauaccucuuaugaauaucgaugcaaaaauccucaauaaaauucuugcuaaccgaauccaagaacauauuaaagcaaucauccauccugaccaaguagguuuuauuccagggaugcagggaugguuuaauauaugaaaauccaucaauguaauccauuauauaaacaaacucaaagacaaaaaccacaugaucaucucguuagaugcagaaaaagcauuugacaagauccaacacccauucaugagaaaaguuuuggaaagaucaggaauucaaggcccauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauauuauaguauauauaagugacccuaaaaauucuaccagagaacuccuaaaccugauaaacagcuucguugaaguagcuggauauaaaauaaacucaaacaagucaauggccuuucucuauauaaagaauaaacaggcugagaaagaaauuagggaaacaacacccuucucaauagucacaaauaauauaaaauaucuuggcgugacucuaacuaaggaagugaaagaucuguaugauaaaaacuucaaaucucugaagaaagaaauuaaggaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuggaaggagcaauuugcaaauuugucuggaauaacaaaaaaccuaggauagcaaaaagucuucucaaggauaaaagaacuucuggcggaaucaccaugccagaccuaaagcuuuacuacagagcaauugugauaaaaacugcaugguacugguauagagacagacaaguagaccaauggaauagaauugaagauccagaaaugaacccacacaccuauggucacuugaucuucgacaagggagcuaaaaccauccaguggaagaaagacagcauuuucaacaauuggugcuggcacaacugguuguuaucguguagaagaaugcgaauugauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcguggauguggagaaagaggaacacuccuccauuguuggugggagugcaggcuuguacaaccacucuggaaaucagucuggcgguuccucagaaaacuggacauaguacuaccggaggauccagcaauaccucuccugggcauauauccagaagaugccccaacugguaagaaggacacaugcuccacuauguucauagcagccuuauuuauaauagccagaagcuggaaagaaccuagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaagaaacucacacaauauguacucacugauaaauggauauuagccccaaaccuaggauacccaagauauaagauauaauuugcuaaacacaugaaacucaagaagaaugaagacugaaguguggacucuaugccccuccuuagauuugggaacaaaacacccauggaaggaguuacagagacaaaguuuggagcugagaugaaaggauggaccauguagagacugccauauccagggauccaccccauaaucagcauccaaacgcugacaccauugcauacacuagcaagauuuuaucgaaaggacccagauguagcugucucuugugagacuaugccggggccuagcaaacacagaaguggaugcucacagucagcuaauggauggaucacagggcucccaauggaggagcuagagaaaguagccaaggagcuaaagggaucugcaacccuauagguggaacaacauuaugaacuaaccaguaccccggagcucuugacucuagcugcacauauaucaaaagauggccuagucggccaucacuggaaagagaggcccauuggacuugcaaacuuuauaugccccaguacaggggaacaccagggccaaaaagggggagugggugggcaggggaguggggguggguggauaugggagacuuuugguauagcauuggaaauguaaaugagcuaaauaccuaauaaaaaauggaaaaaaaaagaaaauguaaacgaggaaaauaccuaauaacaauaaaauuaaauuuuaaaaaaacauagaaugaaagaaagaaagaaagaaagaaagaaagaaagaaaggaaggaaggaaggaaggaaggaaggaaggaaggaaggaaggaagaaagaaagaaagaaagaaagaaagaaagaaagaaagaaagaaagaaagaaagaaagaaagaaagacagacagacagacagacagacagacagacagacagacaggaaggaaggaaggaaggaaggaaggaaggaaggaaggaaggaaggaaggaaggaaggaaggaaggaagccagauagugguggugcacgccuuuaaucccagcacuugggaggcagaggcagacaaauuucugaguucgaggccagccuggucuacagagugaguuucaggauagacagagcaauacagagaaagccuaucucgaaaaaacaaaugaacaaauaaauaaaugaauaaauaaaauguucuuauuuauguuuuguuguuuucaauccaucccucucacaacuuccacuccguccucucuucccaguaccugcuccccaaccucccuuuaaccaagaucccaucguccuugaguuuccuucagaguagagcaggccucccacggaucuccacugaacaagacacaagauacaaugagacuaggcacaugcucucagaucaaagcuggaugaggcaaccuaguaggaggaaagggguccuaagagcagaugaaagagauuaaauuaaaaugaaaaucuuaaaacaaaaaaauuaaaagugcagccuaguagagguggcaucuuagguuugggcagugugaggggacugugagguccuggucucuucuuauuccugcuugccaaccacgaaaugaggggcucuguugcucuccauguucucacuucauugugugcugccuugccacagaucccaaagcaaggccaaccaacaacaggcuggaacagguuaaccuaaagaaccuuguuuuaucucuaaguuaccuaaaguauuugcuaagguaucagaugagcagcuaacugauagcugcuguaugacuuugugggguggccagagacgguacggucagucagaaaucuagacaauagugcagugucagacuccaguuagcacagcccuuucuguaagaaccgaugaagacaucccuugaaaauggcuucaguuccccuuaggacaacaugcacacacauggaaaaaccauucaagauccagcucucucucauacuaagaaccaagcuucuaaccuugagcaucccaaccaucacacuccauuaaaacaaagcaaguuguccaggggaacaaaucagcagggcuuugcaaauauaaaggcauuuuuauuucauuuccgaguaaguucauauucacagacugguaugaucagagguuagugacugugacgauuggguucaaaauaauuaaaacugucacagagcuugacaguugguugcagcucucagcuaaaagcuaaacuggggugaugggagugggaauagagaggagugaacuuuccuaauggaauuuaaaggagacuagaagugcuagcacgugauuaacuagagauuugcaaagcggguagucgcuuggaguccaucacaagauucuugcuuaacugaguggauguguccaguuauaaagagaggauaguacauuuuuaucauucauagacaucacauauggcuuugagauaccuguaggauaccugaauagagauuucuagugaguacauacacauaugagucgaaugaucagaagaaauaucuaaacuuuaaauaaaggcuuggcaucaaggaggcaacuggggagucaccaagauggcucagcaaguaaaggcaggcacauacacacacacacacacacacacacacacacacacacacacauacacacacuacagauagauagauagaaagauagauagguagguagauagaugcugagaaagaaggcaauugaaaaccacaguacaaauaguuaucccugaaaaucaucauguaaaauggaaaaguccagguuauauuuuauaguugcugcuauuuuuguuuaaaauacagucuaaguagagucagaugggcucaccucagccucucguuagccuugaguacuggagucaggugcagccaagagagauucgagcaucuuccuggcaaacuggaggcaaaagaccauuuuugcuuuacuggcucuccuccugcaccaggugccucgggacugaaauccucuccuuucuaggggaaagggccucuauacuaacacacuaaaaagucucccaugaacuucccccagcaagggcaagggcaaagucuggguagggaugagacuguuaauggcuuaucuacuguaucucacacuaccacuucaccuauugugaacucugcucucaacuccuccugccccucauaaccuccaucacccuaucguagccuacgacugucuucagaacuacucacgguacccauccaccaacccuggcaacauccucaaggacucaccccaucuuucucaguucccugggggacaauacccacucaaugguauccuugggggacaaaccuucauccccaagucacaucacuaaucuucaagccaagaguucugggccagugguacccagagucccaugggauuuaacuucaaaucacaggaagugugugauucuuuuccugaccaggauuuugagaugauucccaauggacccccaagauuuuucaccuccccacagacuucuccaauauuggggucgaguauccagaccuuugcaccuucccaggauguaagcagugacauccauccugauaaggcaacagaaaaggagcugacaggaaauggcaugggcuugguaggcagucuggagcuggggaagagcauccagaaguaaagguguguaccugucuccucuguagagacuaagaggucucuauccuggucccugaucacacagugagcuaucuagaugauccuucacaucuuccugaucaccuggacaacucuccaauugccagugaagauucccuccagcccuuugacucucuggcagcagagccagugaguggaggacuuuaugguauagaugacacagagcugaugcgugcaggagacaagcugucucuggaggauaacccuccauuguucuucucucaguaaugcuaaugccuuuagucucuuggcagaugacagcuaaauaucaaccuccaucuuugucagcccuaccuccccaucugucugucguaagggauaacagcuuuggccugaauaguggcaaugacucugaacaggaagaaguagagacccagucuucaaacuuccaacauccccuaacugagucagccccugaccagccaccuaguacucaacuaaacccagcugucucaucaacagccucuucagcaaccuccuuggcagcaccugcagaaagcucuccagcugucucuccaguagcaugcucucuugucccuccugaagucuuuccagcagucucuccagcuuccucaccugcucucccagccaucucuuugggagccuccaugacagcuccagugauuucuccucaagguuccccucaaccuucuccagcagcugccuuccagacagucuccccaacaaguaauaaugucaguagugccccugaagcuugugcugauugagaaaagauaacuggagaaguagccgcagucuuuguauugauguacugaagagacauauugcuacccaagaaguuugucuuccccuccaguauggaugguaaagagaagugugcaugaagaaguucagccauccuaugggguugcaaaccccuucagcuccuucaguccuuucuccaacuccuccaucagggacacuaugcauaguucaaugguugaaugcaagcaugcaccucuuuauuuuucagccucugacagagucucucaggagacagcuauaucaagcuccugucagcaagcccuucuugccauccacaauaguguccggguuugguaacuguauaugagauggauccccaaguggggcagucucuggauggccuuuccuucagucucugcuccacaguuugucuccguauuuucucccauaagcauuuuguucccuccucuaagaaggacugaagcauccacacuuuggucuuccuucuacuugagcuucauguggucugugaauuaaccagaccccucccagagcucccagguacuaaaccaccaaccaaagaguacacauagaggaacccaugacuccagcagcauguguagcagaggaugaccuugucgggcaucaaugagaggagaggcccuuuguccugggaaggcuugaugccccaguguagguuaaugccaggguggggaggcagaagugugugugugggugggggagcacccucauggaaacaggaguaggggggauaggauacggaguuucuggaggagaaacagggaaaggggcuaacaucugaaauguaaauaaagaaaauauucgauaaaagaaaaaaagaaagaaagcaaaccaagaaagaaaaaaaaaaaaggacagccauugguggcagggggagacuugguauuguggccccugugggaagaaaaugaagcaauuuccaaaaguuaucaaauaccugagccaaaaugugguacacagugucugccaugagcacuucagcuucagucucugcaugccugcuggagauuugaagaaagagauacaccagagagcuugcaguggguccaguuaucagcagaggggauuucuuucagaauucaagcaauuacuagcaaaugaagcugaccucgaaacaaugagaaggcuaagaacaaggagguucccaaagugaagcgggaccaugcuuggccuccuaagaucaaaaugcccgaguggcugaauaaaacagacaauagacuuccaaagaaacuggaaacucaagaaacacugagugaagagaauaacacaaagaugacuaaaagcaaaaagacgaggcagaaggcacagcggggagagagucgacuccugcccaagggcagcccaagcagaggugcuugcagaguuugaaaagaaaugacuucccuuaugguuuacaggccagaagcaagaggaagcaagacacgaaaaacuuaaagcugaaggacgaggagaagaaauucaaggcugagaaagcaaagaugaagacaaagcaggagaagcugaaggaaaagguaaagagggaaaggaagagcccagagccaggccauccuguagagcagacaagaccuugccacacagaggcggcugguggggcggcagaggcaguggguuaucuuggaggagaugaagaagcccacuggggauaugugucuggcugacugaccaccagccucugccugacuucacacccauugcugguuugacgcuguccagcagggcuuucucagauuguuugaccauuuguggaguuccugcauaguuuuggcaaagugcuaggcuuugaccuuaccaaagauguuccuagucugagaguccugcaggagggacuuuuaugucaaggugacagcuuggacaaagugcaagaccugcugguauagcuccugaaggcugcacuccacgauccuggucugcccuccuccugucagucccuaaagaucuugggggggaaaggugucagagagcucauugaccagaggcaaugugucugagauacugcgcugcuuccucguggcauagagagcagagccauccuucuaugacagucugcggacccaaccuuuucaggcccagucaucucaacagaaggcugcucuuccagccuuccuugugccugagcucaacaguuccgccauuaucaucaaugagauugacacgacucuguagaguaugucuagcuacaggaaaaacaaauggauuguugaaggccgacuccagggaccaaaaacuguucuggccaagcaaaccagguggccugagguuaugauggaaggggcagaagacgaccugggacagaggugcaguucuccgaucauggaggaaacuagugacagagaagaggaggaagaggagguaaauacaacagcugucaauggccacaggggucaaagagauggagagguugauguugcaacaucuaucauuccagagcgggagugccagauagaaaaacucaguaagcaucagcucuucuucuucuucuucuucuucuucuucuucuucuucuucuucuucuucuucuucuucuucuucuucuucuucuucuucuucuuccucuuccucuuccucuuccucuuccucuucuucuucuucuucuuuucuucuucuucuucuucuucuucuucuucuuggcaugugccaccaccgcccggcugcaucagcucuucuuuagaaaaaaacugcuucacucaucccagaugcuccaggcagugucauugguuaaaaaccgcuauagacaccauuacuggguauuacuguguuucccugguaucuuugcugaagggucagaggagugcacaguuacugacaauggaacaaagcaagaaacugaguccuugauggaagcagucacuuccaauacccagcucuacccgagucucuguaaagagagaauuaacuaacuccaaccccucuacuucuccugccggguccagaagaccaccucgaaaaccuaagccugggucuccgcagccucagcuccuucaguucaccauuagggaacaugauucagaacaagcccagacucaagcucaccccggaccucagccccaaucucaaccucagaccccuacccagccccgucuuuagucaagucgcggguuccuagagccggaagguucccuguucucucugggucagagccagcacgacuucagccaguccgccuuccugucuuggcugagccagacucagagccacaacuuccuguugaucagcucaguccucacgccugacagcagcccaggaaaacuagacucugcucuaccucaguccuuggaggagcccgagccugaugagacacaacccugcccugguccucaaggucccugguuuuaucuucucagcccagauaccccgugaugcucacugcuccuacaccaucacgucccccacaguuucagaggaccaaccugcucccucccuccagcugccugccuccucggaaccaaugaauacacccggugcugcccauccuuguucuccagugcuacucucuuccacccacuugccuggauggggccauaggaggccaucgggggacucugaaaaaaugccagagucccacagggcugggacaaccaaagcggagagggagaccuccuagcaaguucuucaaacagguggagcagcauuacuuaaaccagcugacaccccaggcuauucccccuugagaugugcucaugcauagcuuuuuuuuuaauucauuuuuguagugcuagcgaucaaacccacagcuuucuguaugcaaaucaaaccccccaccaagugagcuacaucuaaggcaagcacccacccgaccaacuggacagucccugcucuugugaucguaggcagcaggcgaaagucaaaguucaaugaaccacugaacaugcgugagagaacugcccccucacacacacacacacacacacacacacacacacacacacacauacacuggaaagugaaaccaacugacaggcgacaugcaaagucgaggggcauuuaauuagaacguccuguggguuuaaaugggacauuccaccagaacacugggauuuguuuccauguugguaaaaucagguaaaccgaguacuugacgcagugacgaggggaccuguucccacaguaaccagcaaccccacccauucugucuagggaaggguuuggguuguugagaacagcacaaggcuucccuauguagccuauauuugcuuugaacucauaauuuuguagcccaacuaaccucaaauuuagugaacuuccuacaucagccugacaaauguuaggaugagaagguaggcgagagguuugcuuugcuuuucuucugaaagucacauucugccuu

SEQ ID NO: 4419 - RNA, 20580 nt, Mus musculus
aaggcagaaugugacuuucagaagaaaagcaaagcaaaccucucgccuaccuucucauccuaacauuugucaggcugauguaggaaguucacuaaauuugagguuaguugggcuacaaaauuaugaguucaaagcaaauauaggcuacauagggaagccuugugcuguucucaacaacccaaacccuucccuagacagaaugggugggguugcugguuacugugggaacagguccccucgucacugcgucaaguacucgguuuaccugauuuuaccaacauggaaacaaaucccaguguucugguggaaugucccauuuaaacccacaggacguucuaauuaaaugccccucgacuuugcaugucgccugucaguugguuucacuuuccaguguaugugugugugugugugugugugugugugugugugugugugugagggggcaguucucucacgcauguucagugguucauugaacuuugacuuucgccugcugccuacgaucacaagagcagggacuguccaguuggucgggugggugcuugccuuagauguagcucacuuggugggggguuugauuugcauacagaaagcuguggguuugaucgcuagcacuacaaaaaugaauuaaaaaaaaagcuaugcaugagcacaucucaagggggaauagccuggggugucagcugguuuaaguaaugcugcuccaccuguuugaagaacuugcuaggaggucucccucuccgcuuugguugucccagcccugugggacucuggcauuuuuucagagucccccgauggccuccuauggccccauccaggcaaguggguggaagagaguagcacuggagaacaaggaugggcagcaccggguguauucauugguuccgaggaggcaggcagcuggagggagggagcagguugguccucugaaacugugggggacgugaugguguaggagcagugagcaucacgggguaucugggcugagaagauaaaaccagggaccuugaggaccagggcaggguugugucucaucaggcucgggcuccuccaaggacugagguagagcagagucuaguuuuccugggcugcugucaggcgugaggacugagcugaucaacaggaaguuguggcucugagucuggcucagccaagacaggaaggcggacuggcugaagucgugcuggcucugacccagagagaacagggaaccuuccggcucuaggaacccgcgacuugacuaaagacggggcuggguaggggucugagguugagauuggggcugagguccggggugagcuugagucugggcuuguucugaaucauguucccuaauggugaacugaaggagcugaggcugcggagacccaggcuuagguuuucgagguggucuucuggacccggcaggagaaguagagggguuggaguuaguuaauucucucuuuacagagacucggguagagcuggguauuggaagugacugcuuccaucaaggacucaguuucuugcuuuguuccauugucaguaacugugcacuccucugacccuucagcaaagauaccagggaaacacaguaauacccaguaauggugucuauagcgguuuuuaaccaaugacacugccuggagcaucugggaugagugaagcaguuuuuuucuaaagaagagcugaugcagccgggcggugguggcacaugccaagaagaagaagaagaagaagaagaagaagaaaagaagaagaagaagaagaggaagaggaagaggaagaggaagaggaagaagaagaagaagaagaagaagaagaagaagaagaagaagaagaagaagaagaagaagaagaagaagaagaagaagaagaagagcugaugcuuacugaguuuuucuaucuggcacucccgcucuggaaugauagauguugcaacaucaaccucuccaucucuuugaccccuguggccauugacagcuguuguauuuaccuccucuuccuccucuucucugucacuaguuuccuccaugaucggagaacugcaccucugucccaggucgucuucugccccuuccaucauaaccucaggccaccugguuugcuuggccagaacaguuuuuggucccuggagucggccuucaacaauccauuuguuuuuccuguagcuagacauacucuacagagucgugucaaucucauugaugauaauggcggaacuguugagcucaggcacaaggaaggcuggaagagcagccuucuguugagaugacugggccugaaaagguuggguccgcagacugucauagaaggauggcucugcucucuaugccacgaggaagcagcgcaguaucucagacacauugccucuggucaaugagcucucugacaccuuucccccccaagaucuuuagggacugacaggaggagggcagaccaggaucguggagugcagccuucaggagcuauaccagcaggucuugcacuuuguccaagcugucaccuugacauaaaagucccuccugcaggacucucagacuaggaacaucuuugguaaggucaaagccuagcacuuugccaaaacuaugcaggaacuccacaaauggucaaacaaucugagaaagcccugcuggacagcgucaaaccagcaaugggugugaagucaggcagaggcugguggucagucagccagacacauauccccagugggcuucuucaucuccuccaagauaacccacugccucugccgccccaccagccgccucuguguggcaaggucuugucugcucuacaggauggccuggcucugggcucuuccuuucccucuuuaccuuuuccuucagcuucuccugcuuugucuucaucuuugcuuucucagccuugaauuucuucuccucguccuucagcuuuaaguuuuucgugucuugcuuccucuugcuucuggccuguaaaccauaagggaagucauuucuuuucaaacucugcaagcaccucugcuugggcugcccuugggcaggagucgacucucuccccgcugugccuucugccucgucuuuuugcuuuuagucaucuuuguguuauucucuucacucaguguuucuugaguuuccaguuucuuuggaagucuauugucuguuuuauucagccacucgggcauuuugaucuuaggaggccaagcauggucccgcuucacuuugggaaccuccuuguucuuagccuucucauuguuucgaggucagcuucauuugcuaguaauugcuugaauucugaaagaaauccccucugcugauaacuggacccacugcaagcucucugguguaucucuuucuucaaaucuccagcaggcaugcagagacugaagcugaagugcucauggcagacacuguguaccacauuuuggcucagguauuugauaacuuuuggaaauugcuucauuuucuucccacaggggccacaauaccaagucucccccugccaccaauggcuguccuuuuuuuuuuuucuuucuugguuugcuuucuuucuuuuuuucuuuuaucgaauauuuucuuuauuuacauuucagauguuagccccuuucccuguuucuccuccagaaacuccguauccuauccccccuacuccuguuuccaugagggugcucccccacccacacacacacuucugccuccccacccuggcauuaaccuacacuggggcaucaagccuucccaggacaaagggccucuccucucauugaugcccgacaaggucauccucugcuacacaugcugcuggagucauggguuccucuauguguacucuuugguuggugguuuaguaccugggagcucugggaggggucugguuaauucacagaccacaugaagcucaaguagaaggaagaccaaaguguggaugcuucaguccuucuuagaggagggaacaaaaugcuuaugggagaaaauacggagacaaacuguggagcagagacugaaggaaaggccauccagagacugccccacuuggggauccaucucauauacaguuaccaaacccggacacuauuguggauggcaagaagggcuugcugacaggagcuugauauagcugucuccugagagacucugucagaggcugaaaaauaaagaggugcaugcuugcauucaaccauugaacuaugcauagugucccugauggaggaguuggagaaaggacugaaggagcugaagggguuugcaaccccauaggauggcugaacuucuucaugcacacuucucuuuaccauccauacuggaggggaagacaaacuucuuggguagcaauaugucucuucaguacaucaauacaaagacugcggcuacuucuccaguuaucuuuucucaaucagcacaagcuucaggggcacuacugacauuauuacuuguuggggagacugucuggaaggcagcugcuggagaagguugaggggaaccuugaggagaaaucacuggagcugucauggaggcucccaaagagauggcugggagagcaggugaggaagcuggagagacugcuggaaagacuucaggagggacaagagagcaugcuacuggagagacagcuggagagcuuucugcaggugcugccaaggagguugcugaagaggcuguugaugagacagcuggguuuaguugaguacuagguggcuggucaggggcugacucaguuaggggauguuggaaguuugaagacugggucucuacuucuuccuguucagagucauugccacuauucaggccaaagcuguuaucccuuacgacagacagauggggagguagggcugacaaagauggagguugauauuuagcugucaucugccaagagacuaaaggcauuagcauuacugagagaagaacaauggaggguuauccuccagagacagcuugucuccugcacgcaucagcucugugucaucuauaccauaaaguccuccacucacuggcucugcugccagagagucaaagggcuggagggaaucuucacuggcaauuggagaguuguccaggugaucaggaagaugugaaggaucaucuagauagcucacugugugaucagggaccaggauagagaccucuuagucucuacagaggagacagguacacaccuuuacuucuggaugcucuuccccagcuccagacugccuaccaagcccaugccauuuccugucagcuccuuuucuguugccuuaucaggauggaugucacugcuuacauccugggaaggugcaaaggucuggauacucgaccccaauauuggagaagucuguggggaggugaaaaaucuuggggguccauugggaaucaucucaaaauccuggucaggaaaagaaucacacacuuccugugauuugaaguuaaaucccaugggacucuggguaccacuggcccagaacucuuggcuugaagauuagugaugugacuuggggaugaagguuugucccccaaggauaccauugaguggguauugucccccagggaacugagaaagauggggugaguccuugaggauguugccaggguugguggauggguaccgugaguaguucugaagacagucguaggcuacgauagggugauggagguuaugaggggcaggaggaguugagagcagaguucacaauaggugaagugguagugugagauacaguagauaagccauuaacagucucaucccuacccagacuuugcccuugcccuugcugggggaaguucaugggagacuuuuuaguguguuaguauagaggcccuuuccccuagaaaggagaggauuucagucccgaggcaccuggugcaggaggagagccaguaaagcaaaaauggucuuuugccuccaguuugccaggaagaugcucgaaucucucuuggcugcaccugacuccaguacucaaggcuaacgagaggcugaggugagcccaucugacucuacuuagacuguauuuuaaacaaaaauagcagcaacuauaaaauauaaccuggacuuuuccauuuuacaugaugauuuucagggauaacuauuuguacugugguuuucaauugccuucuuucucagcaucuaucuaccuaccuaucuaucuuucuaucuaucuaucuguaguguguguauguguguguguguguguguguguguguguguguguguguguaugugccugccuuuacuugcugagccaucuuggugacuccccaguugccuccuugaugccaagccuuuauuuaaaguuuagauauuucuucugaucauucgacucauauguguauguacucacuagaaaucucuauucagguauccuacagguaucucaaagccauaugugaugucuaugaaugauaaaaauguacuauccucucuuuauaacuggacacauccacucaguuaagcaagaaucuugugauggacuccaagcgacuacccgcuuugcaaaucucuaguuaaucacgugcuagcacuucuagucuccuuuaaauuccauuaggaaaguucacuccucucuauucccacucccaucaccccaguuuagcuuuuagcugagagcugcaaccaacugucaagcucugugacaguuuuaauuauuuugaacccaaucgucacagucacuaaccucugaucauaccagucugugaauaugaacuuacucggaaaugaaauaaaaaugccuuuauauuugcaaagcccugcugauuuguuccccuggacaacuugcuuuguuuuaauggagugugaugguugggaugcucaagguuagaagcuugguucuuaguaugagagagagcuggaucuugaaugguuuuuccaugugugugcauguuguccuaaggggaacugaagccauuuucaagggaugucuucaucgguucuuacagaaagggcugugcuaacuggagucugacacugcacuauugucuagauuucugacugaccguaccgucucuggccaccccacaaagucauacagcagcuaucaguuagcugcucaucugauaccuuagcaaauacuuuagguaacuuagagauaaaacaagguucuuuagguuaaccuguuccagccuguuguugguuggccuugcuuugggaucuguggcaaggcagcacacaaugaagugagaacauggagagcaacagagccccucauuucgugguuggcaagcaggaauaagaagagaccaggaccucacaguccccucacacugcccaaaccuaagaugccaccucuacuaggcugcacuuuuaauuuuuuuguuuuaagauuuucauuuuaauuuaaucucuuucaucugcucuuaggaccccuuuccuccuacuagguugccucauccagcuuugaucugagagcaugugccuagucucauuguaucuugugucuuguucaguggagauccgugggaggccugcucuacucugaaggaaacucaaggacgaugggaucuugguuaaagggagguuggggagcagguacugggaagagaggacggaguggaaguugugagagggauggauugaaaacaacaaaacauaaauaagaacauuuuauuuauucauuuauuuauuuguucauuuguuuuuucgagauaggcuuucucuguauugcucugucuauccugaaacucacucuguagaccaggcuggccucgaacucagaaauuugucugccucugccucccaagugcugggauuaaaggcgugcaccaccacuaucuggcuuccuuccuuccuuccuuccuuccuuccuuccuuccuuccuuccuuccuuccuuccuuccuuccuuccugucugucugucugucugucugucugucugucugucugucuuucuuucuuucuuucuuucuuucuuucuuucuuucuuucuuucuuucuuucuuucuuucuuucuuccuuccuuccuuccuuccuuccuuccuuccuuccuuccuuccuuucuuucuuucuuucuuucuuucuuucuuucuuucauucuauguuuuuuuaaaauuuaauuuuauuguuauuagguauuuuccucguuuacauuuucuuuuuuuuuccauuuuuuauuagguauuuagcucauuuacauuuccaaugcuauaccaaaagucucccauauccacccacccccacuccccugcccacccacucccccuuuuuggcccugguguuccccuguacuggggcauauaaaguuugcaaguccaaugggccucucuuuccagugauggccgacuaggccaucuuuugauauaugugcagcuagagucaagagcuccgggguacugguuaguucauaauguuguuccaccuauaggguugcagaucccuuuagcuccuuggcuacuuucucuagcuccuccauugggagcccugugauccauccauuagcugacugugagcauccacuucuguguuugcuaggccccggcauagucucacaagagacagcuacaucuggguccuuucgauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaaaucuaaggaggggcauagaguccacacuucagucuucauucuucuugaguuucauguguuuagcaaauuauaucuuauaucuuggguauccuagguuuggggcuaauauccauuuaucagugaguacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccaguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucaauucgcauucuucuacacgauaacaaccaguugugccagcaccaauuguugaaaaugcugucuuucuuccacuggaugguuuuagcucccuugucgaagaucaagugaccauagguguguggguucauuucuggaucuucaauucuauuccauuggucuacuugucugucucuauaccaguaccaugcaguuuuuaucacaauugcucuguaguaaagcuuuaggucuggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuuccuuaauuucuuucuucagagauuugaaguuuuuaucauacagaucuuucacuuccuuaguuagagucacgccaagauauuuuauauuauuugugacuauugagaaggguguuguuucccuaauuucuuucucagccuguuuauucuuuauauagagaaaggccauugacuuguuugaguuuauuuuauauccagcuacuucaacgaagcuguuuaucagguuuaggaguucucugguagaauuuuuagggucacuuauauauacuauaauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuucucaugaauggguguuggaucuugucaaaugcuuuuucugcaucuaacgagaugaucaugugguuuuugucuuugaguuuguuuauauaauggauuacauugauggauuuucauauauuaaaccaucccugcaucccuggaauaaaaccuacuuggucaggauggaugauugcuuuaauauguucuuggauucgguuagcaagaauuuuauugaggauuuuugcaucgauauucauaagagguauuggucugaaguucucuauuuuuuuugggucuuucugugguuuagguaucagaguaauaguggcuucauaaaaugaguuggguagaguaccuucuacuucuauuuugugaaauaguuugugcagaacuggaauuagaucuucuuugaaggucugauagaacucugcacuaaacccgucugguccugggcuuuuuuuggcugggagacuauuaauaacugcuucuauuucuuuaggugauaugggacuguuuagaugguuaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuaccccucuugggugaauuugcuuccuuuuuuucuagagcuuuuagauguguugucaagcugcuaguaugugcugucucccguuuuuucuuggaggcacucagagcuaugaguuucccucuuagaaaugcuuucauugugucccauagguuugguuacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugacaggauacaugggacaauuucuauauuuuuguaucuauugaggccuguuuuuugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaacgaauguggcugcccuugcauuuggugcguagauauucagaauugagaguuccucuuggaggauuuuaccuuugaugaguaugaagugucccuccuugucuuuuuugauaacuuuggguuggaaaucgauuuuauucgauauuagauauuacuccagcuucuuucuucagaccauuuguuuggaaaacuguuuuccagucuuucacucugagguagugucugucuuuuuccgugagauggguuuccuauaagcagcagaauguuggguccucuuuguguagccagucuguaagucuaugucuuuuuauuggggaauugaguccauugauacuaagagauauuaaggaaaaguaauuguugcuuccuuuuauuuuuguuguuagaauuggcauucuguucuuguggcugucuucuuuuugguuuguugaaugauuacuuucuugguuguucuagggcgugauuuccguccuuguauugcuucuuuucuguuauuauccuuugaagggcuggauucuuggaaagauaaugugugaauuugguuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaggcuucuuguaugaucauggacaucucuuuuuuuauguuugggaaguuuucuucuauuauuuuguugaagauauuagcuggcccuuuaaguugaaaaucuucauucucaucaauuccuauuauccguagguuuggucuucucauuguguccugcauuaccuggauguuuugaguuaggauccuuuugcauuuuguauuuucuuugauuguugugccgauguucucuauggaaucuucugcaccugagauucucucuuccauuucuuguauucuguugcugaugcucgcaucuaugguuccagaucucuuuccuaggguuucuaucuccagcguugccucgcuuuggguuuucuuuauugugucuacuuccccuuuuauuucuaauaugguuuuguucauuuccaucaccuguuuggauguguuuuccuguuuuucuuuaaugauuucuaccuguuuggcuguguuuuccugcuuuucuguaagggccuguaacucuuuagcagugcucuccuguaauucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugauuucuguuaguaggauucuuacguuugccuuucgccaucugguaaucucugaagcuagcuguuuuaguugucacuguuaagagcuuguucuucaggugucucuguuagccucuauaagcagaccuggaggguagcacucuccuuaguuucagugggcagaguauucucugcaggcaagcucucuucuugcagggcagguacccagauaucugguguucgaaccagacuccuggcagaaguuguguuccacucacuagaggucuuaggaucucguguggaauccugugugggcccuugugaguguugggcaagacucugcuggcaagguagcccggggcucgaguggaguggaagggguuugugucccagaucaagcccggguagccugcuucccuauguaccgcagucucagguuccgugcgauuggauuggggcaggcgcuguguuccacucaccagaggucuuaggaucccguggggaguccagugugggcccuugcggguguugggcaagacucugcuggcaagguagcccggggcucgagccgagcggaagggccucauuuacauuuucaaugcuaucccaaaaguccgccauacccaccccuccaauccacuacccacccacucccccguuuuggcccugggguuccccuguacuggggcauauacaguuugcaaguccaaugggccucucuuugcagugauggccgacuaggccaucuuuugauacauaugcagcuagagucaauuggguauugguuaguucauaauguuguuccaccuauaggguugcaguucccuuuagcucguugaguaauuucucuagcuccuccauugggggccgugugacccauccucucgggccgggcggaccccugugcucucaccaggaaggugaucgguugucucauauucuauguuuuaaauuauguguaugcauguguuugucugugccuauauguacagagugugcaugacagagucaaguucucagaacagguugacagagucccagcagcuggaguuacacaugauuaugagcuauuuauguauguaaugggaaucaaacuuuucuccucuguuacagcagcaagugcucuuaauugcuuuccaaccucacuucuuaaaaaaaaaauaaugugugggcuggagaaauggcucagcuguuaagagcuuuuccagagguccugaguucaauucccagcaaccacaugguggcugacgaccaucuguaauggggucugauguccucuucuggugugucugaagacagcuacaguguacuaauagcauuaacuaaauaaaucuuuuuuuaaaaaaauguguauguaggugugagugcagcguguaugcacaugugagaaguacauaugugagcauaugcauguucaggccagaagagggcgcagacacccagugccugcuuuaccgcuuucaaccuuauuccuccgagacugggucggcuacggaagcuggagcucugaaacugggucugcuaccgaagcuggagcuugcuaggcugacccaaggacgaaccuagcaaaccccagggguuuuccuguuuccacauugcucccauagccuuagguugacuggaauccacugcuguguugacgauuugaguuuggguuuccguguuugcacgcaggcaagcucucuuauacacaguccuaucuccccagccucuaggguauauaucuugaagaauuuuuguuuguuugguuuguuuuuuugucagcucucuacaucacaaaguuggggaaugagcuucuuauacaggaaccuuuagggggucacugaagaagcgagcucuagcgcucagcaugccgcuaucugcuggcaagcuguggcccaaaggcugaaccaaggagcuccuccaaccuuggacuuugcaguuucuaaaaguagaaguuuaagaaauuacauuucuggaggcaggcgagauggcucagcgguuaagagcaccgacugcucuucugaagguccugaguucaaaucucagcaaccacaugguggcucacaaacauccguaaugagaucugauacccucuucuggugugucugaagacagcuacaguguacuuacauauaacaauaaauaaaucuuaaaaaaaaaaaaagaaauuacauuuccguuuugggcuggugagauggcucggcaguuaagaacauuggcuggguuuuugagguucuggguucaauucacagcaaccacuuggugacucauggccaucuauaaagggaucugaugcccucuucuggcacggaaguguacgugcagacagagcacuccuacauauaauuaacacuaacaauaauaaauaaaauuuuaaaagaauuuucuucuuuuuacuccucuucuuccucuuuacuuccccucuuccuggcacccacucuucccuccccaccucuugcuccuccuccucuuucuugccucuucuuccuaucuucuuccucucccuccuucucuuuuuccuuggcaguagggcaauugaauuuagggccuugagcaagcugaccuauacugccaauuuccucaucuucuuuuuaauuuuugagacaaauucuugcuaaauugcccagguagccuuugaaaguaugaucauccugacuccuaccuggaaucacaguccuauguugccuggcuaaucucucucugucuuucugucucugucucugucucugucucugucucugucucugucucucucucucugucuccucuuuccucucucuucucuccuucuacccacucaccucugccuaaagacucuuuucauaauaacaaaaucaaauaguccaaagugcaauccuaggaauuuauaauuuuaaaauaaaaacauugaucaaagugggcacagcagugcacaucuauaaucccagaauuugagagcugaggcaggaagaucaaggaguucaggccucgauauaauccaagaacaacgauuaacuuucuuuuguaauuuuguguacuuaccaacaguggcuuuguuacuuuccuuucuccaaacccuauuagguuggaaaaagugaugcuugagcagagucguuaaauauuucuuagaaucuaugcuugggggcuuggggagcuggugagauggcucagugguuaagagcacugacugaucuuccaaaggcccugaguucaaauccuagcaaccacauaguggcucaccaccacccguaaugagaucugacacccucuucugcugugucugaagacagcuacaacguacuuagauauaauaauaaauaaaucuuaaaauuaaagaaaccauacuggguuuuguuucuggguaggcccacuaugcgcauucugcuguaagcucucaauugugacuguccagccacuauacuaguuccuuuaauaggcuagccucuuccuauauagcaggaacuuauuacacuuucugacuuuuaguaccacuugggucuucccauuugagcaggaugguuuaauuacacuuccagccuugagaccuuuuuccuugggaaaaaccccaaguggaguuaguuauugcucauuuuucugagucuaccgugacauuauuggucuggagauaugggucaaccaguaaaagauaaagcuguuugcugcuaagucuguggacuugaauuugaucauggagacaaagaugaaggaaaaaacuacuuccaaaagucauccucucugcacauguaucauggcaugugugugugucuuugagcacacguguacauacacauacaguaaauaaauaacaaucuuuaaaaaggaguacauuuuguugcugaugggguuuuuuugguucuuuuucucuuagucugcuuguuuugauuuuuuuuuuugagagagagagagagagagagagcaugaaguuugguggguaaggagguagggaggacuugggaggugguggggaaagggaagaauaugaucaauguauuucaugaaaacaauauagauaaaagaauguauuaaugaauaaauaaaaggugauguucuauugugagagucuucugccauacauccucugccucaguuucccugagugcaaagauuagcacaugccuagccucaaccugacuuucaacaccagacauuuguccccucuugagacagaaugugucaucaucuucagaugcuuuccugagagagaaguuaaaccucuacccucugccucacuacucacuugcaguucaugcugggaacucuauaauacgggagaagcaagauggcuuuggcaggagggaguauaaaacaguguccuagagauuagccucccgauaucuaacaguccagccguuaugcauaaauuauuuuugaguugcagacuugauccuaagauuucuuacaguguuagaauuacccagagaguuaagucaauuuugaucccaaaaucugugccuuccaaacuuuauaguacaccagaaucaucaaagguccugggucuuguuuaaaacuggagugcucgguccagcuccagagggugugugugucuguguguguugcuuuuugagacaagguuucucuguguaauagaguucuggcuguccuggaacucuuuuauuuuuagacgagagacgaggcuggccuccaacucuuagugauccaccugccucugccuccaaagaacugggauuaaagguaaggacuggaguuuuugauucaguuagguugggucuuggucuaaguguuucuagcuuagaguucuagcaacuuccagguaauauugaacaccaccaucugaguccuccaugcuaauucaaugcaugcuaucucuuccuuucccuucucaggugucucauacaugggguuaauauagggauuaccacacuauaagaguuaauguuuaacccauggaaggaguuacagagacaaaguuuggagcugagacgaaaggauggaccauguagagacugccauauccagggauccaccccauaaucagcuuccaaacgcugacaccauugcauacacuagcaagauuuugcugaaaggacccagauauagcugucucuugugagacuaugccggggccuagcaaacacagaaguggaugcucacagucagcuaagggauggaucacagggcucccaauggaggagcuagagaaaguagccaaggagcuaaagggaucugcaacccuauagguggaacaacauuaugaacuaaccaguacccuggagcucuugacucuagcugcacauguaucaaaagauggccuagucggccaucacuggaaagagaggcccauuggacacgcaaacuauaugccccaguacaggggaacgccagggccaaaaaaaugggaaugaguggguagagaagugggggggaggguaugggggacuuuugggauagcauuggaaauguaauugaggaaaauauguaauaaaaauaaauaaauaaauaaaaagaguuaauguuuaagagagacugauaguguguuucgaaguuggugucagcauggacuugacaucucugucuuagccuagauuguaaucauaaaacaugcuuuacgucucaagaaauucuucccuuccuuguuuucccuucuuguucuuuuucaucuucuccagcuccuccuucucuuuugaguaagacaagguuuugugguuggcccgggcuagcugguguugcagaaaucacccuguguccaauuuccugcaugcugggcugaugugagugugccacagucgugggcaaucaagcuucuggguuguucuuccucaaacauggagcauucuuccuuaagcuuccuugaguuuccaggucguagucacauguccuacaugcuuguguuacagcuccuuaggggcacccauuucuuaguucuuguuaagucuauuuggguuugagauuaggacagaauuuucaaugauuucugaaauggcccuaccuaaacaaaugucucccaucucauauuauuucauaauugaugauuguaaaaucaacauauugaucagacugagcaugguaguacacauuuauaauaccagaacuugagaggugaaguaggaggaccaggaguucaaggccagcuuaagcuauguagcaagugugaagacauccugggucagauggauucuaacaacaaacaaacaaacaaagaagcaaaaaccucccaaaccaaaccaaagaaaacuaaauaaaaaaacagaauaaauaaauaaauaaauggguaaauaaauaaauucugaaaagcauugaaugaucuaaucccgcaauaccaacuauccagcuaagauuuaucccguguguaaagacaaaugagcacauccauuuuguuaacaugaaauuuugguuucaucuuccauaaaugguaaaauugcauuauugcgaagaauugcuuaaaaaaacaucuuguucugauuuaucaucaguaaauguuugauuugcguaccucuuuuaucuaccuagcuucccagggucagacugauuucuugggagaaacaauauagcaaaacaguagacgguuuugaaguccugaucuaaaacaaaacacauauaaaacaaaacaaaacaaaauaaauaagucaaaauggugacaaaacaaugcaaauuaaucugaaaucuguaacugggaggaacacacacaagcauccugucucauguggaacacacauuggguaaguuguuuguagagauucaacuuuauuuuuccagauggcuacacucacuuauccuaaaccauuaguugaauaaucuaucuuuuccacucugaugugaaaugacaguuauauuuuuaaaacuaggcuuucauacaagauauuuuccaaauaagcucaaccuaucccaaugacccuuaauaugcaagaccuuuauauuacuaucuuugaauuuuugaaguucuuuuaaaaguuuuuuuuuaacuuauucacuuuccaguccacucacugcccccucccagucuucccauacagcuccaacuuuagccacauc

SEQ ID NO: 4420 - RNA, 12611 nt, Mus musculus
cggaguuaguuacuccguaaguguggccggaacagaguucguccaucuaaaaagggagggguccaaggagcugaacuccuagccgccuagauuuccacuguggcucuggguacgaguggcaguuucuucuugggauuucagaaaggaaaccaaggaggaaauagguagagcgcaucgcaucgcugugggcauuagguaaguccuguuucaugaaauggcugggauuugucuuuuuucucguuaugaggaaagggaggagggaaggguuugaaaaccagcaauuuagaguuuugacucuuccaaauuggugaagaucuuggcaaauaaaugcuggcuuucagacugcaucgaucaccagcuaccuugguccauuggccaucacguuuucaaacauauuaaggagcacaguagaugcacauugaggaaagugggaauucagguuggaaucuccuugaaauucuguuucaaauuuuguuccaaguguucgugugcuuuuaucuuaucucaauucccuagaucuauuuuauaugaaaauguuuaaauuagcgagguaacagggcaccuaccuuuucucuccacuuaccucuauaaaauucaauagauuauucuagaaaaagaaaaucgaagagcauuuuuuuggcuuuguuuuguuuuuguuuuuguuuguuuguuuguuuguuuguuuuucgagaaaggguaucuuuguauaccccuggcuguccuggaacucacucuguagaccaggcuggcuuugaacucagaaauccgccugccucugcuucccaagugcugggauuaaaggugugcgccaccaccgcccggcuagaacagcuuuuuuuuaaauuacugauuuucuuuacuuaauuuuccaguuuccucacuccauuuuccaaucaagcauccagccggaaagaacuuccucuugcuuccuacagucugcauuccaaccuucagauugcuugguucucaaauugccugaggaguucccuguucacuguuguccuuuaguaguagauccagaauagugguuuaacuuaacacccuauaaugguuuccuuugguguugaacugcaacgcaaauggcuuuccguagaauucccaggcuccuuugcacuuggacccuggccgccauacuaccgaccaacuuuucuaagaauuacgacuuaacaccgagugguggcgccggcggccucacuuggccuguaaucucagcacuccgggaggcagaggcaggaggaucccuuugaguuggaggacagccaaguccagaaagcaacuuccaggacggccaggcugccuagagaaaggaucccugucucgaaaaaccaaagcggggaaagaucgacugcuucuguggugacuauggcuuccuccuguaguaaauaugacggccuucuguaguaacuucggcuucuuucccuacuuaaaacuuuuauccuagguucccuacagccaugauucaguuucuuuuuuacagugucugcauacugcuugcuaaagccggggauuugggggaucuaaucucaccucuccggggacgguauuuuuggggcgagcacuuuugucugcggagacagguccuggaugguucuuagagugauggugucccucuguacgucaucgcauacucggaaguuuuucgugagcccuuuucucugucugaaaccauuuuguuaauucacaguuuacuagcuaugugccccacaugauaaaagcuugacucugugugugauaacuggguuuuuuuuggguuuuugguuuuuuucacuauugagugaacaauugucaugugauugaaguauuucuauuccuguuugagaaaugaaacauuaguuuuaucccaagccauuagauuuuaucuuuaucuggguugaccaguaagcauuuuggauuauuuugacuaauuagaaguuauuggcugggaggugguggcgcucgccagcacuugggaggcagaggcaggcggauuucugaguuccagagcagccuggucuacagagugaguuccaggacagcuagggcuacacagagaaacccugucucgaaaaacaaaacaaaaaacaacaaagaaaaguuauugggccaugcuuggguagcgcacgucuguaguuccagaauuuggaggaguucaagccaguuuugaccacauagaguaacaggcuaacaagucacuugaccuuuuauuugcuauucucaugagguuguauauuggguagaagacagcauauugcucaaacaucugauaaccuaaugaagaaaaguaaaugcuauuucuauggcuuugauugguuaggaaauaccauucuaccuacauagcauuugcaagcaacucuuuuuuuuuuuuuuuuuuuuuuuuuuuuaaccaagugucuaaaguucuguauaaaugccugguaaguuauuguuauuugagauuucugaaucaggucucaaccaaaacuauaacuaaugcauauucaugaccucauuucacuagagaaauggacuaagagcugggacacguggcaaaagaagauagucuucuucucucaauagagugagugugcagugcagccagcagguaagaguaaacgguuucauaggcaauaaauaccaagaauugugcucuucuguguaacgcaggcuggggaauauuuagcaugggauccuaaguauggagggaaacucugaggaagugauguccaagcacagaucugaaguauauauguuugugcguacuaacagugacagaaaacugucggugguguauuagugauagagaagaacaugcaaggacuaguagggugccuuacucuaucuaggagggguugcaaaugcugggagcgugccugcugucuaugcucggguuauaaguggggaauaaccacuccaggacccccacaagcuagcuacaaaguaacauuuucuuuucuuuucuuuuuuuuuuuaauauaugucccaagacauaugauuuauuuauuaucguaucuaagcacacuguagcugucuucagacacacaagaagaggguaucagaucucauuacccgaugguugugagccaccaugugguugcuaggauuugaacucauguccucuggaagagcagucagugcucuuaaccgcugagccaucucuccaggccccaaaggaacauuuucagugucucuuuuggaaguuucuuuguuuugauuuuuauauuuuacuauuuauuguguguguggauucaaguggaaucugagucuacgcuuucuaccacgugucacugggaguguccuuagguguggcagcagcaggcgacuuucuccugagccaucuugcggugcugaccaaccaccucaguuauugagguugguguccuucauguuuguuugugguuugguuguuucuuaaacaccucaaaugcagagcugaggacugugugcaugaggcuuuauugccagaauucuaagaaugacugauccugagagcucagaggacagccucagcuggaucagcacggcuguuuuagucccagcuccuacuuggaaauuuagaaaugccacuauuccucgggagucccugcuugggcuguuacccuuuucccugagucacuuccuguucucaagcauccuuggguguaauugaccuuaccacgugauugcugaacagaguucuggcgagucccauugugcaagaaguuuucaccuuuuuuguuuguuuguuuuuuuguuuauugcuuuucgagacaggguuucccuguguagcccuggcuguccuggaacucacuuuguagacuaggcuagccucgaacucaagaaauccaccugccucugccucucaagugcugggauuaaaggcgugcgccaccaccgaccggcuuaaucuauuuuuuugaagaugcauuuauuuaauuuauaugaguauacuguacagucagacacaacagaagagggcaucggaucgcauuacagauaguuuugagccaccgugugguugcugcgaauugaacuaaggaccucuggaagagcagucagagugaucuuaaccacugagccaucucuccagcccuugcuucuuuuuguuugcuuuuaagacagguuuucucuguauccugagcuguccuggaacuaacuuugcagaccaagcuggccuagaacucacagaucuuaccugccucugccuccugagugcuggaaucaaaggugugcaugcgccauaacuguccugguaaacuuuuuugaaucauaggagaacuaggagaaaaagaaauguaaagaaauaagcugcaguuauauuguagaugaauguauugagagaggcugcuuuuguauagcagccuagacuugaucauggccuaagauuuugcugguuaaauacucuuagauauggccuugauaaaucaggucaguuuaaagaauagguagguguguguguguguguguguguguguguguguguaauuucuuuucuccccaggggauucagccuaagcccugggcauccuagauaggcaugucacugucccacgcuaagcuauaucccaagccuguguguguauguugaaaauuuaaacucuugcccuagcaacugaaaugugcuuuguuuucucuuugauauauuuaucuuuuugccagauuuccauguuaugucucugagaugcuuuuuuaaaaauguggccauuucaaaguacuuucaagcuguuaauucucaccccacagcuuucccaugugccuuuauuuaaagagcauuuaauuucuguucccacaguuaagacaugagaacaaugaagagaucuuuuauccagcguggaauuugaacauuaagcaaaggcagcuagaaacacaaugauaacauguuuauguugcagguuuaaauaguuucuaguuuugguuuuguuguuggguuuuuuuuuuuuuuguggguuuuguucuguuuuguuuuuuaaaugaagggaaaauagagagcaaguuuacccugugucuauauuuugccuggaauucauaagccauugggauuccguagguuucauuuuuuuauuuuuuggaccccagagaaacuuuagaauaaugggcaaggaaacuacaguccaggaucgcauuuugccucucccuuccccgucugguugucucagcauccucggcccucuuccucacuggaguugcauugcacuucagaaagagauggguuuagacagagaugggagccugucaaucauaucuugcucuguacaaaaaaauuaauaaugaugauaaaagagcuacuguuccugccucaguaaaagaagcaggauccaguuuagagugaguuaagaaaugaaguagcugacugugagccuccacuucuguguuugcuaggccccagcauagccucacaagagacagcuauaucuggguccuuucagcaaaaucuugcuaguguaugcaauggugucagcauuuggaggcugauuaugggauggauccccggguaugucagucucuagaugguccauccuuucaucucagcuccaaacuuugugucuguaacuccuuccauggguguuuuguucccaauuuuaagaaggggcaaaguguccacacuuuggucuucguucuucuugaguuucauguguuuugcaaauugugucuuguaccuuggguauucuaaguuucuggguuaauauccacuuaucagugaguacauaucaugugaguucuuuuguggguggguuaccucauucaggaugaugcccuccagguccauccauuugccuaggaauuucauaaauucauucuuuuuaauagcugaguaguacuccauuguguaaauguaccacauuuuuuguagccauuccucuguugagguacaucuggguucuuuccagcuucuggcuauuauaaauaaggcugcuauggacauaguggagcauguguucuucuuaccaguuggaacaucuucuggauauaugggaucacagggcccccaauggaggagcuagaaaaaguacccaaggaccugaagggaucugcaacccuauauagguggaacaauaauaugaacuaaccaguacccccagagcucgugucucuagcugcauaugaaucagaagauggccuagcaggcuaucaguggaaagagaggcccauuggacuugcaaacuuuauaugccucaguacaggggaacgccaggcccaagaagugggaguggguggguaggggagguggggaggguaugggggacuuuugggauagcauuggaaaugcaaaugaagaaaauaccuaauuaaaaaaaaagaaaugaaguagcaccaacuccugcgcaugcccagugcuugcugugagccauggaccgugcuguacaccucaaacaacuuuuuauuucccauucacagcuccugcacacagaagaaagcaggaucgccucacugugcugccuccaaguguuguccccaaauaccacugaccaaaaaguagguuugaccuaauacuccauuuaaaauagcaaauucauacuuucugccagucccuuuauuccucugucacacuauucuuucacaacauaauauuuggcacgcacugcuuauuauuuauuugaggcaggguuccguauagcccaggcugggcucagacuaacuguguugcugcggaugaccuguaaccucuggugcccugccuccucauuuccaguuacaagccucuacugccagugaguuguaaacccuuuauuuccuuuuuauucuuuucucauacaauguaucccaucugcuguuuccccucccuccacuccucccagucuccccgcuuuccccucccuccuccucccagauccagugauacucugguucccuucagaaaagagcaggcuucccaggaauaucaaccaaagaacucacaacgaggugcaaacccucacacaucaaggcuguaagaggcaagccaguaggaagaucuccagagcagacaagucaaacacagcccaccucccacaguuaggagucucacugaaaccccaggcugaacaagcauggcauguaugcagaggggcccagcgcagacccaugcaggauucauaguugcugcuuccgucuccgugagcccugguuagcugauucuguggcugugcgcuccugguguucuugaccccucuggcugcugcauuagcuccucccugugcuguucccugagcucugccuaagguugggcuucgugugacucugcaucuguucccauagcugcuaggggaagccuuucugaucauguugggcacagaucuaugagcuuagcagaguaccaugaggaaucauuucauuaagcuuuuaaauuuuauuuauuuauuuuugcaccuguccuguuucguucuacccuagaucuaucucuaggcuagccaaugucugguuccuggcaaugccaggcauggucucccucaggugugggccucaaguuaguccauaagucauuaguuggcuacucucaccaguucugagccacuuuugccccagcaugucuuucaggcaggacccgcuguaagucugaaguuagguagcuagguugaugucuuagucccuccacuggaagacuagucugguuacagaagauggccaguuucaggcuccauagccucgguuacuagguguccgcacuaggguuaccugguagguuccagggaguucccaguguacuguuuguuuccacauuguucccaaaaagauuccccagcuccacucaucucuuccaauauucucccuccccucucuccuuuaccccuucccuucccuaccggaccccuccuguucuauuccuuuccaccccagucugcccacaaauaaucucuuucccuuuacuagagagguccacgcacccuccacccccuuuuuacuuagccucccuggaugugugaauuguagcaugaucauucuuuucuuaacaaccacuaaucagugaguacagaccuaccgugcuuccuuucuugugcuggguuggcucgggguaauuuuaauuuuuuucuagugucaucaauuugccugaaauuuucauguuauauuuuuuuaacagcugaguuuuuuuuuuuuuuagauuuauuuauuuauuauauguaaguacauuguagcugucuucagacacuccagaagagggagucagaucucguuacggaugguugugagccaccaugugguugcugggauuugaacucuggaccuucggaagagcagucgggugcucuuacccacugagccaucucaccagccccugaguuuuuuuuuaauaguaaugcucuauuguguaaaauauaccacauauaguuuauccauucuccugagggacaucuagguuguguccagguuuuggcuauuuugaauacagcgacucuaugaaugaacauaauugaacaagugcacuugugguaggauagaaggucuuuuggguauaugcccaagagugguauagcuggaucuugagauagauugauuuccaauuuccugagaaacugccauauugauuugcacagcggcuguacaaguuugcacuugcaccagcaggggcggggugugcugcuugcucagcauccuugccagcgugaacugucacuucccuuacugcucuuaggcacccugacaaguguaaaguugaaucccaaaguaguuuuaaguguuucucaccauuuaggauuccucuguuuaaaagucucuguuuagagcuguaccuguuuuuaaauuggauuguuuggguuuuuuugugagauguuguuucuugaguucaguauauauuuuggauauuagcccucugucagauguggaguugguggaaaaguuuucccauucuauaggcugcugcuuuguccuauuaacgcuguucuuugccuuacagagaagccuuucaguuuuaugaagugccauuuacuaauuguugaccuuacuaccuguguuacugguguucgguuuaguaaguuaggaagcugucuucugugccaauacguugaaggcgauuccccuacuuucucuuuuaucagguucaguauaucugguuuuguguagaggucuuugagccacuuggacuuccguuuugugcagaaauauaaauauggauuuauuugcauucuucuacauuuccaguuagaccauuuguugacaaugcugucuuuucuugcccauuauguauuucuuuuuguuguuguuguuuuuguuuuuccuuugagacaggguuucucuguauagcccuggcuguccuggaacucacuuuguagaccaggcuagccuugaacccagaaaucccugccucccugggauuaaagucaugcuccaccaccgcccggcucauuaucuauuucuguccuuaucaaaauucaaguauccaugugugugcagacuuacaucugggucuuugauucagcuccauugaucuguuuguauuuaugccaauaccaugcaguuuuuauuacuacuauugcuuaguauguuuuuacagcuugagaucagggauggugauaccuccagaaguucuuuuauuguucaggauuguuugagcuaucaucuuuuuuuucccccauauggaauuacguauugucuuuugaaaggcuguaaauuuguguuggaauuuuaauaggaauuguguugaaucuguauauugcuuuugguaagauggccauuucacuguuaauccuacggauccaugagcaugagagugcuuuccaucuucugauaucuucuucaguucuucaauuucuuucuuaaaagacuuguaguuuuuuugucauacaagucuuucacuugcuuuguuaggguuaacccaaaauauuuuauguuauuuguggcuauugugaaggacguuguuucccuggucaccuucucaaucugucauuuaugcauaaguaaggcucugacuuuuucuuuuguuauuaaguuaauccuguauccagacagguguuuaucagcucuaggguugccuaguagaauuuuuggagucuuuuauguauacuguuuauucugucagcuguaaauaagaugcuuugacgucuuccuuuucuaauguguaucucugaucucccuuaguugucuuaaagcuaugucuagaacuucaaguacuguauugaauagauaagggagugagugagcagccuugccuuguuccugauuuuaguggaguugcuuugaguuucucaccauuuaauuugauguuggcuugccguaaauuggcuuuauuauaauuagguauguuccaguauccuuaaucccuccaagacuuaugaagggguguuggguuuugucaaagguguucucucuuuguuuuuggcaucuaaauagauggcugugguaauccauugauuuacaggucuacauaacguuaauauagugugugcgugugugugcuuguguggaggucaggacaaucugagaauccagucagucuuuccugccacacguaucccaggaucaaacugagcugaguggcaggcaaguuccuagugagccaucccccugccuagagacagaccauuuacugaagucacuuucucaccaugggcucucguauuggaguauauuuuaauuuuggguuauuaucuaaggcagguguuugcggaucagugcccccuggaagugagucauaggcauuguucaagaaggaagcagcuaagacaacaugaaugaacaaaaaaugaaugaacaaaugaagaaaacggcaaagacaaguggccagaaagggccgggcggaagagcccucgacagacugacccuaaagcaagacgaggcaaggccaguccagaauaccagaguggaagcuccccguguaacauacaccauccgggaugaaagugagauuagccccgagacugaggaagauggcuucccugacggauaccuagagugcaucauacgaggugaguuuuccgaacccauucuggaagaggauuuccuuuuuaaauccuucgaaagcuuggaggaaguggagcaaaaccuuucucgccagguucuggaagcgaguucccuucucgagucuucuuuggaguacaugacaaaggggacgaagcaagagaagagagaggucacgcaagagacgccuccgcugaggguuggggcgagcucauuacuugcaggcggcccugcagagaagccagagggcgguguguacuguggugucuuaucgaugcuggaguguccucaagccgggugcaagaagaagcugagggauaaaaccgcccugaggaagcacaugcuuguccacgggccccggcggcacgugugugcagaguguggcaaagccuucacggagagcucgaaacuaaagcgacauuuucuggugcacaccggagagaagccguaucagugcacguucgaaggcugugggaagcgcuucucccuggauuucaacuugcgcacccauauccgcauccacaccggggagaggcgcuuuguguguccuuuugauggcugcgagaagagcuuuauucagucaaauaaccagaagauucacauccuaacccacgcaaaggccgggaagaaaugcugaagguggagacagauuguccucaggcuggguagucuuaaugacagaggcacuggggauacacgcauuauguacagauuguuauuuguagggauagauucuauggcuaaaauaauuuugcaacucuucauuauacaguuuuaaggccucuuuugguauuccaugguauaguuccaacaggaaagucaauggugaaagcaguuucaaaagcauaacccuuacuauaugugcuauugaaggggauggggacuuuugcauacgucggaaaaucaguuauuuuuaacuaugcaguuccuaauugccuagcuuuuaccuuuagaaauaugcuucaugguaaauuugauaauccuaaagaauggccaacuuuggcaguagucaacaaaugaauacauauuucuaaauuuuauguuuugauuuuuguuuuucucauuguaccaaacuauauuaaucauaguuaaaugugaauaguuacaaaaaaguugauccaucugaagauuuuagauguuucaaaauaaaaggaaauaaaacacuagaaaugaguucaauuucuggggaaaaaaaagugcauuaagaagacaauagccagucauagugagugguucauagcacucaggaggccgaggcaggcagaucuuugaaauugaagccagccuggucagcccugccucugggcucagcuaaagcucuauagagguacccugucucaaaaaaagagagacagacacagagcacuucagaaagggugggguguggugguauacaucuuugaucccagcauccagaaaguauaggcagacagaucucagugagucugagaccaaccucguucauacacaacagcaaaugucaugucagcucagccagaacuaacaaugagacuuucccaaaggagagugacuagcauucaauauugauacaccaguccauuagggagagguugucgaagcuauuuugcuaucauuuccaggcguucucucaaacuuuugaaguccaccaguccacaaugacaaaaaaucuaccucaaacaccagaaauguaugcucuuguaguuauggaggcuaggaagccaccagucuaaaagcaaaggauugcucuccugagugguggacauucauguuaugaguuuacuacaaucaaauaguacuucccagaacgggccaagauuuuguuuccc

SEQ ID NO: 4421 - RNA, 17379 nt, Mus musculus
cacacacauccuauacauucacgaggauacguuuucucuccuucuugcuuacaggaauuagagacagcuccucccuugccuuaguguucauuuuacugaacuuacagccagacauuuuuaagauucauuaucuuaaaugucagcacagguaugaaagucugaauacugaucacaagaggaaaggcuaaucacauggccauauauguuaauguauauuuguauuauccacugccauaaagugcguucaucagaucaauuuaucaaaauugaucaagaauuuaucacaggacuguucuucucaguuguuggcuugggaauccuucauggcuggaugcucuggaaggaagaaaaagaggaacaaauaaaaacauucagcacacacacaaaaaaaaacugaauaaaagaaacacacacacacauaugugcacacacacaugugcgcaugcacacacacacuaaguucugagaagcacauaaugaagcuaaacucaacucaaucauaagcagaaacaaagccaaagaaagcccuggaggaaugggagaguguggccaugguacuccugagcuuauaccacuuuggauuuaccugcacacugauagacugucagcauccugcaauggaagggggaagagcucauauggccccuccccucucugagcauuauuggcacuuaauaauguacuugugugaauuaucucaugcuucucugagcaacccuaacuaaacucacugugucacaagacacagaagaugaaaguaaaguaggaacuagcuggggcgaggaaggggaucaguugaguuggaaggacacaagaguguguaaugaaggggcgaauaugguaagaaaaauacacauaugaaaaucaugacuauauauaucacaucuauaauccaagaacucuaggugaaugauccagaagaaucuugagauaaaggacaacuuaagcuaauggugaguuccaugccagacugaauaauauagcaguaucaccccacaaaaggagaaaaauagauggggugccauuuugagaugcggaaguaaaguuguuaugauguaugggccaaaguucaggaacaagguuggaggaugucagaguuuugagaaaauauccccauguauaggaauaagguaagcacuccaguuuaagauaggaagcugggcaaaguauuuccuuagggcagugguucucaacuugcuuaaugcugugacccuuuaauacaguuccucggguuuugaugacucacagccauaaguuuacuuucauuccuacuucauaacuaauuuugcuacauguuuguuuguuuguuuguuuguuuguuuguuuguuucaagaaaggguuucucuguguuaacagcccuggcuguccuggaacuugcucaaacucagagaucuaugugccucuaaguccgaagugcuagggguagagguguacaccaacaccaaacaaauuuugcuacugcuauaaaucauacuguaaauaucugcuauccaggauaucugauaugcacucucugaacacacuaaaagucacugacuguuauuuuacauuucuaggggccaauaaagaggcuaccaauuuuuuuaaauguuugauuuuaauauguuucuuuucaauacucaguucaacaaaagcaauucauacaaaguuucuaaaagaaaauaugcaaaucugccauugccuucccugaaauucuaaaagcaguuuggacucuugucuuuuuucuacacucauaccauaacauauguacuugcagguguucauguauaugcauuuaugugagcuccuuuuugagaaaauuaaagauuaaaaaugucaaugagaauuccugggcaucugcagagccucugauuugaaauacaaugauauggagaagugguuggaauacuguaggcuuagagccuaauuagcuuaucuugagauaacguuagccuccuggauagccauccuuugcccaccucugugguagaacuaacacuuggugauuaauagauuaaaaaaaaaaaaccuuuuggaauccauuaacucagcagaacaccaaccaaaaagcuaaaaaugucaucugguuauagcugaaaccuguaggagagagccccccaucccuguaacugccucucuggugugcccuacacugugcuuuuaaguugccuuaauuuaagacuuucuuuguucuguaaaacuauaaaacuucaugaaacugcuuccauguugaagcaugaaauuugggguaaccuagaccucuuucuuagucauggucacucaaauuuuaucaggauaaaugauucaucucuuuuaagaugagagcuguggauuguuuguuuguuggcaucaauacaaauaucuugugaauuucaaaagauuaauauuuaugcuuccauucuuuccaugagguggguacuagagugucagcagugaagaaaauggaaagggaggagucugugaugguacuuagguuuguuuuguuuuguuuuguuuuguuuuguuuuguuuuguuuuguuuuuccauacucuucuccacagcccauagcuaaacucuccagcccuuugggugcagaaaugaggaaaugaguagaagagaaacuuuggggagggagugaggcaagagccuguuagcaaccaugucuugcccuuccccauugccagcuaauccuggcauuauccuugugugggggcuaaguaauuucuggguggagcugcugccuacaaaguuaaccagugauaucucugcccaagaaggucccuugauugauauguguguuugacguguuuaccucagucccuauaacuggaaggggcugccucaagacaauaggucaaccugucagugcugaggccuucuuuguaaugguuuguucucaccugguaugacuguuuugaugauucacggaugcacaaaagggcauggagcagacuucaggaaagucugcugcuuuuauacuuuacaguuaugaccuaaacaauaucagcguggugacauagacaccucucacuccaauggggaguuucugcuacgcauuacuuacuagugcaaggccagcaagauggcccagacagugaaggcaucugccuccaagucugagaaccugaguucaaguccaaggaccaaugugguagaaggagagaacugacuucaaguuuuccucuaaccuccacaugaguguuguggggugugugugugugugugugugagagagagagagagagagagagagagagagagagaucauacacaacacacacacauacauacauacacacacacacacacagacacugugauguuuacuugguugguguuguagugcuagagauuagaaggaagccagagcuuuguacaugguaaacaaauuccuuacuacuaugcuccagccccagccccacgaugaugaguucagagaaugguuuaauaugauaauuuuauuaggggaaguaagaaagcguuauggugacauuuucagucauucuuuuaauagauaguguuucuacuuugugagccagggcuguguuuagugagaugaaauacucaguccacuacacugcugcuuccucuuuuacuuugugugaguuccacuucugcagauaugauaaagagucucccugcaucagauaagaucucaacuauaacuuuuuuauuuuaaaccuccgguuuugucgaguucagaccguaaagaugcacuggaagaacggaaaaaagcccagccguuguuuaaucacucagauuaucagcaccucuauaaaaagcuuaaaauggcaagaagauaaaauguuaagugugagcgguaauuacuucccuuuaucuugugcgccagguugcaaaccuuaccauauggguguuugugcaagguuaaauagcuauccaaacguguaaugagauacagguacuaaacuggacaaaagaugcagauagcauccaauaggccagguuggaucaaucuggccuauauccugcagaaauagaacacaaaagaggugacugacauaucuucaugguucuaauacauauauuuugagagccauuuaauaaaauuuuaaaugccuuuuauuuguuucuguguauggcaaaauacuaugagggaaggaaaaaauuuggggagaaauagacugcuaucugaaauaucauuaaaauugagagaauugggcuggagagauggcucggcagguugaaagugcugcaugcagccucauugugaauuguaacccuagagucccagaguccguggugaaaccagcuccuaaaaguuaucuaccaucacaucaacacagucuauugcaugcauguauguauguauguauguauguauguauguauauguauauaucauauaucacagucauauauauauauauauauauauauauauauauauauauauauauauauauauauccccauuguggacacaugcuugcucauguaugugcuuauacacacacacacaauuuuuaaaaugugagcugaacgaauacucgauuuguugauaucuccccuucucauacuuaaaaaugucacaauuaguuugacaaauugucagaucacucuaucugcaguuauuuuuuauagcugucaucagagacacuacaaaaacaaaugccagagacuuacuuccacagaaagucaauaaagaugacuuccagaaaagauacuuaaggagaaugaacacaaaugucaaaagaggggcaucauaagucaugagugguaagaauaaaggccaggaaaacauaagcuacacuguaagggaugggguaguaugugugcacauaugugcacauuggagcaggguggcuugaaaacaguuugugcaggacaagaaugcagaacaagagggaguagagagauagugcagcacauaagaacaugugcugcucuuacagagagcuggcauucuauucccaacacacaugcuggguagcuuacacucugggacuauggcucccagaaaugcaacacaucuggccuccucagguaccuucacucuuguacacauacccauagacaguaagacagauagauagacagacagauguacggacagacacacacauuuuuuaaauaaaauaaaucuuuaaaaagaaaccagaguguggugguugugauggcucacaucuuuaaucaaguacuuggaggcaaaggcagguaggucucugugacuucgaggccauccuggucuacaaagcaaguuccagggcagccagagcuauacagagaaacccugucuggaaaaaacaaacaaacaaacaaacaaacaaacaagcaaaaagaaaccagagcauccucagcugugauuauuugaugcaggauauguuguucucccuucccuccaacccucagacuguguuaaaugacauauguagcaagauuaaucuuaaauuagauugaaauugauauauauucuagcagcaaacuuugaacucuucgugcgaaagagaaaagauguccacaguauauuaaauaccaaggcuguguagcaaaucauaagacugcaguuuuugaagcauuuucaauauuuugacauauuuggaagcagucagagacuagauacuaaacagcaaauagugauaucagaagguucuuauuuguguuaaaugugauuauaugcuuacugcuucauuuguguguguucauuucuugcauaauagagguuaccuuuuuaauucuguauuuuuuguuuuguuuuguuuuaugugcuuugcuguuuagucuucauguaugucugugugagggugucaaucuuacaguaacagacaguugugaguugcuauuuggaugcugggaauugaacccugguccucuagaagagcaucagugcucuuaaccacugagccuucuccccagucccaggugggauuuuugcuuguucauuucuuuguguguguguguuuguuuguuuguuuguuuugagacaguuucuccaugaaacaguacuggcuguccuggaacucucuuuguagaccagacugaccuugaauucauagagaucugccucccaagggcugugauuaaagguaugugccaccacggcccagccuccgauuucuuuuuuuagugagaacacugaaaaaacaagauacagagcccagggcuggugagaaagcucauucgguaagguucuugucacacaagaaugaggacuggcguucacuccccagugcucaccugaaaacgucaggcauggugguguagaccuggaaucccagcacuggagaggcaggagcaggaagaucucuggggcuucaagaugcucccugcagauucaaugagaggcaguaucuccaaaagcaagguggaguauuacuccuuaggaagauucccaauguugccaucuaccuucugggcacacauacauacaaacaugagcaugcgcauacaagauucacacaccaaaagacuaauuaaucagugaguugacugauugauucauuuuaaaaagaaaaucuagagucucggagaacccccaugacucacauuccccacuuauuaaaaaggguccagggcagugggcaggaagaugaaagggaggaugggucugauuacccuuagcuauagcuaaggguaaucagaguugucauagaaucaucaaaggguuuucugucuuuuauuuauguaauaaaauacguucuuuacaaauagugcuuuuauuuauucuuugagaauuucacuaaugaauauaauauauugugaucacauucacccuccccauuccuggguccucccacauauaacccacaaauucauguucuuuuuucccucccucccuccccuccucuucuucccucccucccuccccuccucuucuucccucccucuuccccuuccucccuuccucucuccuccccucucuccuccccucucucccucucuucucccccccucucccucccucccucccucccucccucccucccucucgccugccugccuaucuagcuagcuagcuagcuagcuagcuauuuccauccaucuauauuccuuuaauaacaacacacuggguauaauuugcgccacucauauguucacagcugaaggacuagccacuagagcaguggcucucauccuguggguuugugaccccuuugggaaucaaaggacccuuucacaugggucucauaucagauguuuacauuacaauuuguaacaguagugaauguacaguugugaaguagcaacaaaaauaauuuuugguuggggggguggucaccaccccuugaggaacgguauuaaaggguuuuaaacacacacacacacacacacacacacacacacacacacacaauuaaaauugacucuucuuccccugacacccaucagcucucaauaacucugucguuaggggugagagguuaccugucuucucccuauccaugcuggaauauuggcuggcuuggucuuguguaggcaaccacagcugcucugagcucauguguauaucuuacacgcguucgcgaccggccaggaaagacgcaacaaaccggaaucuucugcggcaaagcuuuauugcuuacaucuucaggagccagagagcaagagagcaagaagaagaacaagagcaagaaagagaaaaagaacaagaacaagaaagcaagagagagaauggcaaaaccccgucccuuuuaaggagaauuauccuccgccuaggacguauuacucccugauuggcugcagcccaucggcccaguugucaucacgagaaaggcagaacacauggcaggaaaacugccccugcacgugugcagauuauguuuacuacuuagaacacagcugucagcgccaucuuauaauggcaaaugugagggcggcuccucacauguauaacaguccuuucuuguccgaauacauggugcugccucaguccucucuaaucucuggcucuuacagucuuuccauacccuuuucuaaugagcucuggagcaagaguauuuaauacagauguccgguguaugacugugcacuccacagacugcauugacuguuguccacuguacaaguaagcaucucugaugagcccugggaacugcacuaaucuacagguauggguauucuuauucagaaggcgauuucauccuaugucuauuucgcugauaauaguagugagcucucccaggaacuauguccucaccuaaccacaggcucuggaucagauuuacaguacaaggcauguguuuccuucugcacagucaaccuuaaaucccaucggaauuccauugguuacccaacaugggugcugggaauccaacuuggguccucuacaagagcaaugugaacucuuacccacagagcaaccuuuccaguccccgcauacuuuauuuuuacuauuuuuuuuuuuacuauuuccuaaucuucauucccaaaagagucaccaacagcaccaaaccaucaaaacauaaaugguagaaaauaguugccugaggcuuacuuaccuuuaagucagaaucauuaaugcaaaauaucaauauguacaauaggaaacacaugguacuuuuuuuuuuuugagacagggucuguacauuuuguugacuauuguggaacucacuauguagaccaggcugguuugaacuuacagaaaucugccugccucugccucugccucugccucugccucugccucugccucugccucugccucugccucugccucugccucugccucugccucugccucugccucugccucugccucugccucugccucugccucugccucugccucugccucugccucugccucugccucugccucugccuccuacauguuaguauuaaaggugugcaucacuacacccagcuauguguggcuuuugacauuguguuuuagauugcugcuguuuauuuagucaacauuagcaucugaaguuuauuucuuacucugagcaagucaaaugacuugcaaacaaagccagcauauuaaucuuaacaaugaaaaaauaaaaaaaucaacaggaucauaguggaauuaaaguaaaagucauggcaugguuaauucagucacaaaucagacgaagagaugaacuaguuaugcuaaccaaacucacaaggccuucuaagguacaauuuacaggcuagagaaauaccacagugggcaagaauauuuguugugaaaagcauaauacugagaucagaucacaacacucauauaaaaaugagagaauggccaugcacaugccuguaaucccaauucugugggguuugacaugagaggaucacuagggcuugcuggacaccagccuaguuuccgagucagugagcaacccugccucaaaggaacauaaaagaaagcgucagaguaggacacuuguuguccugcccuggccucugugaacuugcaaguaggcaugaacacaacauguguccaacacgauacucauacacuuacauacauacacauacacauacaugaaacacacaaaauuauuaagaaaaauaaucuaaaccacaucugcuucuccucuauugcugugaaaaacaaaacugacuaaaaccaacuuggggaggaaaggguuuauuuagcuugcauggugucccaauuacauccaucacugugggaagccaggaacucaauccaggaguaaagaacugaagcagagaucaugagggaauacugccaaccaacuugcuccccauugcuugcuuagcucucccuuuuuauacaaccaggaauaccuguccagggcugagaccacacacaguagacuauaucaaucacuagucaagaaaauggucucacagucuugccuaugugccaaucuuuuuuuuucuuuucuauuuuuauuuuuuauuagauauuuuccuuauuuauauucaaauacuaucccaaaaguucccuauacccucccuccgccaugcuccccuacccacccacucccacuucuuggcccuggcauuccccuguacuggggcauauaaaguuugcaagaccaaggggccucucuucccaaugauggccgacuaggccauccucugcuacauaugcagcuagagacacgagcucugggggguacugguuaguucauauuguuguuccaccuauaggguugcagacccuucagcuccuugaaugcuuucucuagcuccuccauugggggcccuguguuccauccuauacaugacugugaacauccacuucuguauuuuccaggcacuguuaaacaaugaauuuauaaaauucuugggcaaauggauguaucuggaggauaucauccuuagugagguaacccaaucacaaaagaagucacuugauauacacucacugguaagugguuauuagcccagaaacuuacaauacccaagauacaauuugcaaaacacaagaaaaucaagaagaaggaagaccaaaguguggauacuuuauuccuccuuggaauagggaacaaaacacccauggaaggaguuuaagagacaaaguuuggagcuaagacaaaaggauggaccauucagagacuaccccacccaggaauccaacccauaaucagccaccaaacccagacacuauugcauauuccuaugcgucaaucuaauggaagcauuuucuggauugagguuccuucucagacaacacuagcuuuugucaacuuaauaaaaauaaaacaaaaaccccagcagaauccaauucacaggaggcugacuacacauggcuucauuugggaguugggaagggagacuucuuugaauagcuuuacuuguaggcacugugaaguauacaacuccuuucucuguaaucccuccuuagggaaucuuacuuaauccuuaaucguguauuuuuugaaucccggcugccuguguugaucaaauauuuaaucuaguccucaagcacucuucaaagauccagacuuccguuuuaguuguuauuguuaacauuuauuuuuauuuagaggaggaggaguggaggaaugccacaugugugguacuuguggagcccgaaagagaguguaggacugcuucagagcugacguuaaggaaauugugagcuaaccagugcagauccucagaacuaaacuagggucuccuugaagagcagagcaacaagcacucuuagugguugagccaucucuccuucuccaccaccuuuuuucagacuucuuauucaagaauuuucuugaagcaucacgcaucuucauuuauauccaauuuauaaugcaauugugagcaacaguucucacuuuguguguguguguacguguacgugugcgugugcgugugugugugugugugugugcgcgcgcgcgcgcgugcgcacauaaaagagaguguaaguccaaaugccugaggaagccagguaacucuagaucuggaguuacaugugaucaugagccacaugacauggguucugggaaccaguuuggguccucuguaaaagaaaugcuuguucguacccagcuggugguggagccacaugccuuuaaacugggcaauugagaggcagaaccaaguggauaucugaguuugaggccagccuggucuacauagagagucccagccagggcuucaaugaaacccuuucuauauauauauauauaaaagaaaagaaaagaaaaacaaaaaaagaagcacaaguuuucuuauuauguauacaauguucugucugcagguaugccugcaggccagaaaaggacaccagaugucaucacagaugguugugagccaccaugugguugcugggaauugaacucacggccucugaaagagcagaccucuaagccaccucucuagccccaaagcacaauucuuuuuuuaagggauuuuuuuauuuauuuauuuacauuucgaauguguuccccuuuccaggucuccccuucuggaaacccccuagcccaucuccccucucccugcugcuacgaggguacuuccccucccccaccuacccacccacuccuuccuuccugcccugacauuccccuacacugcagcaucaaacacucucuggcccgagggccucuccucccacugauguccaacaaggccauccucugccauaugugcagcuggagccaugggucccuccauguauauauacucuuugguuggugguccaguccccgggagcuccaagggguucugaccaguugacacuguugcucccccaucccccuugagaaagagcacacauucuuaauauugagcuuucucucuuaucuuuuugauuuaaucccccacaccccugccuuuccaccuuuucaugaguggcuagcucacacuuccuucugagacuaccuuagcucuucucaauuccuagaguuuucucccucuaauagugaauuggcaaauguuuccuccucaacauuuuugcccgaauaucaccaucucuacaagucucaccuugaccaauuuaaaauugcuacucacuuuaaucuucguuaugcuuauacauacuguuuuuuuucuauagcacuuaugacccaauuaucauauaauuuacuguuuuagcuucaggcaucaagauuuccuuuuccauuggaaaaagauaucaccauuagcauaaaaauucccagaggacgggauauuuguggaaauaugcuaagcucuuugucuuacucaggguuucuauuccugcacaaacaucauggccaagaagcaaguuggggaggaaaggguuuauucagcuuacauuuccacacugcuguucaucaccaaaggaagucaggacuggaacucaagcaggucaggaggcaggagcugaugcagaggccauggagggguguuacuuaccagcuuguuuccccuggcuugcucagcuugccuucuuauagaacccaaggcuaccccccacccagggauggcaccacccagaauaggcccucccacccuugaucacuaauugggaaaaugccuuacagcuggaucuccugcaggcauuuccucaagggaggcuccuuucucugugaugauuucagcuuaugucaaguugacacacaaaaccagccaguaguacacucagugucugauucuaaguucauagacugaugucugaugcccucuagucacuuuauuauuauuauuauuauuauuauuauuauuauuauuauuauuucuuuugguuguagugaaaacuacacucaauuaaugacaaugucauauuacuuuaugaacuuuccuucugggcaagagacuuagccaccuggccauuccucaugcacuguacugucauuucccauacaaauaccccuucaaaauacaucaaagccacacaaggugaugcauaccuguaaucccaguuuacaggaagcugaggcaggaggauugucaaugugcucauauuaaguccaugucuuaagucuauaagaaaaauugaaaaaaacuguacuauauuucacuuuaacauauucgguggcacaucuaguuacaucauucuaucauaacuuucagagucugguuauugaaaucagauuguuuuauuaucguauuuaguaucuccacagcaguaaguguugguuuuuagaaguaaccucuaaacaugucucauacuuguguugcuuaaacgugucuuggcuccuuucugcuucaagcugacgccaaugcuccuugaugcacugugcucacaaugccuuucauaagcacacuucugccucagcacacaucucaucucagucccuccuuugacacccuuuccucucacuagaaagguaaaguccacauaaauguuuuguucucuaaauauugagcaauuggacuaaaucacuugaugcuaauucacacacagacauuugauccuguucuuuuugguuugguuugguuuuugguuuuugguuuuugguuuuuccagaaaggguuucucuguguagccuuggcuguccuggaacucacucuguagaccaggcuagccucgaacucagaaaaucaccugccucuaccuccuaagugcugggaguaaaggugugcgccaccacgccuggccuugauccuguucuaaaguaauucuuuuuccuccaaagccgggcauaggauuucugguucuccugacuucuugcauggaucccauucaaacacuaucccuccaacuaaugcauugcugagauguaacaggcuuuaacuaaaucuuuaccgaacagauuuaaaacaaaaacaaaacacauuugugggguugagucucucucaguaguuccuuuugcuccacagaacaccuaguguuucaguggucugaagauccugcuguacagugagggacuaccucacaacauaacauaugcauguauucugcaccuugaugcuuuuauuacugcuuuugaagaggagucagcaaguaagugccuuacuucuguggcacagcugacauuccauagauacuuuugacaaauguuuaagccagagaugguuuugauucuguuauauggauuuccugauccuuuauauaugauauuuuauuucuuuaugagcuuauuuuacucuaucuucgguccucaaauucagugaccaaagaaauauaauggcauaagcacagaauaugaccucuguguggaagaauuccauuuccacuccauauauuuauagugcuuagugaaagaugagacuguucccugacucugucucuuuaguuaucaaccaaccaagugauucugagcuucugcuuuuuccugaauggcuuuuucuugaauuucuaguugugcccucugaucuaauuaguauaauuagccuuggacacacaauagacagcaagaaacaaagaagcucacagaauucgaccucaaaagccugccucucuuucacacccuccaagggucuaaguguucagcuguccucagagcucauagccuuuaauccucacaucaaucuccguguucuauccaauuccagcugcugucuagugaagagcagcaaagguugggaagaguugugggaacguggacgucaccccauucauucucauuagucagcgcgggagacacagauuucccuaacauugccaagagugcuccugcagugucugaaugauuuauuguuggacaucauauugcuccucaaaagguggcuaaaagaacugagaaaaaucaugggcacguuuuaucucaaacauuauguaaucucaucaccuguccacugaagugaggggcaagcaugcagaaggcagacuagcacagaacgcuuugccuggcugcggggaggagcgggcuuuuuccucaguagugucacuaugauguuauguccaugcucuuaaaaauaaccccucacuuacuuucauguaagcaacguugaaaucaucaggacagaugggaacacacacacacgaagugggagggagaccuuguuagaaagagaaaagcaaaaagcagaagcagagaggguaagaaauggucaugaaauaaaaauaugaucaaaauauauauauauauauacauggaugagauaugaaaaacaccauaauaaaacccauuaucauguauaaugaauauaugugaauauuaaguuaagaaaaggcuuuucugcugcgcuguggugacacaugcccuuaauccccacacucuagaggcagaggcagggggaucccugaguuugaggccagcauggucuacagagugaguucuaggucagccaaagucacacaggaaaauacugucuugaaaaaccaauauuaaauaauaauaaauaguaaaauaaaacaaagagauuggguuguuuuuuuguuuuuguuuuuuuuuuuauuuugguuuguuuuuuugguuuuucgaggcaggguuucucuguauaguccuggcuguccuggaacucacucaccaggcuggccucgaacucagaaauccaucugccucugucucccaaguacugggauuaaaggcgugcgccaccacgcccggcaaaauuguuucuuaaaaaucaaguuaaaaagauguaaaaaguugaggcacuacaccagcaucaaaggucaaaugguaaauuuauaaaagcaauugacaaaacuauuagaugaaaugauccaugcucugucugucccucaggagaccugagggacuaacuuucuaagaacaauauucaagacuuccugaaccuggcccaacauaaccucaugccucauaacccacaaugccacaugcagccacauaugccauccugcaauucauacuugaggaacagggcagcaggccacuauaccuuagggucaccuccgaagcuuuuaaaaguuauauagagaauagcugaagcucacuaaaggaccucuaguuuccaagugguccacacccacccacccccaccaaggucacaagcuggccucagacucacuguacagucaaaaauaacuuagaaucucuggucuuccuagcuccugcucucucuugcuggaauugcaggcaugcacagacucaaaccuagagccuccugucugcuaaggaaacacgguaccaaacaaucuauauccucagcccuccauguguuugccaugcacaagauaugcggagagcuguguuuucuucacagugaacuuucuguccucuagcucggugucccucagucuggauuuuacaaugccuuucaguuuguucuccaggcuuaacuucagcacugcuuucuucuaaacauaccuauaggcuuccaacuuuuuaugaaauccucucuaagacagagguaaaugaacugagagccaugagccaagccuugcugggaccagccuugugaagagcuguccugaugugucacccuuggcuaccaagauucaaguguguucaucuguucccuucucuugauaguucucacuaacaauaacgggcaugaagaauacccuaucacaguuugaucuucauggcaaauuuccuuuucucugcaacacauagcaccucaccauucugucuuagucccacaugugggcucugucugggcugaugguugaguuucuaagacauuuaagggaugacuaaguucauguggcagcaugcucacaguccugcauaggucugugacagaaggguucccagggccaagagaggaaguggacacaagacccuaacccugaagcuaucuccaauugauaaucacacacaaaagaaaacuuaaguuuuuauagaugacuguauucuaaugagaaagagagagagagagagagagagggagagagagaagagaguuuggauauggggggaguugagaagggucauggaggaguuggagggaggacaaaccauaaucagaauauauuguaugaaaaagucuauuuuucauacaaaaagaaaaaaaaacaggguauauuguugcaguaaaucuccucccaaauaugccccagcaaugaaaacacaacacaguuaauaugauuacaugcugugcuccuagauugggcagaucaacugcuacacuaccaucuuccaugucuaugagaccccuuagaacuugcaguuucuccaggccauaugcuucugcuccgcuuuucuucuuccuucuccucuguguccucucccucuuccauuuu

SEQ ID NO: 4422 - RNA, 102052 nt, Mus musculus
auuaaagcuaaaguauuuuauuaauaauuuauugucaguaagaaaggcuggcuaaugauaguuuucaguaaaaaccuuuacaagaccauugcaucacaaauauacagacacuauaaaaaccgugucguggugguuuugguucuaaacagguaugcagaagguccccuucacacuuuccaauaaugaaaaauguuuauaauccuaauacagcaacccauuuaauaagacauguccaguaacaggucguccacaccccauauguacagcuacacuggaccgaaaugugucaaugaaaugucauacuucagaggaaaagaacagcgugaaacccugguuacaucagaaaaucagaugcuaggcaaacgacgcuaacaccaccacacagauccagcagaaaacaaaaacacgaggcguccugaaaaccuagguaaaaacuaggagaggggggaaaacaaacaaacaaacaaaaaaaaacaaaaaaucaaaucuguacauaaaauuuacacaaagaaagcaaaaauuaaaauaaucggaucuauauaaauacaugaaucaugcuaacaagacgacaggaccgauuuccguuucaucauuuuaacagagacaaaucuaaauacgaaaagaugcucaggggaugggacaggggaugaaaacccggucgauuacagucaguuaggacgcuggaaauggcuaacaugucaagaggcuugugacuccgugcagccacgccuaccgcggcucaccgagaagcggcccagacggcugcaaaagaacaacacaacggcggaugucaccgauagcaucucuagguucaugaaaguccaggcacuuuggggaggaguuugagcgucacacuuccguaugcugcugggaaucuagcggagggaucgucaccucuucgaaguggccgucguccccgcucucguagucgcucaucaugaccucagacuccacuucacagcacgcugacacgucggagcaggaagccgucgaggcguacacggacaugggcauguuuucuauggugggcgcuucgaaguuucuuugauacccugggggguaggggguguaggguucucuacauggacuguucucgccagcgccuuguuucugagguucggacauaucggcgggguagaaauugggcagguacugauucagguugaaccucugccgacuccgggaggaagaucccaagcuaccugcugcaggcaugucccuggguggguguauggacucgaacuggucgcugaacucuggaggcaaugguggcaguucaucgggugcagggaaguccucugguggggguggaaagucacuuucaaugucauaacccccaggguaauagucaguaucgauggcguuuggaucagccgaguagagggguguguguucgucaauagccucguaauuggggaacucuuguaugucuggcagagggacacuuggcauccagucugauguaucccagugguacccuugguagaaaaggaaacacgauuucaguuuguuuuucuuagcuucuaugccucggggagagagcucagaguaucagacacaagacacagaaguaggugugcauucaucccaaggccaucgcucugcaaaccccgccccgacauagugacuauuuccggaaugugaacuugaggguuuuaguacauaucugacauucaaggcaauagaguuccgacagaagcagcugaaccacuuaaaauacaugcagguuuuuuguuuuguuuuguuuuuucuuuuuucaaacaauccuaaccacgcuucaacuuuccuucuguaacugcugacccuguuccauaggaaggcgguauaggaaguuaguaaggggcuuucaagcagaaggucucuacugggggaaauuccaaacaucacugggcuuugugcugccugccauccaaaaaaauacuaauuaaggcaaaucuaaaaguaauaaaaauagcuuuuaacauguuaaacucaguaguaaaggcagcagugguuucauuggccucauuagcaaugaauagaacaaugaauuauuuuaauaccggcuaugcagcaaaccaagucccuaaaucaaacaaaauauaaccaaauaauuaugauaagcuauaacaaucuuuguuaccauuuuaaaguaugaaaagccccccccccccuuuugguuguuguuuucuuuaaagaaaaccaaggccuaacuuaaggguaggaguuucuguuuugagagccgggagaagguuaggugauccguauuacaaggcagugcacaacaagggguuuaguuacugcgguagcaucaagcacccggagaagccugucaucauugggucgagcuuucccaaugacuuccagugauuauuaauggacagcuggcaugcauaagucaccucuugguuugcugaggucaggagcagccaaagauucuuuugguggcagaguagaaagaaaaagaaaacagcgauaauuaaaauugacagacuuggcugagacggcaacccagauaagcacaugguacaauauacggacacgcugucuuuaccucacucucggcuaaugaucacaaaugagaaaaucaugaugcucaaacuagaugggauauggcaagaaggaggagauaagagaugauaaacuagcggcuuugcuguguguuuccagggaaacaccugacucaggaaaauaauaaacuacagauacugauaaaaaauuauguauuauuaaauaaauuaauaaauuaauugguuacuuaagggacgaucuaaaaacacgagcuacacgauuuacacacacaguagcgcacagaagaaccuucaaaaguauaaguucggagaaacuggugucacacgcucacagacaaccaaaaguugaccauaucccaacaccuuacucacguucacuaugauuuuucuauuuauacuguuaacccuuucucuagugagcucccgaauuaacuacuucauggcauggccucuucccaucaacucugcaacuguacucucucucccagugaccacauuacacacagaccucuggccccaaguccaaggaaauggauagaaagcacucaggaccaugggaugcucagccugacuaagguucagauugguuuucuauaagaaaugagacgaaaaucucacagauuauugaagacaacgugggucaagugugacccagcagguaugucaccaucacgguaagaggagcagucagucacaguagaacuguggccacuuuucuaaacagaaugcucucuaugcaucccauaaugcucucuaugcaucccauaaugucuuugaaaacgaugacaaugaaguaauuucugacaaacuaauagcugacugauaccucugauaggaguuuaaauaaaaguggaaaagacagauguuucaaaaauaugaauaaaaggaguauuuagggaaguuaucucuggugcuuuuuauacaucuucuauaauacacuaaauuccuuuauaaacgaggccuggcaaccuuuguuggacacuaagcauuugaaaacccucuaaacuuaggugcauuucccacuuuaaauucacuucagauaagaagauaaaucaguagaaaucacauggagaagacuuuaaauuucugcuucuuuaaacuuaucaauauuuaagauauugggaugucauccuguuucagcuaaaacuggguagacaaaauauggauaacauucugaugcucaaagugaaaacacgguacuuuuaagaaaacagaucgaguccuuuaguagcugugaccacugaagucauacuuguccuccucgcaaucuagcagauaaccuugccucuuccaccuaaaugcgccugcugauguguccuugcagaagagucgugcguguuuacugcugaugcugugugaauacaguuugcacuucucuguuuucacggguggcgggggcaggggccacagugcauaugcauguauguguguauguacaugugugcgugugcauguaugugugcauguggaagcccacgguggacaccgagacucauccucagccucccuuucuccagcuuaagcuugccucggccuuccaaggcaggaauuaucaguagaucaccgagccacugauuuauaugagucccugggaucugagcgaugguccucacaccugugugccaagcacuuuauccacugggccaucucucuaacccugugugugugcucuugauggucuagguaaguuauuugaaagcacugauuuucacauuaggagauuucuagauccaaaucaacuggacauuuauucaaaacaaaaguccucaggcucaauacaauuacucagucagaaacuggagcuggaaaccagccccgagucuucaacagugacccauaacauuuaaaacaaguaacgaaaagacaugcauacagauauuuucacaaugcacuaguacugugaacauaaaugucccaaaaugaaagccaccaaaccuucccaauggaugaacuauuuuaauaacaggacaauaggcagacucacaccaccccacuuacagucacugcaaaccacagacagaaaacacagacacuuauaccuucuuuauucaccgugucaacgacagcguugacaagguguauuacagucacuauggaagcuuguaaaaaggcacaaaaggagccaguuaggaaaauccuucguuaguagaaaacagugcauuaaguaaaauucuguaacucaaugcaauuucuccccuaaacugugaaauuugagacuagauaauuaugcgagacccuugcacuaacuaaccaauuaguuacaggucucaagacacuucaaaucaagcuauaggcuugccacuauuagucaaaugaaugaaauaaccaaguuuuaguaaaagcuagggaaaaagcuuuagucaaguauuuuauacaauuacaguuauggaguauaucaggggggaaagcaauucagguuugcgucuccuggacaaacgguuauauguucaaggaacugguuguuugaaaauaaggaaaucuagggagacauaacuacaagacugguugugucccuguugcuuagcguguauuucucaugucgcagacgccguacagauugcuuuugucauuugcauauuauuucaaaguaccaacaucaacauaaacgugcauguuaacuggguacacucuaauccugagaccuaaaggcuauuuaaccuaaugcacagaagaaaacagaacaagacaagcuuccugcugucacuaaggcucucaugagggggaaauggagcgaucgcccugcauuagcugggugagcugaggggacaggaauggccugucacagggagcugucccagcugugacccuguagagcuuggcauucuggccacagguucugaacagggaaugaaacgaggccuuaauuaccaggaacgugagugaauuuuaggcacgggagaaagaaggaaaccaaaacuucccucagagcuuucagcgaggcaggccccauugacaccugaacuucagcccugagacguagcagccucccaaacuacagaaccacacgagacccgucugugcucucuugagccgucaaguguauggcuagccacuaaaaaggcguagaaaacugccgaugaaaugauuugugcagacguggcucagacuugaagucugugacugaaaaugacugacugacugauguagggauuaaaaccacggacagucccucgcaggcuuugccucacgcugcuacugcccaaaaauuagcuuuguaacuaaucugacaaugacuucuccagagugucugaauguuguuaagaaugggauuucaacaauuuaaauuaaaaaaaaaaaaagaaaaugaaaaauuauugacaaaauucuuaaaugcauuuuuugaacagcacugaacuuacaagggccaaagcauaaaucauuuaagcuggcaaaacaaacauuuuaggauugaaacuaaggggaaaaauaauccugguuuguucuugaugauaagcaauaauaaauccauauucucuacacaagaauaaacaagggugugcuauaaguaaugaaaaacaugcuugaaaucuuugaagaacaggacauauuuauagucaucuuuaauaaagaaaagggcucugcaaauuuuuauagauaagcagaugcagagauccauagauguagucauuauaaauuuuacaucacucuggucauggaucauguuauuuuggaagugguaguuauuagcaaguuucuucuuuccaaugauaaaauacucuuaauguguaaacacacugcaguuuuacacgaggagaaaaauuaaaaauggagcccauacuaucugagauucaauuauuuccagucgauaaccacuaucguggggcugguaauuuuuuuguacacgugcuaauacggcgaagcugucuaucagcgccauccacccugggggacaccagauacacagaacuggagucauagaacccgcugccaaaccuucuuuguuagaaauauaauccgacuuacuagccgucucuuaaacucugcucucagucagaacgcucugauccaaaugggagcuggggcagcggugguuggggaagagacaaauaaaaccuuguaauaccgaagguaugaccaaaggugaacauuucagauuucuacauaucuuuucucagagggugcugcauguuaugagugugcacugcaugguucagaaaaacuguuacagagaucuugaaaaaaaacccacaaagcuuccguaacacuuacuguuaugcaaaaaaaauauaaauaauaccagaguagccaaacaaggaaaauuaacauuuuuuuucuuuccuauuacuauaguuaaaacaacucuugaguaagaacauuguuuuauuugacaguaccccugugcaugcuaggcaagugcccuaugccugagcuaccuuuaaauauuuccccuguguagguucaugcaaguacucauaccacaguguucauuuacaccaagggggacaugggacguuuucauacuuaauuagggaacccggacuaucuaugauauaugugucuauacguugguauacagccuaaggaaugacagcagcacuucaaagcggccacagcguccaaggucagcaucugaaaccuaccauugucaucacaggacucugacuggaaggagcuaagcgacugcaccucagacaggcucucccgggcacuguauggcugggagggcuuuuccuccaggggcuucuuagagagacagggauccagaucuaccacuuuagcugaaagggagagauggcagguaaacaggugaguuccaaguucccuaagacucauggcuacacuuaguaagaaaguaucugcccuuacacgugaggggaggaggggcgagcuagaggagcauccuagaaacaaaacaauagaaagaucugcacauaugcucaacagauucaacaaauaauaaaaaaauuaguaucuuagugaccccaccauuauuucucuuguuauaauaaaacacccccaaaucaaaguugauaguguguaucaguuacaucuagaauauuaauuagaacauaacuagaucuaauugaauaaaaauaauuuaaagcucccaauccccagccaguaacuggaauaugcaaaugaguuuucaggaccauuucagauuggaaagcgucauucauccucauccccgcaaaccaccucagccaagaccacuucugcagcacuggcgagauagaaaacaucacacccuuaccgucguagucaaagucccagcuaggcuucuguauggagucgcugucugagggcgaguuggaaggcggcgguggaggcaaguuuggagcuacgcugcacacagccacggcuuuucgaugcccgugcauagacucgggguugaaggugcugaauucuggaugcucugggaucgcggagccuucgaaggaauugcggucaagguuguuucucgagucgcuuggaaugcugggaguguaggaaaugggacggaccggcaccuggggcgggaugucggaguaaauguucuuguucagcuuugaaucaaaauaaggucucugcaagaaagccgugguuggccccaaacguuugucuucagguucagccuggcgcuucuucuuccgacugaucaucuuccggcagaggacgaacaccaucacuaguaagacuaucccagcuauaaacacaauaauaccuauucccucggccaguccgauguuccacgggguggacacguagugguugggagaggcauccucacagugcuucccucuguacuccuggcugcaguuacagugauaggagccguguguguucucgcaaagggccccguuccgacagggguucccagcacacucaucgaugucacucugacaucugccaagaaggaagagagaccuuuguaguacaugucagacggcaccuguccuagaauucuucaggaugaacacuaaacauacccauccuucauaagagaugccaaaacaaagcuggaugggaaacaaucagaaaagauccaaaaaacgggaaccagaagaggccuuuuguggguuaguuacauggucauaggcugaauggguaucugggagccaaccacaucaagcaaauaucuagcugcauuuuuccagaauuaauagauaacugaaccaguucaauagguuaaaacauaggcuguucucagguuucacaaucaagcuaucauuuauuuagcaauuuuaaaagcuaagguacauuuuaacaaguggugugugcugcaaacccuucuccuaggccagguugaauuucagugaaaaugguccuuuugggauuaggacgguccuggaagacccaugagggaauagaaaaugcucuccauuuaaaaacgcgauuccuucgggaauuagaguccucuucuuacgcaugucaacauuacagaauagaccacagacaguuccuucugcuuuucuaaacaggggcacggggaccauguggcuuuuacacugccacccucgcuucugaggcucuuucccauuugaaaaaaaaaucauuuacuugcaaauuaugaacaauuauaauaaagacugaacacugauauauucuugauaaauacacugauuaaaauuggggaaauccacaaauguaccagggccgcagaacuaagggcaaaauucaggauuauaaugacuccaaggacaaaacaauauagaauaaauacaggcagaccgcaccagcagccuaaugagaccgaggggugcucuccugaauguccuuugcuaagcauuuaaauauuacguguacccaguagcucugcuguugagacagggucuuaucauuauggcuugauaugguuggcucccaaaucagccuaugaccauguaacuaauccacaaaaggccucuucugguucccauuuuuggauauuuucugagugcucugauugugcuagaacuauguagaccaugcuggccugaaaaacucagauccaccggccucuaccaacugagugcugggagugugucugagccugauuucaguaacuuuugaagcgacagcaucugaaacuaguuucuuaugcauuuuuuuccucaagauauauagguguauguuuuuugagagaucuaaaugucuaaauaucuaaauccuaaccaccucuuaggcuuauucuggggauuaguauacuuaauauaauaauaauuaguauaguuacuguaacugcccagcaagaugcuggaucuauguugguacaaaacacugugugagaaaccaugaugaguaccuucgaaaaucaggaagaaaugcaaccagcuuacaagcauuugcuacuugccaaagacccacacuggcaagcuuugauccagucuuuugucucaagacuuucgucuguacaucauaaaaaaugccaaugagaaucaccauguccugaccggaugcggugugaguuaacggucggcacacuguggaaagggcgcagcagaaacgaagcuucaaagaaaccauuuaccuuucuccccuaaagccugagucacacugacagacagcaccauccaaacugucaaaacacguuccaccauucuuacagggaucaucuuugcaguacggacuaagcugacaucuaaauaaggaaaaacacaugcaaaaagaaaaaaacaaaacaagcccucaugaguucacugcgaguaaaaaacagacagcauuaacaacgaagaacacgguggcccaauccggugcagaauuccaugcuuuaacauuucaccuuacaagucacuaagaaagagauacaaacauaccucugaccaguguacagcccccugcacuggcacacaaagccgccguugucuaccaugcacguuccuccguagaggcagggguuggaggagcacggguugacgcucaccucacagaacgucccuacguacaacgcgcugcacuugcaguaauaaccuacaccguggaaaagaagagaagacccagucacucagugaccgcaagggguuuuacgugcuuacagcuuuaugcuuaagugaagauacggugccccaacagcuacgaaacggaguaaacuucccauucucuccaggugcagaguuaucuauggggucgaaaccucuuuucuaaaauacugggaccagaaaugaucccgacucuggaggguugugggguuuuuugguugguuguuuuguuguuguuguuguuguuugauuuguuuuuguuuuuuagguuuaggaguauuuccuauagauuuuacagcuggaacauuucuaaacuggaaaucugauauucaaaugcuucuaacccuagaaauuuaaauaauacauuggggaggggggucagaaaguucuggauuugggagccuuuuagaauuauuuuaaaauuuaguauguuuugugacuagauuuagguaaugaaaauuauauauggcuggugggucaaauggaaagggcaggagaaaaaggcccauugguggacauacacuaagcaacagcagucaacaacgguuuuacuaccaaaaguaguguucccagcgaugugcaguuagagacgcggcaagauaguuuacuuuucucccuuaaaagcugggccuggcccuagccuaucuuuggccacggucacugcugcaggaggaaaagaacacgguaaacauugguuccugagaccagaccaacguuauggcacaagccacugaguccugaccaccuuaucggugaccaagacaagaagcgaugacaucacugaaugggagccggcaaaccaaugcuauuugggaguugccuacaugugcaugcaugugguaccaucugagcgacugcagcuucacgaagccuaccuccaguaggcgagggauugcaaacgccuccauucugacaggggcugcuggagcagucuucuguggcggucaauaagcauccaugagauagguccacccacucuucgaugugcgcguaggcucuuggcuuguuguucagaggcaacuccugcccguucaaauaaauagaauccaugcagccccugaagccacuggccaccugggcgccucgcccaugcuuugucccuugcuggcggagguggccaccaaaaaagacguaguuguccagguugaggguuuucagagcccccggggcugugcccgaagcgguguggacuucauccagaaccagcuuggcguaauugcccuccacuuccagggacaccgcgugccacugcccgucguugaccugaaugcucuggacggagacaaucccagggccgcuuccgcagucaaauuuguacugcagucuuccgguaugaaucuacaacagaauaaauaucguucacacugaucgcauaugaccuucagcaucagucugugcaaaaucuacauacaagagggggauguuuagugaacaaagguaaaaagaauacaagcuugcaucuaggugccacaaacucauucaucuacgacaugaauaauaaaaauggaucguccgggggcucccaaaugccaaguguacauccaaaacuaacagggacguggcuaguuauuaacugcuaacugaacccacacagcauacacacacgcacacaacacacacaauaccauguagaauuuccauuuaaacugccaagauuagcaagguauaacgaagagacuugaauguuagcugucacgugucucaaggaauaucaaaaguaaauuucuaggcuaccgggcggggagcagaaagaauuuuugacuacacccaagugucaacguuauccaggcacuugagaugcgcaguaaaaccaccuuucuuaguuuguuuuuagacgggacagucaggacacgagauagaauuuaaguuucauggugucccuugcucugaggucacaggaugcagaagccauaccuccaggaugcuguagucagucccucgcgcguacaugacaaccgcgugggaggaguagguucucagacgcaugcucagcuucaucuccagucuguucucauucuccagcaggcgguacuucacgaagcuguuucccgugaaaguuauagaugagcucccuacggauaucagaaaaaaguuccaucagcaccaaacuuaagccuggcaucgacagugaccaugaucgaucgaucgccuucccuccccagaggcugacuuugguuuguuuuugcuuuuguuuuuuuaaauuuaaaaucgcagcaauggggaaaguguccauuggcuuucacagacagcauagcacacacagcugacucuccacgaggaagagacuaagagcucuguauuagagaaauaaagucuaaaauaauaacaaaaauaaacauaaaaauguuccacguaaguuauuaguaggcaauuugagggaaagcaaaaaaaaggaauguagccucaaggugauuaggcaaaaccugucagacaaaaccacaaaacaauccccacuccuccaagaagaugaaaauccuaucagccuccggaaaugaaaauuaaguuaugcagaacugacuaaauaaaaauucaauuucaaagugacaaaaggcacauuuaacaaaauagaaguccaauacuaagaagcaagggcagauugcaauagaaagcauauuaauuauaauacccaggguucuacucauucagaaacagacagcccaagagggcagacacacuauaggaaaugcuagcaccaacuaauuagcagagugauuccuucuuccauaagcagccaaaaacauuaaaaaaguuaaguauuucaauuccacuagggagaaaguauggauuuuaauugaaagcuuucaaaacagauaaaagagaauaagacaggagaccuuuauguaugccuggaagaaauggaaacuauuuguucaacuacuuuggaaacuaauaugacaguauaccuuaaaaaauaaaauuaaauguauuuaauuuuugacaguagauucuaguuuuggaauaucauaaacaaaaggagaaaagcaccaaccuauaaagaugaacuugaaaggauauuuuagcaggaaagauacauucuuuaacaggacacauauagaauggugacuaaaucuggguccaguuauuaaggacagugaggauuacacacacacacaaugggcuuggaacaugucuuuaaugagcuaaguaggggaauaaagcaagaaacugaggacuguaggagaaaucaggcaaaagaggauuagagggaaacaagaaacuaugaagccccacaguuuaugcagucauugccccacccccuagccccaccccugcuccgggcggggcggaggcgggccagggcgggggcguggcauggccgaggcaggggcggggcugagggcucaacagcucagugagguccugcucucugcccaucgcuccccuuaccucgauauaaccugcacauaauucuuucucuaauaaugaaaguuaucaaagcacugccgagggugguuuccuggaauuccugggaguguuuaccugggcauuuaccgaagccgcccccggggcacacgcagcuauacuucuccucucggggauccgcgacacacucagaucccgcgggacagggguuaucuucacacccaugguggacaggugggcaugucccgucuuuauuuagaaaagcaagaggaagagaagagagaacacaggaauuaggaaaaugaucacuacuguuguucccauucauucauucauucauucauuuuuuugugaguguuggaggguugacucucaggccuccuguaugcuagacuggcacucauccacugacuuacaguaucuccaguccccuuuucauuguuucauuuugagaugagauaucauuaugcugcccaggcugaccuggacucacuauguagccuaggcugguuuugaacuuccaaacagaugagaccauaggccuggccauaaaaucaucaucaucaucaucaccaccaccaccaccaccaucaucaucaucaucaccaucaccaucaucaucaucuccuccuccuccuccuccuccuccuccuaacauuuuaaaguuuaauguguauguguguuuuaccugcauguaugucuauguacuaccuggauaccugacaccaucaucaucaucaucaucaccaucaccaucaucaucaucuccuccuccuccuccuaccauuuuaaaguuuaauauguauguguguuuuaccugcauguaugucuauguacuaccuggguaccugacacccuugaagucacaagagggcaucccuggaucugaaguuacagauggucaugagccacuaugugggugccggaaaucaaaccuaaggcucauggaagaguagcccaguggguucuuaacugcuaagccccccaccacagucuuucacgcucuucuccacauacauaggcgcuauuaccuuugcagagacacacugcuguucuguggugucggggagucacgaaacucagucuggccgugcugugaguggacaugacguuuucauccacagacaccuucucaucacagaacuuccacgggcaauccagccccgcacagagcuucuggaacacuuccaggauccucacgccaaugauuuccucaacguccgucacggaagaauuaaucuuaugcagaaguugcuuuguugaaacgugggugccgccugaccucucgacaaagaguaagacguccagaugcgaaugggguucggagggcugcaggcugacgaucuguaugucauucuuccggacgcccaggauguugcguagggcucgcuggaaguugcgccaguagucaccaacaaacuccuccggggugagauucgcgaagcgaauggcgacggugugguucagcaucuccugggucacuuguuggaugugcacggugaugucggccaccguggugaauuucccaucugucacgcugacauugagaagguacuggccuauguccagcuuucugugugcaaucagcuugccccccgugcuggagacagagaacaggccauccauguggggauccagacuguacaucaaggugucauacacguccuggucgguggcguggaucuuuccuaugaccccaccugaguauuccucuccaaaggcggugaugaaaaucuccagcggcaagauggcaggaggguggaugcuuuccucgaucacccugaugucaaugugugucauggaugacagcugaggcuuuccgcugucagccaccugcaaagacagaagucgccucuggcguuacugcaaucuccuaauaaaaaugcaugacgcaguacacuucuggucugcccauauaucaacugcuaggcauucauuucuugucaugaagcccagugaggaaaaggacaacuguuuugucccuuacucauauggacacugagucacacuccugcuugggaaggaguagcccaagugccaccaagacaaaaccagacgugagcucaaaaaacaaaccauauucuuuuuugguuuucuguaagguaugaguaaacuaucuaaauauacaaagauggccaccuguggaugcucucugugcacccaagggaaaccaugaagacuuugauugguaccuuaacaugcagaagguaaugguccuucacuuuccucuugaucgucgccgcugucaggaggaccccaugcugauucaccucaaaggcguuuucaucauuuccacucacaauagugaagaagaaggggggaccguugugggaagaguccuugucugucacuaccagcuucagaacgcugaaacccacggguuuguucuccuguguaauaaacaaagaacaaaaagcuaucaagacagggacaugugaggcuuccugguaaauauacagacaauuaaaccucauuucuagugcaucaaggaugagagaagacagguagagaggcaugagggaucggagagggcaggaacauggggacugagagaaguaacaggagaaaggagaucugagaagagucaagggaauggaacagcauccauggggguuagugagggaccagagagggcggggguggaccagugcaguagaagacaggauuaggaaaagcucuuccuaguuacuccuaggacagugagaauaucuuuccuaaaccaaagcacagcauggagugaggaaugcugagcugaguccuacaaacgucucuucuauacuaagacuccucuacaguuuucuagaaaacgggucuggaaaggaaagcuacgucccaugagugucuggagucagucagagauggaggaggccgcacacccucugagugcgccacccauuuaccuggaugaugacacuguaguugucucuggagaagaggggagcguugucauugacaucggagacaucgauauucaccgugguuguguugacucuggguggauugccguugucggcagcuugcaccgugaguguauaaccugagaucuuugccacgggaaagagagaacaacacgugucaccugaauggugccaaucaaccgggaaccacugacgucauuugucugggcaaauuccuaaaauuaaaauaacaacucccaaccagugagggagugggugcacuauucucaacagagaugguuaucagcaagaagcagauucucugcucucucccauuacaugcaggucuuauuaaaguacuugaucuugaaacucuuacaguucuauuagaauacaaagacaaauuaugcaaaugaccagaggaaaccaaacggcugaccuagcucaaaggcuguuacuuugguaaucccacagggagcgccuucaacaaaggcuaaagcuuagagagcaggggguagagacuugagcugcgucucaccccgagugcagacucauuuccagcaucucaagacgugccaggucaccgucaccuucaauuucacacuugggcuauacuuagccauuuaaaucccucaagguaauaucuguggccacuugcaaaagaaaucaagucaagugagacagcuucccuguuagggcaguucccuguuacaguaucuuuagagcgagcacugggcugggaagauggcuaaguccuggagcaccguucugugggacaucagucuagccaaugcucgaccacacagccuugagaacuccaucaggccacaguggauacaaggguguuaaaagagcuagguucuuuagugacaauuacuaaauuucagucaaguaugguugacacguccccgaguuuucaacacgcagaaaucagaggcaaggguacugugaauuugaguccagcgugaacuauauagcaagauccauguuuuaaaaaaaaaaaaaaucacauuuugcucuggaguacaauagauucuucugagccuaagagucaagucucccagacucuuaagaacaugccacucaaaaauaguaagccaguggaagagcuggcuccgccccucucgagcggaaguguggcccacuucucccuggcucuccacaguugauggcuucuggcaaggcugcugaucucuuguggggcuggacacuagggguuuguccagugaguacaugggcaacacaaggcugacuaccuggguuuugguuuuuuugguuauuuuuggugggagaaggggagcagacaugagaggacggagaguugaguuugggaaguaagugcgguuuagggugcaugaugugagauucccaaauaaugaaggaaaaaagacagucacaauaaaacaaacaacaacaaacaaacaaacaaacaucaaccaaacaaacaaacaaaaacaacuaaccaaacaaaaagagcccccggagagccaaaacuuuaacugacuuucaaauacuucuauccuggcucagcauauccuaagaugaugguucuacccuuuguggacuucacauuauaccaagcagguaugaacuggaagcuuuagugcuuugauaccaauuuaagucccccuuuuaggcuuaccguuucccggucuaggggcuucgucacuuucacuucuccucugacagggucaauugugaacggacuucccugguuccccucuauaauggaguaguggauguggcuguuugaggggccaucagcaucgucagccauaaucuaggaaacaacagagguaauaacagcuagcuuauuuacggcaguuacuuaaaagccacugauugacugagcaaagagcuuccugguuugcagugugaagacucaaacauccucacgggacaggacagugugagugcucuagccuugagccauguccucugacugaaaaacugcaacccucuaacauaguuacaagagaaccaguuuaagaaugagagugacuuuacuaaucgccccuucaagaucccacagaggcagcugcgagggaagagacgcaccguaaugacaggcugcucgagagccgcauccucacugaccacggugguguaggugucuuggcugaacacggggcuguuaucguugaugucugugacguugauguucacggucgccacaucacucaacgaaggcgugccuccaucaguggcuuccacggucagguaauacucgugggagcuuucauaauccaggcucucaaugauaaauauggccccuguauggacagacagaauuacguccagcccgcggcagcuccauuucuuauuacaacgaugaugccucuuaacacauguaguucucaaugcaaaaaguaacuuguacgucuucagcuuuaauucaguaauuuaaaauuaugauuuuuuuuuacccacccaacaucccuguuuauuuccuuuauuuguaucauauuccugguggcauuagucaauaacgcucucucugcuuuaaaugacuauaaugcuuuuuaaaugaugguggcucuuaguccuucuuugaugugguucacuacagacuuuaauacuuuuuuuaaaaaaauucaacucagugccuuucgguucccuucuuauuguuauuauugucaugaauguucuucugaaaagaauacaguaacucuccucuuagucuuguuaaauaucccccugagaauggaacccugggaucgugcgugcuucuaauacuagcaguugggaggcuggggcaggaagaauaagcacauaagaucugucuggacaacacaccgaggucugguuucaauaaacaauuaaagaaauaaaauaagaucccucacugauuuaacaauacuuguaagaagacucugcucgaccuagucuauccuacuugaaaggauaauugcuccaagagucccacagauauuauauaagacaaucaaauuacauuaaaagucaugagacaccuauucuucaucagaaauagucacacaccacuaagcacagccugaaagaguuacuuuuuacaauguucugagagugcaaaagcauuuagaccacaggcuaccaguauuagucacaaagcaggaguuaguaaugguugaucuuuaacgcugcuggcuccuuggaacccaaucuccuuuuacucguguauguaaugaguaaagaagucaacugauggaauuaauagauguucaguauaggaacaucugucaggaggaagccacuccauguaccuuugauaucaggguuaaaugaguaauuauacaauguuaucaccacuaagcauccugccuuggcacaccugggugcacuggcugguuuugugugucaacuugacacaagcuggaguuaucacagagaaaggagccucccuugaggaaaugccuccaugagauccagcagcagggcauuuucucagggggugaucaaggaggggagggcccauuaugagugguugcuuccuuaggcaucccuuggguucuguaagagagcaggcugagcaagccagggauagcaagccaguaaggaacaucccuccauggccucugcaucagcuccugcuuccugaccugccugaguuccagcccugacuuccuuuggugaugaacagcaacauggaaaguguaagcugaauaaacccuuuccuccccaacuugcuucuuggucaugauguuugugcaugaauagaaacccugaguaagacacugggacacugagugagagcuaauaguuuuccaaauuggcuuguaauguaugauggauaugcuagaaaguagguauuaugcaggaucagagucugacggcuuccuaacuguuuuuaauccaacucaggaagagaaagcaagccugaguguuaccucuucagaacacccaccgaccacauugcaggaagugccaggcagcccucaguauggaacaagggcuuccucacuucacagggaggguuaccugucuuagaaucgaugcugaauuuuccauguucauuuccacuuaugauggcguaggugauuuccgcguuggccucgauaucccgacuugcggcguacaccuggagaaccuccgucccaaugacaauguccucagacacacuggcgccauauucacgguacucaaacacuggcggguugucguuuauauccaaaacagacacaaccaccgugccaguagcugucaaucuccuuggcaauccuugguccacugcuuucaaagugagaguauagacugccuguaguucccuguccaaaugcuuuuccaacuggauaauuccagaucucucauuaauggagaacugcccgucagcggauucgaccagcgaguaggaaaucuuccgauucaauccuggcaaagcaugaaauaauccuaucagguuucguggcaaguacccccgcuuccagcucccccuagguccaccccugcacaccuuccaccucuauaugcuuuuuuuucuuuucuuuuauaaauaacuuaccaacuccagcauguacugcccuguaaucacugggauagaaucauccaucaaaacuguacaugaacaaccagggaccacacccuuaagaaaaauggcucuccccacuucagaagccaaucauugucgauaccuucucagcuaggaagaggggccccugagucccgaaucccugauaugcuggaaucuauaagacuuacuaaaaugaaaucuauuuguuaauuaacuucacccaacaaagaauuauuaagguugacuuuuaaaaauaucuucaauaucaaugaaucaagaaguuauuuuauccucuauuaucauaauguuugaauguauauacuuauuuucuucacaaauacguuugaaaauguauacaacuuuaggaauguaguacuagcuuguuauguuccugcgaugcuguaacuuccuuaacagcacuacugauuuauucccaaaaaggcacuuugaggggcuggggauaaaacugguacaaagcuuagccaagcauaugaaagacgcagguucaaaccccaacaugggugucggggcgugucaguuaauggcgucaacaacaacaccuuagagacgccgcagcuacacugcagcaggaaguuuacugcauguaacugucaagacuuuaaacacuuaugaaaaauggcuuaaguuuaucaugacugcaacaaggccaaguuccaccaugugcgugaggaaaagaggucaauggggcguguuccaucacggggaacucaaagccuucugcacaccccacggacagagcaucuccaucccucaggauaccugugucugcaucaguggccugcacucuggucagcggugucccaggcucuguguucucgaauaccgugaugguguagggcuccgcggugaacucaggagcauuaucguucacaucuucuaacgugagcacaauagccgccugacaggaccucccaccuccguccguggccuugacuagaagauuauaaacugcuuguuccucacgaucaaggagggcuaguguucucaguucaccuagagacggcagaaacagauggggacacuggagacuuagggcaaucauccaucacuuucuuuuucuucuacaauuacaaaaucugaacaacucuuauuuggagaaaaauaauaacaacuaccuuaccaaguucaaaagcuuaaagaugaagaaaauguggaucguuuucauuauagaaaacgccaaauugcaaauuuaggcaacacgccaucaaauuaaagaaguaacguuuagauacacccugaguauuuuuuuuucaaagaaaacauauuaauuucucaaucuuaaagaccaaguaggugauaacuauggcugccuguuuuuuuaucucuucccaacuuuuacacauuaaguugccguuuagauuucuaagaugccauuuccacagcaucagaauaaaauuuaaaagagaaaaaauguaauuuccaguuuuguacaugaucucaugucucccacacagaggaaauacacuauuaaguuagucccaaauuccauccuuaccugugucuggauucaguuuaaacuucucugcaccugaaccaaauaaaguguaaguaaucucugcguuggaccggauauccgcgucuguggcagagaccugcaugaccagcuucccgggaagggcgucuucaggaaugguaucagaauacgaggucuacaaggcauuaaacaacaccguuaacaacaggagcauucagugucagcagugaaggccgaggggaugauggaaaagacaucaucucauucuggccguggaaaccaugggaaaggacuggaguuaaauacucagagagcuuuuaaagugauuguucuuauaaaacagaugugggaacaaggaagagccuuguaacagguaccagccccacauccgugacuccagccugacacguaacccucaggauauaaaauaugauaugcuacugaacugcuucauacuucauucaaauucuuaugagaaaaugugauguaauagcccgaauuuauguaaaaacuagaggaaauauauaucuguuacauuacauuuacuuaauuugaggagcagggauugacuguguacaaccaacuguuccucacagagaauuaaauaacugcaauuacaaguuaaacggucuucaugggaugggggaaaaaaaaacccagggcuagguaaggcucaggcaugucugcuuccucuuucuucacaucugucugaauccucacacuguuggacacucgguuccaguuccaauuaucacauuagccaugccauaaauagaacacauaagggaaagagauuaugcuccuuuuacacuuacuuccuaagaugaauuuaauguagggaagauauaguuuaggguucacaaaacuggguacuuuguaacagugauuauuucaaguggugauguccccaaauuaaaguauuaucuagggcagaguugguauaauuaaaaauuaugaaugggguaagauuuaauauagauacuauacauauaucaaaauauguauauaaaaacauauaaauauaucuauauuuuauauaauauacauauauaaaaaagaagagauacauagcccacugcugucauuaaauacucccauuaaaaaacacaaauacauguugggauuaacuguuccccucucagaagugcugccuccccugacaaugagguuugguuuacuucucugagaacaugugguaauucuccggucucagccaaaacacugggagagcaggugugcaccacuuggccugguuccccuucccggggcuaagacuuccucuacugcuggcaaacaaaaaaaaaaaaaaccaaaaaaaacaaaaaaacccaaaaagucuccccacaccugccuucagucgucacaggcugaggcccugcaguuauacuccuggucauaaacuacuagggcuaaaccagcucggccgcugggugguuuuuuaucacccaguuccagucagccaucucgccugcugcaguuccauggccccaggcucaacugagcccagcaguagcagcagucauuucaaucaccucaugguuucucuggaaugaacaaccaaugccuuaaaauagugcauuaacacacguguacuguacaaguagaagcugcuggccagauguuuccccaucccuaaaacaacuguaucggcaaaugaagagauuaucuucauagaaagcuuccagaguguuuuuuagggucagacacuggguguguguaagagaccccuuauuuuccaauauuuuagaccaaaguucuugaccgacauagcaugcugccaagucauggugacgcuuucucaaauccugcccaugugacgcuucuccacuucaacuugguaagcaaugguaacacaaaacaugggggagcuaugacaccucaaaagcugcccccuggaaagaugaggagacuuacaucugugacguaccauccuaaggggaacacgccuaccuucucacagacuggacuguugucguuggcaucgagaacuuugacuucaacucuagcuuuggaagagaaggucccgucuguugcugugacagucagaagguaacuauccuuuuguucccugucgaggggcuucuucacauacacccuccagucacucugcacauuuuccacagcaaacugucccaaggcauccccuccuaggaaguuaaggaaagaaggugacugccaaagcugcuggacuacaaagugaauuuuguaaccacgggaaaaauacauuauacaaagaauguauggcauugccguuuaugagggauuaagacuauuuaaaggaugauuaaaauugauacauacuuuucuuuugcuuuucguacuaugguuuuguauuuuaagcuggucucuaauuuacagaauccuccugccucagcuccuuugagcuagaauuacaaguguguccuuacacauauuacuacauauuaacuuuaaaaaaacaaaaacaaaaauaaaccaaagcagccguaauaugucuacucaaauaugagauuaaagaaugucaacuuuaaaaagccauaauguagcuugcaaugcaucuuuagaucacauuuacaagacuaaguauaaaguauaagaauaaaucuuagaggauucuaggccgaaacagcuuugcuuaaaguccuuuaaguucggcuuacacgugauuucuacucauuuuagacaacuaaaaucacaucaaccucccagaugcauaaguccacacuuagcauguuacauguaauauggauucaucuuauacugaaccccgagcauuuuaccugugaugaaguaugacaccugucuguugaucucuucagugucagcaucggucgugcuuaagauggcgaucacgccaccuggagggucauccucacucaccgucccuuuguaaaucucagccgugaaucucggcgggcugucguugacgucagugacgguaacacccacaauggcgguggaagacagcugcaccuucucaccgugauccgacgcgaccacuuuaaucugguaacuggcccucucuucguggucaagcuccuugagaguuguaauccagccuguuuccauguuaauggcaaaagauucgaugaugucugcgucuugggauuggucuaggcuguacaugacuuggccguuggcuccugagucuaggucagaugcucugaucuggaugacccugcuucccccuggcagguuuucaacaauaaaugccucauagggacuggacuccaaaacugggcuguuaucauuagcaucuuucaccuggauacugacaucuauagaagccaccaccucguagucaucaagagugcaucuggccaggauggaaaacugauaccacuuaguggucucauggucaaggcucuucuccaguuucagucucccauucugccugucgaucacaaagaacucaucucgauuacucucaggaguauugccuuugacaaggauguaaagaacagccccgccauguucuacccggaugaggucaauuucuguuccaaugggcgugucuucugagaugguauagguauaaaagggcucugagaaccuaggaagcugcacuucugguggaaguauuuuaauauagacaggaacgacagacucucugggcggagacccgcuauccacggcucuaacgaagaaagugaagaacucauucucuaaaccuauuaaacuuuccuuuguaguaaucaggccagucagcuuguugauuuccaaguucuccuugacacuuucagaauccgccucaauggcguaggugacgucagcauucgaucccucaucagcgucacucgcaaagaccuugacgaccgacgucccuuuggcagcgcuggacccgauguucaccucguacuugguugagcgaaacugaggugcguugucauugucgucugugaggaugacauugacggugcagaaagcaaccuuccccccagcauccuuagccaucaagcggaucgagaucacuuucuccgccggugucucucggucaaguuucuccaaagugaaaaucugcccucugucauucacauaaaaccugucuuuggcaaagucauuuacaaugugguaaguuacguggcuguaaaugccagaaucucugucagaugccuucacuuggaccaccagggugugcaagggagcguuuucagcuagcuccacuucguauucguucuggugaaaaacaggacugugcaaauucccucccaucacaguuacguuaacccgagccgagcuccggaaaaccccaucagacaccgaaacguugaggcuguagaacggcuucaggguguggcggcggagguuggagagcgugauaauucccguuucccugucgaugaugaagcuuuuaugaucauugccagacagaauagaguacucuaacuugucuaggucugagcugucugcaucgcaggcucucacacacaucacgaaaugcccgugugcggcgugcucgcugauucuggcuucauaaaccuguuguucaaacagagguggguuaucauugaggucggugacagccacagugacgaccacgucacugcucagggcgggcaucccuccaucaacagcccuuacgaagauccugugcugcugggacuguucguaauccaaagcucucacuagugaaaugagccccguguuacuaucuaugugaaaaugaucgugacuuuugcugugauuuccaaucagcugguaggaaauuccucuguuugguuccgagucggaaucuguggcucgaacuugaaggacagguguuccaauuacagaugcuucagacaggguuguggaguaagauggcugcacaaacacaggaggguuaucauugaugucuuccacuaugaugucaacaaacacuucagcgugagcgcccgucagggagucaguugcccgcacgcuuagcuuauaggcugggugggacucaaaauccaguggugcuaugacguuuaccaccccaguguugaaguuaauaguaaacugacuaaaagggucuccguccgugauacuguagaacacuuucagcccuucugggcuguuggcuuggauauggaccacugggcugugcaucuggauguucucugggaucucagcgcuauagaaagccuuuucaaacacgggcauggcuuuguucaugacagugaugggaaccagaacuucugcagagaaagcuggacucccuccguccuuggcgaccacugugacaagguauucuuuauuuaaagugucaugcucaaacugcuucuucagagaaaugucgccagaagguccaaucuggaaguggucaugaugcuccuuaagguaguaguguaugucaccauuucugccacugucucugucaauggcaguaacauagcgaaugacguggcccaccucagcauccaccuucaccacagcguaguagggaagguuaacaaacacuggagcauuaucauucuggucuucgacggugacuuucaccacgacgugggccaccgcugacggcucguguuccuuagucaccucuaccaccacgucaaacgucuccuguugcucacggucaaacgguaucccggugguggacaacacgcccgacguguggcugauuuuaaaucugcggucuggguugaggaugcgguaaaacaaaggcucauugaguggguucccuaucgcagugaugacagcuaacguucuggcuuccguggaguucucuuucacaacugcggaguaggcgucuuggguaaacuugaggggacucucucugcucuccuuuacguugauuuucacggaggccaugcuugugaaccugccgucggaggcgcggacggucagcucauagcggcuucguagcugagucguguucuguauugcgauggugccagucuugugguccauugagaacuucuccccaauguugccuucagugauggaguacaugaccugggagaaugccuuggagucagcgucuguggcguucaccgugaugacguucacgccucuguaugucggcaggagaagagacacuucguacagugacuuagagaagacaggggggcagucguugaugucgaucacgugcacagucacauucgcugcguacucggcgaacagacgaggaguccccaugucgugcacuuggacggugaagugaaaagcauguguuucuucauaguccagacucagcacuguacggauggcgccggugguggggucaauagcaaaauaguugugcacggacggcucaacgauuugauagacgagcagagcauuggauucccugucagcauccgucgcucgaaucaccagcggaacguuccugucugucagcaccacacuguugacggaggcugacucgcugaugaauccugaauauucugccugcgugaaaacgggcggguugucguucucaucccgcacgugcaccaccaccguuguguugguggacaaaccggccauguuggucccuugcacugucaaugaauacaugggcaguguuucaaaauccaaggcucucugagugaugaugcuuccggaaugcggguuaauguuaaaugcgucgcccauguuuccgucucuuauuucauacaucacugaugacuggcugugugcagagaccaucccaacaaaacuuccaauccugauggcuucacuaaucuccgcagaguacucuuuggaugugaacuugggagaggcauugucagcaacagugacagcgauacgcacggaggucaucucgcucauagguggaucgccuuugucuguagcuuuuaccauuaaaucauaaucuacuuggugacuucgguccaauucucuggcaguuuuuauagagcccaagauggggucaauuguaaaagaauuuccaauguuuccuggaagggcaagaaaaaaaagagucagagaaagaaaccuauuagaaaagagccaaggacaacagaaauagcagagaaacagauauuuaaaacuuacacccugaauuuaaauagaaacgaaggggauaucaacaguugaaugagacauucaauuuauuucauuuuuuuuuaacccauuuaaaccguucagaauuuuggcugucaaauaugaaaagcaaagaacagaaaaaaauauauuguuuugugacuaacgccaaaauccucucucugcucaagugaaaaauguguuguagagacacauggcucuccucucaaaauagcaauucagugaaggauuuuccaacagaaugcugaaacucucugcuggaugcaucaauuuuaucagcacucaccacuuuacaagggaaaugcuuaauucacuaagaaauuuuacgcugggguuucagagggcuucuucuuguaagaaguuaggggaccgagaaaccguuuucuguagcccaccgcccuucaggaguuuucaagauguccacaaucuucccuucuuaaccuuugccaagcugacuugaucauguaguuggugacucucaaggaggagagauuuugcuuccagggggacaucuggcagagcucggcugucaacagcacuuggaaaggaggaagcguugcuuccacguagaugauagcagccaagagacaaaaacagcguacgccacgcacaacggccucccucggcaacaaggagcuguuuuugcuuccaaacaucaaccgcacugaugcagccgagaagcaaaccgcuacgacagaugggcuuugcuggcaucuccucggaccuucccaggcucgcccacgcagauucaauauuucccccaaugccucaaaaccccacaggguugggaguuccuaagagaccaguacguacucuccauguucuggauggagcaugggcaccguggggggucucuggggucuaccccuucgcugauccucgcuaucccuuuucugucuuauaaacaaacaucuauacaucacucccagaacgggauccguucuucccugaugaacacuugguggcccagcucgggucaccugccacuaaacuuuucucacacuccucuugcuggguuuuacuaccagcaaacuacuuagugucaucugucaagccaaggauuagcaagccccucucucuccccauuaagaguaagcauuuccucuaccaaauucauuuccuucauuaaauacauuuuccaaaaauccaugacauuuuuuuuuccugaggccagacauagucugguuuucauuagguuggccuggcucuguguccaagccccaaggcagugccuggguuugaaacagggaggaggccccgggcuucuccagacccugaaggucugggcugagccuuggcccaggccucugccaggcugcgcagacgcuaauuuccggccugucugcauuugggagaaucucgauucuagguuauccuugugccucaggcaaucaccaaaccucagaugcuucucuuuguccaccugcccauuacucucaccuuccaaacuugacuggcuggguaggaggugacaccugcucaccuuucuggcaagugacucuaucucucccaagcccccuagcuuucugaggccuguuuuggaaagcagcccauuuggcaacauucauauccauucuucuacacguguuuaucuuauuuuuccacagggaaaucuuauuugcucguaaaaguucauacauccuaggccucaaauguagaagugaaucaacauguuuaguguugcaagacaguguucaagagaugcacuaguguucucagccccggucagaucaacauccucucugcucuccucuccucucaugccagggaccccauauuccacccuguucuccccuaacgcagccuucccuggcuauucucagaaucucucuagucacccauuuacucuuucauuuuucguucaccagaaugccccugccugaagacuccuccuuccuucccuauccgguguggcuacguuuauuuuuuauuauacacguguucucuuuccuccuauuuauuuauuuuugcuuucucucuuguuucuguauagcugagacucaacacgaaaacacuauguaucgcaggcgggacuccuacucaccauccuccggccucagccucccaagggcuaugcuuaaaggcguaugccaucauacccagcuccugaauccucucuauaguauggauaacauucuuacuaugcauacacaaugugaaguucaacaauaucaucaucugcgguauccuagcauugaauuaacaggacccugagcccguugcugacauaaaaaugguaaaaacaggagcccagagugauuugguauuuggaccucacacagguacguaucgggcacaaagcuucagccguacagaaggcagcccagacugccgacugcggaaagugagcgacuggcaacagguacguuuuucucagcccugaaauaacagguuugcccccugagaaugggaauaagguagugggcgaacuuuguaccagggugggguugacauuuaugcuugcugaagugguauaacuuuaaauuauagucuugcauuucaacgggggaguuaucuggacuaacaagucaauguugcccuuaagucgugacuauuuacuagauagcacagaaaagagacauguagugggaccccaucucuuccuaugucugacacauggcccgugcguguucaguaaggacuugcugacaguguggaaaccucucccacgugucaguggcaauuauacuguaaaccugagggacaaagccaacucuaauccguagauucaccgaguguuauacaucuccagggcugacaacaguaggaaaguaaugcucuaaucugcuucucugacaagccgacaccacccagaguacagcacuuagucucuugugcguaauucaguuacuacuggaaaaacccuuucauuaaauuacuuucucugaagacuucaaaucagagaaaaacuauugcucaauaaauuucuccuaauuaaacaugcagguaaauuuaauaaccaagucucuugaacuuuauuaaaugcaaucagauacaaauuagaaacagcuaauuaugaauaaauguucaaugaaaggcaauaugaacauuuuacaguucaccauguuccaauggguauauguacacacacacacacacacacacacacacuucugaacucucacaguaguggcuuccuauagaaguuuuuuuuuuuagcacauuacauuaugaaagcugugucuuacagccuuauuccacacgggaacaguccaauggcgcuuacucuauucuuuggggagacacagaguuccauucucagaauaccaaauuacuaaucccaucagucauuacaaacacucaaagaaugcacaugccuucacucagacaccaacaaucauauuuuaaccacccaguuguugaaaauuaugugaaagccaacggaaaguugaacauuuucgccuacauaaacccagucaguuugucuaugacaaagucucuucauugaaaugcucgggcaugcacgaauggaaugcacuguuuuucuaacugcugaauuucucaagcaguggaaaaaauucuuuaucuccuuuauccaaggcacuaaccugguaacagugcauuuuaacgcucucaucccaggugguauagaaaaucuuaucuguaaauaacaaagucaaccugguucuuuuaagggaaacaaacgaguuucccaacacguaaagaaauaaguuuaauuggcacagaaagcaaaugggcaaguauuuuugucaaacuugcucccuauauacucagauuuagagucugagaucuauaaccugcaaucucugcaugcaaugccuagcagagaccacagacaacaaguuaaguagaguucuaggcuuaaagaaaaucaguagauuaggauacgcuaaaaccauuucacaaaaugacgcgugaaacuggcucuaugucuucuacuaccgaugacugugaggacggugggaaacugaagccuucuccagacucuacacuuagagguauuuagcagggccaacucuuuccugauuuuauucuggaacuccuuggcccaggcucagcugaccuuccuggcuugggcuauaacugugcuaccucuagacaaugugacaggccccuucccagaagccaccacucuguggccuguuucaacagcuggauucuaugcaugauacucuacugucaaaaggacuguggggcuaguucacaaggcacaggacacaggguauccccuuuuucucugagaauugacccaacacagggagauaucauacucuccuggcauuucugagccagagaaaauacucucauuaaaauguugaauuacuaagccagaauuugccugacuaguuuaagagccuaaaaugacuccaaaaaaaaaaaaaaaauacugaauuagaaaaauaaaguucccccacucccguaggauuuaucagucuuaauuuauguuaauacugguaaucuccagaauucuugacacucaagcuuauuaggacuuuaucuuuguuccuuggcagagguuuuuuucccccccuaaaucccuuuugccuuauacauuaaacaguaguuaaaaaagauuuaauccauuucugcagcgcuauguggaaguaugcuucagcaccuagaagcaguuuuagaaaaugcgagauacgccguucaagcacagucacgagacugcacggcuuccgaccuaccugacucgaucgaguagagcacuucagcguuccucccuuugucuuuguccagagcugucacuugcagcacaacugagcccacggcugccgauucauaaacccgcccgucguaggacggacuggugaaccacggugcguggucauucuugucacugacauugacaacaauccuggcaaaguuucguuucacagggacauccugaucccggaccugggagagaaaagucaacauguuaucuacugggguucuucuuucuuguggauuaaaaacaaacaaacaaaaacauaaaauaauacacacauacauacauacauaaauacauaaauaaaaucacuaugcuuuuccaucccaggaaaccugccagucagaaagagagacggcaggguaaagggugccuuccguaccaugaccgugagaacgugcuggugaauggcuucauggucaagcuuuucagcaguguaaagagcgccuguugcgggaucgaggcggaauuucuugaggcuggcuggaucgaugcugcucugcagaguguagaucaacuuguuuuucucaucccuaucuacugcacugaucugcagaaucuccacuucuggcucuguguccucaggaacagcaacuucguauuucgauguagaaaacugggggcgguggucauugguaucuauuacuuugaugaggaccuggaacgaguggcaaggacacucacauaaagacacauucacaauuauguuuuaauacuuaaaaauacauacauauugaaaagaugccauugaaccaaacuacauauggacacgagaaaaaaaaaagcaauaaaaaucuagauucaaagagaguaucuauagcuugucuuugguaugcuauucacuuaauauuuaacaauaacuauagagacagaauucagauuguaguugaaaauugcuugagaaauacaggcgaauuucucauaggucuauaugagaccuuuggaaaugacucauggaaagguauuggacuugacucugccgggauuacaguguacccauuuucuacacuagauuuacaccagugagaggguuaguaacacuaucuaauuccucauucuaaacucugagacuccaaguuccuaauaaguuauuaauacaaaggaacaacuagaaauggcuaaagaugcaauucagcaacugggcacuuucuaagaagcaugcaugagcuugucuuagaaaucccacggcuguuaagguaaggcccugugguuuuaaguuauauuucugugacuucaaacacuauauaaguagugaauguuuuuuuccuaacaguaauuaagaagguugaaaaggaaaaacuccuguaaauauggugacauauaacgacagcuuuagagcaaagagacagaugucaaaaaacuuagucauauuuggaaauaaaacauauuuaccuugacagaugauuaauuuuuggaaugaagugacauagguggauaaggcauagugaaagucagcaccaaucauaaaauaugguuuauaguuuaugaacaagaaagcugagcucgauuggcuucuacagaacacgaggauuugcuaguuuaagaggaacaaggggccaaaguuuuagcagugccagguaacuauagaccucaccacuccacacacacaaagacaguauuuucaugagccuguaccaggguccccaaagaacaccacagcaucaaaggaugcauucucacacccauucuaugugaauacuaaguucgcucaccaaaccacacacacacaaaaagaucauaugugaacaguauguuuccauuugaaacuaccgcugagucacucuuuaagauuaaagaggacccaggaggcacugcuguaaaaagaaguucuuuuauaaaucugaucaaggucuguuuacaaauuuaaagcuuaaguugaccauagugcaggaacugggcaggaguuugacgcugcuccagcagauacgguuaaccauuacucaacaaaggcugaaaagaacuagcgauccauugugacaagguaagguaacccgugagccgcaugcuggcugagcauugguucagggcucucccgcaaggccugaggguaaaaagcaaguguaacagaaacuguccccaguacucuuucaaucucccugggcaaucuccuauuucuacagagccgaaaaccugcuagcacaccauaagaugaguccuuuucaaguccagaggcuggcugggaccuuccaacgcaaggaguccugggaagaggauggucagccaggaaagucaaaguugaggaugcggaccuaucuuuuagagacuggaaagacuuggacucgaaagaacaaagaauggggauggaugugggacugaauacgugcagccucaagucccgagagaaggauggagaauuagcuauccuguccacuucaucagaggaaacacauuccaccgccucgucuccgucaaguggaccaggaggguuucagggaaguacgugcaauugcggagguguggggucaggagccugcacggugaugcuguaagaugucugugucgugugagcguguccuagggacagacagugcagcaugaagaacaagcccccugagccaccccccuugacccuucuaagaacugggaagacaaacagcagcaccccuacuuuccccgauguggcaacggaagcagagggagccugauccuugccccugcacaggaggaagagguggagacaaaccucaaacaagcucagaaaguagagaucaggauguuccggagaaaggggaagagaaugugagaagagccaagcugccccaacaccaccuucacccugucuuacaaaauaaauuaaaaaggaaaaaaagcagcuggauuuguagguuaucuggagaggcaaaggagagaaaguagaaagauccaaccuccacuucaggcugggaagcguccugagcugaaggaugaagcugugugcccagaacucagacggaugaagcccugugcccaaaacaguggcauccgccaugccccccaugccccccuccugcucuccugggucugacaggaaaucugccgaacccucuuacgcccagcaccugugcuaccaaccugauuagcacagagccgcucugcgaguucuugauuuucacccacacaccugcaacugccagugcugcaagccuuaucagcacaggucagguagccgagagucuccucacaggauacacccuacuccgcuccagaucucuaucucccuguugugcacagucccagacagaaaccuaaaccuaauuacugccuguucccuuuguccccaccaccccaggucagccugggcucugucacaguucuguuauguucccacaaccucuucaugccagugaucccuugggauacugucaggacugucugagcaugcuccagaguaagucacaggacuauacacaccacccuggaauuuaaaagacggaacacuaaugaaucuccugcauuucaggggaguuuuaguaauguagaucaaaaauucauauuaggagcuaacuaaaggcgcgguuuucggaaaaggaaggguuacauuacuaauuaugucuuaaugagauaaugucaccauauggagacaugguuguggcaaugaggaaggcuggauggccaucuccacacucccccaagucccgccaaccaccuuccagucaguccugugaaguagacugugcucugugcacagggaccguguaaaucuaccgaacaauaaccauuaagguuuauuguaauuuuuuuuuuaauucucacuuucauucucuauaguuuaacaucaggggcuuauuucccaaaagaaaaaaucaauuucugcuccuugucacuucaacgagaagagcaaugaccaaaucagaaagggcaaaauggcagagcauccuccacacggcaacucaaaaaugaccccaaagcagacaccaccgcccacaaaaccagucuuacacacaugcaaaucacaagugucuggagaaaggaguaagacauuuuuacagcuccccuuaaguuaccuagucacuuauuaacugaacauacaucccagacuguaauuuuuaaacauuaacgaaauuagcuguuagaggagaugacccgucucauuuaagaucgcagagaacauaaucuaaagauggagaaauagcuuucagaagcaucucgggcucuaagcguuggcuuucuuagggauauuuaagugacacacaagucuuugguaucugucaucucaggaccaagagaaugggacuuggguccguuaccaauuauugcuuccaaggaaacaugugauguaauacaauuauucaacaagcacuugugaaugagcgaaugaauggaugaaugaauggaggcuuccuucuaaaacccacaauuacucgucacccagaaacaucauucuggacagccaguucuaagaaucaaagagaauucauuugaaacagagaaguccauuaacuuacaagguuuuaacacugaagcuugaaaaccagaaaccuagccagcuauugauucucagauagcaacaaauaaacacggauggggauuguugcugcagcuuccacgagcuugaguuuauaugauaaaguaggagggagaagggggggggugugauggcagcaacuugggauguuagagcuucaagagaaccaucuacacaacgcauaccgugguaaaacucugugcacacagcuuaaaugugaauguaaagcuaagaagacuucgacaggaaaaugguaaggguguagucuggcuuuaaguuuccuaucgaaguuuuuaugagacugcuaagcaaaaggcaagacucuaucaggauuugcauuaauaaauuuucugccccuaaauaaggacucauggugugcacaucagcacacaacugcccacgcugugcgcacauccugcugugagggcauuuucucggucucucugacagacaugugucacugguguccccuuaccugggugaggaucgugguggucccaucuguugccuccacggugagguuauagcuggauuucuguucugcaucaaggggcuuagcaacgaugauaguuccggugcccuuguccacaucaaaguggcugucauaguugccaccugaaauuaggacaaacagcagugcuagagcaaaucaugcaauaaagauaugccagguguuuuauggcuuucugaaccuuaauggccaggaaaacagacuuuuaauacaauaaucagagugacuccaaggaccugugauuucagaauggccagccagcucuuuagagcguuuuagagaaaaacuggaccuuaaugcgagggagguccagaacuaagaccacgagcaaagagcccugcugacacaaccagucagucacuucugacuuuucggccauuauuaaaguuuguacaucguuaugaaaaccucacugaccauauaguuuucacgacuggaaaacaauuauacuauuuugaguacacuacacuaggaaugacuacuaaaaacacacgcuaauucugaaagaaacacucgugguuaacuugaaucaaaucuauuacgaacuccuuaaaacuauuuucagaaccaaucuccuguccuaccaauacuaucccgauauaccccccaauuacauucuaaacaagacucuuuucaagcuuaugggaauugagacacauuaugaaaagaaguggaauggagauaaggcuuaaugacacacugaaauccuacagcuaaaucaaaacaaaacacacacacacacacacacacacacacacaucaucaucaucaaucaaccaaucaaucaaaccagaaacuacugaugcagggacaaguuaaaauaaaaaugaccauguuugugacugggauggguagccaugcauucacuaugaaaagaaccauggugggaaaaagucucuggaaacaaaaauccaugcuuugauauauauuuuuuuuugaucucauaaucacgugggaaauuaugugaucucagcagauaccuucugcuguacaguucgggucacaagucagcugaaagauguaaaacacuucucuagcaagcgcgucuccuggcacagccaaaggaagcaagcaagcguggaaagcaagcacagaagaagucagucagaccgguucccaacaguggggggaggaggggacaaagucagauacugcaggcacaacguaagaugcuuaauccagaagugugaggagaggaacgauaaacgucgugguuauggucagcuauggcccuagucuuuuccucuucaagaccgacagugagggaggcuucagcgagaaccuuuucacacacugggaggcaacacagcuaagaguagaaggaaguggcugaguucuaacuccagauggugguuacaaacacacuucugauucauuaaguauuccuugugauuaaaauguuguggaggaagagaaaaaaaaaaaaagcuaaggcuagucucuguagcccaugcuuaggaucccagcuaacucaggaggcugaggcagaaauauagcaaguuugaagccacccugagcaacuuaauaugauccugucucaagauuuaaaaaacaaaacaagaaaaauccccaaaguccaguguguggugcagcagccgagagcuugcuugucuaaaguggguggauggcgcaggggacccugugagcuuuuagagcuguguuauagucuuuuaaaaguaagccgaggaugugugaguucauuaaaucacaaaaaugcugacuuaagcauguaaguuuuagaggaggauggagcuuccugaaaaaaugagguaaauaacacuaagaagcuauggucaacaguauaaauuccauauaaucacaaauaauagcacgccucuauguguguuuguguguaugugugugcgugugugugugugagagagagagagagagagagagagagagagagagagagagggaggaggggaaggaggggggggaggaggugaaggaggaaaaacugguccaaaacauuuaaauucuuaaaacuaaaacuaccuguguauguccaaaagcaaauuuuguaaaagugcucacugacuggauggcuauuuuauguuuauucuuuuaaaauuauuauguguauggauguuuuuccauuguguuuaaucugcauaaucaaucccacaggcaugcagugacgauggaggccagaagggggcaucagauucccuggaacuggugcuauagauuguaaacugucacgaggguuuuggaaucuaagcaggguccucuggaagagccccuggcucuccguggauccauuucuccacacccaggaguacuuauuugacuauauguugugagaucuucugcuggucucaaaccacggcagucuaaggaaauucuucaccucuagaccuuuucccaaauucacauucuaacaugagaaaaccacaucagccugucaguagcccagaggaggaugacgagagcuaagagcgcccgccacguaccgaugaugucaaaccacagaggcaugccagggggcucaacugagaucacgccgaucaugugagccaccggaucacuuuccauuacgguaaaugagaaaaccgauuccucaaacgaaaucggcuccgaggacggcuuggguuuggagauccacucgauauggagccuggugguggacgacuucugggggcgcccguugucaacugccuuaaucuauaagauaugaacggggagacgaaaaacagcaaaucacaugugacaucggcaagcuucagagcaacuauaguuugaucaccuacuaagugucagauacuccaaacuugugucugaauacaguguaugcugacugcuggcugaugaggaguuucauggccauauauguuggggugagagccaguaagaaaauaaacccgcgcuccccaaacgccaaguucagguugcgacacugaaacugcuuucucaauggagaagagaggaaucggacucacggaaagaaugucauauucuccggccgcagaaaacuuuuuggacgagaccacucccguuuuggguucgauggagaaccugccgugcucguugccuuccucgaugcuguaggagagcuccgcauugggccccucguccuuauccgcggcuaugacgcgguagaggggcucgcgcuucgaagcgcuccgguccccguccgccuuuucccgcucugggagccugauuuuguaaaacuucugaaggaauugaggccuguugucguucucaucgaggauuuucacgaugacucuggcaaugguggaucuggggggaacaccguugucugucacaguaaccugcguuuuaaagguaagagauaacaacaugucagaguaccaaaaaacgaguguuuucuagguuaauuaaagggauguugaauauuuuuaaguccucuuaaaaaauucccuuugaguauucaaacacaaagucuccacauaccacauuaaaacugucauuuuaguggauuugugugugugaaauaauccuaaaguaucauuuuaaaguguacuuauuacaaauuuaaauaucauagguuugaaugcuaacgaugaguuugagaguuuucuuauaccauuuuaaauacuuaagaagauggacacuuacgcccauuguaucacaggauuuucagaaaaaaagaaaaggcaauguuaaguaauuugcuucuagguuacucaugugcuccaguaucugacacuaagcaaugggcuacaucugagucuauaucacccugaaaguuuacauuuacaucugugugugugaaaaauaauggcccuaaucaggacuccuuucagucaagcucugccuccuucuaaauuaacugaaaauacuaaaaauguugagagaauaaaauuuuucaugaacggacguucuuuuggaaacuugguaguugucaauccuaguaagaaaaguguggauguaucaucacgggccuugucagaggauuuaggaaacuaacaguuguuucuauacauugaagcacaagguuuaucuuccuaagcuuuucaggaugaaacaaaaugauuguuuuaguguuagcuccucugaacacuuccugccugucacaugucaggugggacaaacuggaggggaggggcaaacuggagaagacauguaaccaaacacuguguaucgcagguuucacuaaguucggugucaacaaauaagcuuuuccaaagucugaaguaauauacuccugucuccagggcagguaaacugacaccagcuggucuucaaauacagacaccaaagaaugacagacacauacagcccauacacaaacgccuuccacaucuuuugggucaaugccuuagcacugucugcaaagcccuuuugugccuuauagcugcucccauguggcuuuugacgcuccuugugaaagagauaacacucuacaauaaguagagaacuuuugugaaaccugaaguuacaaccagagggagaggggaugaacccccacaguugccugagguuuuugguacuuccccaugcuuucuuucuccagcauccaucccuucccugagucaauuucuguaguaacugaaugaaaauucaaagcccugcucuguaauaaagaaaaugaauucaagggagccacacaaccuguaaaugaaagcucgacuccaguaagaaucacuguuaggaagacucggaggcucugaaggcagcugguaacccacgcgugcgugcaugcacccacaugcacaugcaggcuuaaaaagaaauauuuuacuaauaacauaggcuauuuugaccaaagaugaaauugaguagacaguaggaauaaguucuuuuuuaaaagaaaucgcaagucaucguuuagaauuuucucuacaaaccacgcuguugagaguuuggacaugucacacagucggcucacaaauaacaaaagcagcugacccuacgccuggcucugauagugaaauuagcaucugaugagaaaaguucacagaggcacggcuugcucugcugugcccugucucugaagguggcugccccuguccaccuccaugguacauguuaccugucaccuucaaaccacucccacacugucauucugcgaacuauugucucccaaccaaaacgggcuaaaacgagucagugcaaaaaacaucugaaauuacccaaauauuuuagaagaggaaauguuccacccccaccuccuuugacguuugauauuuuuagaaaauuucuuuagguuacaaacaaauucuaguguacuacuauaugacuaacacaaugauuuaaguguuaaaaaccaccuggaaaucaacaacacacaguuuaucaacaguuagccuugaucuauagauaugucuuacaggcauaaccgggagaagucuacagaagguacagagaaaaacaucgcuccugcaaauaaaauucaaaugacuuugguuacaaaaguauuuguaaauuuguguaaggggcgcagguaaagaagaacaaaguucaaaaggguacuaagggguacuuggggcugaguuccuuuccucugaggauggacugaggugggggagaggggauauucauaauaagacauuggcagccaugaaugacagacggcaggagugagggugcucucaggguguuuuguuagaaauaaaggggccgggugugguggcgcacaccuuuaaucccagcacucgggaggcugaggcagguggauuucugaguuugaggccagcuuggucuacagagugaguuccaggacagccagggcuacacugagaaacccugucucgaaaaaccaggaaaaaaaaaaaaaaagaaagaaaggaaggcuuacuucuagaaugugcucguccugcuguucucgguccagcuuccucgacgugguugugaugagaccuggaaaaggguggacacuuauugaucagagcgaaauaccauccacccccacaccggacuaguuuacucagaagccgcaggcacacugugcacugucuugcucuaacgauucuugggaacaccgggcaaagggcagaacuuuuauggaaagggaagaacucaaaucuacuacaucuccuggucaucagacauucggucagaauagaauuuuaaagguaaaaugaaguuauccaggacuuauucucuuccuguaucucuaauaccugcuccagaguuaagauaaauaaauggugaauucaguucuagaaccauacugaaaaggaaccauuagaaaccuauaacuuacuaucuucuagucaucuaucuucaaauaaagaauugcuauuaaaaagauaauaaaauauuuuuauuccuuauuauaaauuggcugacuguuguuauuacuucaacaacagucagccaauuuauaauaagagaauaagaaaaugaugcccacccuguauuccccauuucuuugauuauauuaucaaacuagaauaaaaugucaaccugucucuaggacuuuaaucuuaauaucucuugaaucaucaauauaugccaugagcuagaagacugccaaaauuguuaaaauguaucuggaugcuucgcuaaagugaauuccacuagccaugaaagcagcggcucucacccuuccuaaugcugcgacccuuuaauacauuuccucaugcuguggugacccccaucauaaaauuauuuuuguugcuauuucauaacuguaauuuugcugcuguuaaggaccguaauguaaauuucugugcuuucugguggucuuaagagacgugcgacugcccagaggggccccaacccucggauugagaagcacugcacuaaggcauuggugcaauuggcaucagcagcagcgggugcauugacuugauuucaggggaaguucacuuagccagguuggugcuggguugauccugcuucccagcauugccaggaaaauaguucaauaagucaggaguuugcagcuguggcugucugaacacgacagagccaggagaugcucugggcugaaacuccugagguccuaccgcuucccauggagcuacugacuuaacggcuuccaggaggccaaggagcuuucguuaagagugugacccuguaugaguagacagaucuccuccaacggcuggucccauacuccuuaagccuaugggcaguauacaugggacuuggcaggacacucuuuaaaaugaggaugugaaauuggaaggguguuggggagggaaaugaguacgaucaaaacacacuggagauaauucucaaagaacuagugaaaacucccuuuaaaagaaaaccggcuuuccucauaguuaacuuccucccauaucccuaacuaccuuuacaguuaacggcuauuauaaaauguuucucuaaaucugcaaauaccagauguauauguuuauuaacucaaugcuuuguguuuuuaaauaacugcucaaauaacuucuaagcacaaccuuccaacuggccuuucaacaaaccacaagauuguguuacugcuggacacuggaccucuucccaaacucuaccuauagacaacuggagcucaagaagacgcuuccggucuuguaacaacaggacagcacuucaaugguacaggccuuuuaguccucuguuccagaaaagguucauaggccaccgccacccgcucacaaacaacugugguuuuaaagcaauugaaaaacaggaaaucgcuuuuaucuguucuaccugacuguccuaaagcucucauaagauagucacgaccacugguaagauggcacggaaaauagcaugauaugcucacaagaagaacuucugccuggcacucaggcauucaccgagggcacccaggaaaauuugccaugaacacuucacuuacaucaaagugcuaacaaaggauuuaaccaucuguauuaccaauucaacauggaaccuaguuacuugaccagguuucaguuuagacucaccggaacaaaccuccaggcuuccuguuaaacaccuccccggacccccaccaccccauccccuuacccuccaccugccucccuucaccacuguaacacagaggaacugagauucuauuuaaaugcaaugaauugcaaggccuacuucaauuaacugccauccccucacuuuaaaccgagucaacuguaaaguucccuagggcuaauggcccagugagggccaccgcauaugugggucaugggauguucaugccaaagcagugauccaaauguagaauacaaccccaaaauaagguccuguaaggaacuccgcuugcuuuguauuauuuuuauuuuuuuuguagacgaugugcaugguaauuuggaacuuuccuagacucagaacacuccuaccagaagaauccuauccacgguuucuauggcuaucucccagaagccuccgccaggcagcacaggcuaugccugugagucugacgcgcagugugaagagaggugccuuucucaaaggaguacaguauguuugaugcuuacuacagaaacuucgugcaaaaugaacucuaaaguacaaguccuuacugcagcagggaagcuagccacuucucuagggugugccccaccuuccugggguacacuuuaggaggcacacagagagguuaacacccuggggugccagcccaaccugcagcaucccuggccugcugcacggcacuuguucuguguuuauaauucaucauucugcuugcaggucggcuuccugcugaugcccgcccaacccccucccuccccacuggacaaacaccugcuucacaacugaauauucacugggugacuaaccuuguagguguuaauaucugagugaggcauuauguguccuaagaaauauuauacauuccuuuaaaaagauguauaugcaugcaguguuucccccugaaucccaggaagacacacccuuuaucagaaagggcacaaugaccaaggucaggugucugagcuaaaaggaaguuaauuuuucuccgaggucaccaggcacucauuaacaaggucaguuagaauugaguucucuagggacccagaugagaauuuuuuuuuaacuucccaucgcauuaaacacauaacuuaguguguuuaugguauuucaauucuuuguaaagccuugacugugaauucagcaaaucuuaacaggggaaauggccgugauuagucacuauucauucuggugggucaaaaaaguaagucagaaacugaaagagaagauaaaagcagagagcaugcacaccacaggcggccccuuccugcaucuacugucauuuucugcaagcaucgugaaguuaaaaauagaaaggaaaagaggggacaaagacuagaaauguuccuuccuugaucuagaaaaacauuacauucucuauacauggggcaggcugaaagggcugguaaauuucccaccuucacacuaauuaguauccucaaauuuaccucagaagugugaaugagacuaaaggagaacaccaaaccuuaccaaaugagcagaacugacaagugacuuguacucuuuucacaucaaugcccacguuuagaaaguuaaggcagacguuuagauucgcuguaacucucccauguuaaccuaaccuuaaaauucuuuaacucaggaccuccucuaagacaaggucuucgagaggguaggcagcacacacaggcaccuaucaaaggccggcuagguggagauggagcagcuacacgcuuauucaacaacucuguccuguccauucagacccucacaggggaaaaaaagaaaaccagagggaacaagugaggcucuggaagaaacaacagaaaaagggggagggggaggagggagagaaguuaguuuaaacagcaucacaaacacaaggggacagccagccagagggugaaaacccacgauuucugaacaagacugagguccaguuaccaugaagggcggagcacuugagaucuguagcaggugaaauuuacaaacaguaaagcuaucgggcaagguccugagugugugccagccaccggcuuaacccuacauggcaggaaacugacuuucaaccaucuuccuaucauucuccuuuaagacuaaaaccaggaaggggaggcaggcagcagaggguuagggggugggggcagggcagucaccuaauccuacuuuauuuccuuuuccaugucuuuggcuacauuuuuuacuuuuuacaauaauaagaagagccacuguagcuuuugaccuuauaaagcacuauccaaagcaguuucucuuagccugaaauucucucaauucccacugcccaacacaguagcaucuaauugcgcccagccgcugagcagcuggaauguggccaggcuaacugagaaaguggagauuucagaaugaauuuaaauaacuuaaaaaggcacuggucauuuuugcugcuuucaauagccucuuguuccaaauuacaugccaacauguggcucaacaauguucagaauauguuugugguuaaaaagcuaaagauacaauucaaugacgaauacauccguuaucaaaauccaggcuuguaaacauuugcccuacaaaugcaacguuuuccgcuguucuggcgugggggccaccacucucuguccuccaauccucagacuccguccuuagaauucaguucacagaguucagccggagaugaagaacccuugucauugucacuuuauagcuuugccuaauacccccccaaaaucacaucuuuguguucaaccugacuuccgaaaauuaauuuguuuaccagcacacgcuuuuugcauuugauggcuuuucugaugguuuaaaguugaaaauuaaguugcuaggccccggugacgcugccguaauauuuaaccagcucagaguuccccaguuguucugccugcauuauuacucaaugugcuugucaaaauggccuccccaaauguauccucugagagagacacaaagcucuugcccucgacgguaagacagaucagaggugaggggucuaaguuaugugaggggucuagguaaugugacagugcuaacaauguuuauaagucuguucggugcaagcacucuuucauguauacuuuuaaaaaaacaaauaaauaagccaagcuguagaagggccagaagacgugaccucuugguugacagcugucacagguccuuuccuggugcuuguaagcaguuacaccuagggggaccagccagccuguuaucauggcaucccagcugcuucaauacaaagguggccugaggcagcugcacucuggccacuaggcuuucgaaaccgugguuuugguaaaggcacaaacuucuucagcagguuugucccaguuaagacagcuccaggcaacucagaagaccucagaagcaagcaagggaagacuuaguggccuccaggucacuucuacagcugccccaggcccaggcuccgccuuuuaacagcugugcuugauuaggcacaaacccaggaaggcgccucuccuagugacucaacagaaagcuugcaaauucccaaccugagggcucugacuggucccuaacucaaggcauuugacgugcugaacuggaaacugugcagugaccuguggaauuacauaggaacucaagaaaugccacgauccuuuuccaaauguaucaucaggcugugcuuucaugggcucuaguaaaggguugucauaucacaggucaaaaagaaaaagcugagcuggccacagggaaaagcagcaccuuuuguuuuguuuuguuuuguuuuuuggugguagaguuagcggcugcuuucaguuuuguuuggggagacuggauaucccuagcugccccagaucuuggguuccuuuugccuaggccuccagaauccuggcuuuacaggugugacccaccacccccugcuuccuuuuuagcacaauaauugggugcuuccuuuggugccaggcuaagcauucuaggaaucagaaacauuaaggaaaaucaaaauaagauaagcccuaggggcagucaguaaagugguugagcaaccuuuagacaaagagcuaccagaacuaagaggcaaacguuauugugagccuuggguaugaaugcuaacuuccuauacaaaauguauauggaaauauuuacaaagcaauuugucaaaagagaaaggaggaacuggucagggaagagacugagacggggcaaggaagguguuuccuuuccuauacuagaauucucaaggaagggaucuucaguucuuaacaaaucuuuuacuugaaacuuuauagccuuaaaaauacguuaaaacucaaagcaaaagauauaggagaacaauuuacuggguggaaauuuuagauggaaaagaauccaauacaguauuucuuucucuuuccuuccuuccuucuuucuuaagauuuauuuauuuguuauuuauaugaguauacaguagcugucuucagacacaccagaagagagcaucagaucccacuauagaugcuugugagccaucaggugguugcugggaauugaacucagguccucuggagccaucucuccagcccccaauacagauuucuaaagccugaacuaugcagccauugacaaacauaaauaagacuuauagauauauauguguauauauauauauauauauauauuuuauauuuauauuuuauauaaguaugcugucuucaugcacacuaggaaagaugucagaucacauuauacauagauaguugugagucacuacgugguugcugggaauugaauucacaacuucuuaaccucuaagccaucucuccagucccacauuuucguuuucauuuuaaaccaccacaguggcaagugggagacaacuucuucuaauaaguuaaagcaacuggaaauggaaugaauuuuauucuaaauuagagucccacuacacaaaccauauuuccuagaaguggagaguguuuaaaauucccgcccaggcaggggugguacacgccuuuaaucccagggagucccuugacucccucauauaccauguucuacacugugcauuucucauuuaccauguuauacagugugacucccucauauaccauguucuacagugugcauuucugccaccugaguagaaauguaugcccucagggguucaccuaaaaaaaaaaaaaacaaaaacaaaacaaacaaacaaacaaaaacaccgaaacaggcagggcacagugacaucagugagauuaaucaagacaguagcuccaaaacuaacaggacaauguauccucucuagucagaaaacacucacucucccugcauucucaaaccuaucuuuuucaucuuagcuaucucucuguuccucuuacacacugauaccauuuuuuuuaaccucaaaaauaaugucaacuaucagaauaaaauagcaguaguuaaagacaguguucuagcugcuaaacaagucucuucacgucuccauaacauaacaacauuaaaauacacaucgucaguuguacugccucaggaacucagaagcuacagucauaggggaaauaaaucauuauguuuuaagaugacauauuaaaaauacucuaccggcagugguggcgcaugccuuuaaucccagcacuugggaggcagagacaggcagauuucugaguucgaggccagccuggucuacagaguuaguuccaggacagccaaggcuacacagagaaacccugucucgaaaaaccaaaaaaguacucugaggcaucaauauaggagacaauaagaaauaccauguguaccaugugacugcaugagcaucuucuccaugaacacuuuagccuguauauuugaaacagcucuaaugaaauaaaaaauggccucggaccaaagacaucuguagcagcugggaagaucacagaggagggggguggguguguguggguguggguaagguggagagacaggcaagcaacggaugcuaaagggggccuggggaaagcagaaccauuccaacuggcugaguuuuuaaacccuuuaccagugaacuggaaagcaagcagggagugaguagcauucccacagccagcgcugugcuuggcucugucauggauacaauaacuggguacagaaagguccuggcccuugaggacuggagccaggaagagaaccaagcaacagggcaagaucagaaccaacaaugaaaaagucagagucuugcuuagcucagaccaucagggggcaggacaacacgucucccuuuucccaugcuggagacuuggagggcgucauaggcggaggcaaagguucagcucuccccaucaacucuccuauagcugucauugugcaucuacucuuagagcuucugucggaggcucucagagccuuggcagcgugcgcugucuuccuauagguaguguucugagaccgguucuaacugcaguuggcugggagaucuuuggcagcuguggccaucugagcagcuauuguuugucacugcaguacuggugccggcaggauuaggcuuggagccaaaaauggaauucuauucauagccugucagggcuggaaaggagcucggaauucacuuaacucgaacuuucagagguccgcagaaaacacuaauaaaauuaaucagacggucacucugaagccacacaaggaggggcugaggucaguaucgcccgcuuuucuucugcuuuuacaucuguucugcgagcuguuuccugguggaaauuagugguuucagaacacaagaucagaaggcaaaucaauuuugcugugaauuaauuguuuuuaguauucuauauaaguuauguaggagggaaggaggccuggagggagggaaagcacucaaucaacuguaagguuaauaucuaagguuaacaucggcaaacuucaacgaaagcaucuuaagugcaaaaucuuacauguacuuuagucacugacguucagugaccuagaaucgcagaauucuccuugauccaacugacccuaaggaucccacgaaaacagauuugauggggggaaaaaugcaccagauaaggcaggagauaaaaccugacuuuuaagacuuuagagguaauacauuucaccauaaaauaaaaacuaguaaugagaaauagauuuuaaaaaagucuauagcccuuaaaauacacgaaggugacuuucuguuguuguuguuaaugaaucccugccauuguggcgugaguggccuuucaguuccuuccuuucuagagcuaucaaauguuacaccggaaacccucggaaguuguuugcggcuguaacuacuuccuauugaacuguguuaggucuccuuuccagccacaauaaaaugccauuuucuuauugccucauuacucaguaauacaagacucacuuacuaaaggagcaugcagcuagaaugcgauuaggugcccaguauaucuacuacccacugcaguauucugcagugauuaaagaacgcucgguuugucgauuacuaaauguaaauauucuauuuccacuaaaucuguuuguaaucuucuacugaacagucacaccaucccuuauauacccgacacagauagcucuuuaugaaauacucuauucuacauguaagcaaggaaaucagaggcccuuguauauugguguucuccuaaaagcacaacaaauguauaauguaguccuuuugaguaugaacaacucagucccagacaagguuacgaaaaaaaacaggggagggaggaaccuuccaagaaccaagagccaaccaggggagcuggcacugcagcucuggcuguuuguaauaagauauaccagcaguacaagggcgaaaauaucaaauuuaggcaucuuuuaucuuccagugagaaaugauuuauuucuuaaaggggaaaagaacuaauuaguauugcuacccacuucuaaacaucuaccaggaacuuguuaaaucucaaaaaacaugcuuaauaacgcauauucuaaguguuguaauuuaagcgccuggaaaggcaacacucagucugucuauaugcacucuuguuuacagaaugggaaaaguugggucuuuuauuucagaguuuaauaauuuaaauagcugcugccccauuucaagaaaaaagaaaaaaaaaucaauacgugaaguauuuccauuguuacguauaacacaucagugucagggaacuguugcucaacuuguauggacuuuaaauugugaauggcuagacacauuuuauaauacugaaagcuauacaaacuugaaaguuccuuuuaucauugaacuacaaacacugagcuaaaugacugugacagacacuggacagacugccuaccuaaaaacuucccuggccuuuuauacaaaauggucaguaauuccuccaguacacgguuaaugguagcaagcuuaaggagcuaggaucauuuaagagcauugugguuuuuaaugugaaaagggccacagaaacaguaucagacuaaaagcaacuaugcucugacacagcauucuuucggauacagaauaaccaccgcaaaaccacacucacacauccaagacgcaguacccagaagcagcagggaggaaauccaugccugugguuuggacccugggugguccugaccucucugaagucauguaauuauuuguaaagugaggaaaaugcaagucucccuuuggagacucuguuuggagucucucugcccuuagcacaaggccccucccccaggaagauuuaaaggauuuaaguggaucaaaguugauugcaaaaugcaaagcacaaaucagaggaagaagaguguggccugaacucccaaaaaugggcaaaaaugaggcuaagagacuguagaagggcuaggaagucuaaguucacaacagaaaguuaagagucaagaaagaaaagccagggguugcugcucucucuugacugcccccugaaguucggcucucaaagacaaccaaagugcaucagaaagaacaccagcagcauuggaagagccuaaaguguucuaaaccauugauccagagacgaacagacuggguaggaccucaacccaaccggagcaacuuuggcuggggauauagcucagcgguaagaguguuugccuaguguaugugggucuuuggguucaauccccauuacugucccaaaguggggaggagcaagccacccucaaauuccaaacccauuuuuaaauaucucaaggggacagaaauauaugauucagccaaugaagagacugacuuacagugugccuacugauacaacuaaccccacaaaccaaagccaggaugcccgcuuaugcccauuacccauuccuagucuauuuagcauggcuacaaaauauaauucuucauauauuucuuuccagagaggaagaaggacagcagugaaugaaaauuagucaaacaguaaccuauuuacuagaggagauaagagccgauagaugaaagggccagagguaggcggguggauacacaucuauagucaaagaaucauuugcugagccugucaaucacuacccuaaagggauuuuucuaaaccauuuugccuggcuuaccuaggagagaaaagaaauagaagcaguugccucugugcuuggaaauacaggcugcauuauuaugcaguguggagagcccaaaagaugaaucuuuuacuaugucccacugcuugcucccuaaguacuggaacaaagucaaggggcagaaagcauggccaagauaaggugaaauaaaggagccugggggugggcggcuuagauagcaucuagcagcucagagcaagcacacugggaagauuccagcuaagggacagggcaagggugggucagacuaacaaaagaguuaugagcaucaaucagcucaggguucgcuaguguacuggcuaauuuuaugucaauuucacacaagccacagucauuagaggagagacagccucaaucaagaagauaccucuguaagaucgggcuguaggaaauccuguagggcauuuucuuaauuugugauugauugugggaagagccuagaccaauguggacggagccagcccuguccuggguucuauaagcaaccaggcugagcaagccauagugaguaaacaguuacccuccaugggcucugcaucagcuccugcccucacuguguuugaugaagaacuguuaccuagaacuguugagugaaauaaacccuugccuucccaaguugcuuuucgguccuggugcuucacugcagcaauggaaacccaaacugagagagucaguuugccugugaaaggcaacugcucugccauucuccauccccagcccccagagaggcuccagaggccagagcaccaaugcagaaaaagaaaacacucacuuaagacaccagggacgggaaugaaggacuacauaaaagugaaagcacucacugggaaucuuucugugcccuuugaauccugcauuaugugacucaauuacuuaaugaagucaggaauauaaucgagaagggaugugccugugugcagacaucccaaggcccaguguuguuaggcacagaaugcaaguaauuaauggucauuaugaagagcacagucuaggcagaacuuaaggacagauacucuggguguccucaauguuauaguuuagagagacauaaagugaacucuaaugucuuuuuuuuuuuaacuagcuccagaaacccaugauacuaaauaaguuuauauguaaaauuaaucaggaaauucaauuuuuauuauuuaaacacacacacacacaucuuuguuggaauuaucuaguacuccuuuaaugaagccuuuugggggaggaguauacacagaauuauugcaaagcugaaacugaauaaacauuuuuaggauucaaaaaaaaaaaaaaaaccugagcuucuacaucuacacaaggggccagauuacacuuaacaauaccaaagguaagaaaaauggacaaaguaacaguuugcaggcaaaaauaaaagggguggggaguggggugaggggggagugacucuuaaugagcuaucuugaagguuuucagaauauucaucccuacaugagaaccaggagauacgcacuaaugaccuccugaagacuaaauaguaaaggcagcauuauuuccuacaaccaaacacaguaacaguuacauaacugcccaucaaucacuaaaaggauaaacuguaucuacauaaggaauacaaacaacaacaacagacuuaagggcucauacagagcugcagcgcgcaugacucucaaauaaguggagugcuaaacccuucuccccaaguuuacacaccaugucaucagcccauuugugaaauucuaugggcaaauuuauauauaacuaauauaauggcagggaacaccagagaucaccuagggaugggggcaaagaaccagacgacagaaacccaggaggcaauucuuuagaaauaccuauaugcucacugccugacacagugaugggucccugggucuggacaaagguggauuuaccuccugcuaauuauaccccaagggagcuuuuuaaaaguaaaaagacuuacauuguaucaaaaccuuagaagauagcaaauucacaagacuugggacuuuuccguagcaggcacaagccugaagaguaaccuucaaaauuaucaggcgacugggaacuguguaucucuccucaaagcugcuaacagguggggucaguuuccuaagguuaccagaggauaaugaaauauguaaagcucacacugguggcuuuugucugggccccuccucuguccuuggcauaccacagagcucugaugcuuuggauugcgugagcaggcagauucaaggcuccaaacaauaaaauaucugugucccugccucucucuugccuugagcaaaggcacaauuuuugaaagacgcaaacugacccuaacugauacuggaaauagccaaacaacaaggaaaaguuacuaauguuuacucucuguuaacaaaaguaucuagguuaggaaagugagcuaaaccuuuagccugugcgcccuaaaagagaaaucacaucaaguccuacuuauaauuaguagacuagcaacugccugagaugaagcaagacagccucagcaccauaauuaaacgcuggaagauacuaaaaaaagaaguucauucaagccugaugcuuggagaccaaacuuuagaaaugauugcaguuccagaaagcuucuuugaaaaaacauauucuugucaacaacaacaacaacaaaaaccacauagggaugcucuccucauuuacaaaaugacugugaguaaauggguguuuaagucuauacaaaauguucuaaggacuuuauacagacucuagaaaacaagucccucccuccuucagucauaaaggccacauaaacacuagcuucaguccuuacccggcagucaagucgccuaagccugucucuuggacagacuacucucccugcuucucccagcuucaaaauaagcccaacagcucuuccagggccuucuacuuccugacugccccaugccaccagugugacugcaguuacugcaaacaccuucaucacaggcugcgucaggccccugcucacgaggccuucccuguguuucuucuauaucuacagggcaaaaucugaagaccuuucacguccugacaccuuaaacguuaggcuuccugguauccaauaaucccugggaagcgaacacacauuguuccuuaugcuuguugcgccccccaccccccaccauguagagcuguaugaagccacuaaaaucgugguugucauacauccaucaaacaagcagcugaaacaugcaaggaaacaggcuguggcauauucuccacaaaggaccccgaggaguccaggaggagggccuuaauaagagugucaaucgcuggucgcuaauccuaaagccugccucccgcccuaaugucugcuuccuccgugaucccaaagagaagacuaacuacagccacaucugaguuccugcccggugauuuuccuccuucagacauuaauuacuaaggacccugauuuaaggucuccaagugguguuccgggucaguaaaucacaagagcuuucuucuuucagagagucuuucaccggcucccaccacccagccuccauuuuaacaaaccaccucuuaagacgcagugccugcuguacgguuucagaggaugagacgaccuacugaugucccuugagccuugaagaucaugcugagaccuuccacugagcuggagacacaccucgcuguacuuauuuauacucuauuuuuucuuaaccguauguuugcuaaagcaugauuauuuuuggaccguuaaggacauggcuggggcucugugaaacucucuaaccauaguuuguaacugacacaccucucagcagcuagccccauacacuagagucggccucuacuuccugucugccuucaagcuguaaaaacaaccugcuuggagauggauucucuccagcugucuucucagcauuauacacgcgccucacacccgggggugagagcucaccgugaacuccuagaggcuguguguucgcacagaagagcucaggcaccauuuccuaagcggccuaagggagaaacgcaaagggaaggcaaggcuggaccagggcuauuccugagaccuagccuagaccaucuuuaaacuuucugucuccuauuaauuaugcccagagcugcaguguuugcucggauacuggaaggaaacguauugcuugcuuuccugucucuucacaggggacuuaaucaaaucuaaaagagggacagaaggcauaaaauaagaaacauuuuuaaagucuaauucaguaagcaguuuuaaauggaacuaguuauuuuuauuauauauuguacuauaugucacauaauauauauguguauauauaugcauauauauauauauauaaauaaaaacauaaauacucuuuuuaguuaucaccucggggcuuuuacuucucucuuuccauacuggggccauuccuucuguucaggcaugcuaucuggacucuaaaccuccucugaaauuauuuuaaacugacaccuuucuucuuuuacagcaggugacgugcuuuaaauuuuugacucuuagguuuuggguacuuucauuugaccucgcagcaacagugggaccuaauuaccacccggaccuggaaaacagcacaccucagucugcagcaacagcccuacacuagcccuacccggcauagguaagacaggcugcuaacccacuucuuagcuccaaguucaccaugcugccuucaaugcuccuggaaagagacuacucucagauccuacacauuucucuucuauguaccucaguucaaggcucaaucugucuugauaaauccaaacuauacuagcuuuuugugugugugucccaaaagcugggauacaauuauccccaaacaaacaaaacaauuuauaaagcacucaaaagaacucuugaagucacucaacuacuauagaaaaguauuuauaauggcaggcucaaauaugcugacaagcuuuacaaacuaacaacuuaaccauagcuugcgcacacaaacacacacacacacacacacacacacacacacacacacacacacacacaggggauagaaccuaacacacacacacacauuggggauagaacccagggcuucucuuauguuaggcaaaugcuugguugcuaacuuacaucaccagcucuuagacacauuucauuuccuauaggaacuuagaacuuagguaccucucaagauuugcuugguuuuuuuuuuuguuuguuuguuuuuuguuuuguuuuguuuuguuuuuuuaaguucaaugaaacaaaguaagacauaaugauauggggagaagaaaugguaaggaagacgaagcuuggagccuucugacauucaaaacaggugagacagagguguaagaagagcuaaauaagucuugcucucuagaaugccagguucgucagauucuaccagcaaagauggaagaagacacauacaacguccagucauugacaggcuaagcgauucaguuuccugcaaguaaacuuuucuuucaaagccguacaguagcuguuguuuuaacugauuacuaauaauaaauagaauuguucugcacucaacgugaaaaguuuccauagcagaaacaggagcuaugugcucacuauacaaaugauaacacauggaucaucgauuugugugggguggggguggggguggauuuaaagaagccuaagacucaggaaacaaauaaaacauuauuaaauauggaagagcagagucugggcucacaggaucgagagaccuugaccguggagucaagcuccuaaaaagcagagggccacagagauucauuuuuaaaugaaucucuguguauaucuuugagguuuuaucugugagcacacgggcuauauaagccaaaggcauuagaucccuggggcuaaaguuacaaaagagccacuuaaaguggguucugggagcugaacucaguugaguccucgacaagggagcucaggcucuuaacuacugagcuaucucuucagcccugggugugugagugagugugugugagaguguguaagugugugugugugugugugugucacagucuuugagaagagaacaauguauugucuuccaacccuaaaguggcuuggcccugauccugucacuuacagucagaguucugggaaaaauuuaaaacaguacuuagaaaguaaugaaguauggaauaaaaaaucuaauauuuuucaccaaaaaagaaaauauauaaaaauucagauacuuaguagcaaauuugaucuaggcuuacggcaucaucacugaauuacuuuuaaaaaugacaacugcuuuagacccagggcgcaaaacuugacuaugaaggaaaacucauccaucagcuauaugguaggaagcccaaagaguacgcacugugugugaauuaaauuucacccacaaaucaaaccuuguucugaggaacugaagaggaaaaagagguaccaaaccaaagaaacuuuggcaagagagaaauacgaacuccuagcucucaacugggagaguguacucacacacacacacacacacacacacacaacguaccugucuuaggauguauugagaagaauccuugaggguucccgcuuguaauucuguaugucaguuugucauuggagcuagaauccgggucaaaagccucaaucuggaccacagauacauccuugggugaguuuuccaugauuucuggauaguacacggguucugaugucuguggcgcguugucauugacauccuccaccucuauguagaccucuaugaaggacgacagaggcaccacgcccugaucuguggcauagaccgugagccaguagugggaagucgacucucuauccagucggucugaagucucuauaacaccuagaaauaagaggccaaagaagaaaguuaacaacaagcacaagaugccaccugugucgaagaauaacaacuccgcugguggcuuaugugucacgugccccaguuucccugccuaaaggaggaagauaaaugcauacuccuuaguggcuggauaaaugaguuaauaccuaugaaaugguuagauauguagcauauaauauggacuaaguauuuacaauuacuagugucaaacaaacuacuuuaaaaaucuaugaucuaagcugggauuaaaggaauacguauggaucucugugaguucgaggccagccugguuuacaaggagagccagagaucccuagugagacccugucuugaaaaaaacaaaaaggcaaaaccaaucaaacagaaaaucuacgaucuaagcugaaaguaacccaggagauaggcacuaagagaucaucucauggucuaacacacuguguuccaaagauaaaauuuauggcugguuaauauauguugaguuuuauggagauuaagcaggaaaccaaagauaaaccagagugagggcucagcuccauggucucagucccacucaguaagccacaacucagggaaagagacucggaguaacuuuccucuagacagccagaguaauugggguaaggcuauccaauccuuaaaaacaaaaaaagcuaaggaaaaaaauaggaaagauuugcaagccucgcauaagagauuacucaggucucuuauauguuaaaccucuuaacaucuuuaaccaucuuaagcaaacagacaaccaguauguuauaaaaauauaaauucucccaguugaacuccaaggguguaucuuuccuagcugcuccuggaguuucugguuccucauacgaaacacagcaacuaugcacuucaugaauaaacugcccaagcuggaguuaggauacagagucuuccacugagauccaaaccagggccguuguuacugagagaacugggaagaggggaaucauauacccaccgaaaacagacccaguuacagacaucuauuaaaacuucaauuccagaauccuccaacaaaguaaucagaaguagaaaugugaacucucuuaagcaaaucuggccuuuccccgauuuccugggcugccacuccauuaaaaugcaauuaaacccauuggacaagugaaguguuauuagaaaauuucaaguagacaagacacauggugguucugcccccugccucucacuucuaaccguuagauauuucaugcugcuugcuugcuugcuugcuugcuugcuugcuugcuuucuuuuucuuucuuucuuucuuucuuucuuucuuucuuucuuucuuuccuuccuuccuuccuuccuuccuuccuuccuucuucuuuccuuccuuccuuucuuuuucuuaaucauaauucucuugauguucauaaagcaaugacaauucuauacacaauuuucucuggauucacuccaugccagacaucgugguagccccgugcuguaccgugacaccuuuccugacacgccucgacuagugaugcuauuguuuccacuucaugaugaaaaccucagacgugaggaacauucccaguaaagggcagauccuuggaacccagagccagcacaaagccugguccugucuauucugagcacaaugauuggaggauaaagaucaauacucaggugaagauuauacauucauucaaauacaacagcuuuaaggagaagacaugaaaugcaagcacggugugauggacgaccggugauuggcuuuccuuuacauuuuuuuuccucgucucaucuauguagccuucugcuuagaacugguucuccgguccaaucaaccacgcacagggcaaaagucauguucaucuugaugugaaugccuccuaagaacuccuagcuauggccaggagaauagcugaguauaaggaaagguugggaacaauguuguauuaaauauuaauuaagagaguaagacuagggaccgugaaggccacuucccuauggcaggaagucagguuacagggauggaccgcagggguugauaggaguccagcccauucuuuacagaaagccucagcucuaaaauaauccacaugccagucaucuagaaguaugaccagaaauaauauuuauucuuugagucacucugaguccuuauuccuguaaucaacacagcuaccaccaacaccagggaaagaauggcaaauaaaacugacaccuucgagccaucacggggugugaaugagacaaccauacucauucuuaaaauucuacuccucuucuuaauucucuugccucugagucaacuuucaaaugcugauaaccagugaugacuuuuuuuuuucuuuuuuuucuuuccuuuuuuuuuuuuuuugcauaagaaguuacaaacuuguucuuccugggaaaaauaaaaucuagucuuuaaaugaaucuuaucccgacuucgacaaccuguugcgguuuucccuccagaccugucuguuccuaguuauaauuuucuaucuuucauuucuuugcuuuuuaaacaaaagcagaaugguugcuaugagacagaaucuccugccucuguaucaggugcugggauuauggguccuuaccaaaccaugccuggcucucuuucaccuuuuagauagcagugacaguaugcaauuagaggacagauaaggccagggugucaagaggaagaggcaacccagccuucuaaaauucccucugguuagaugcagaaguaaaaucuaguagaauggggaggaacaggguaaucacaggacgcuuaucuggugaggaaugugggagccacacaggaugaccagggagacuuucaaugacaaccaugcugcgcacagaagacagcccagacaugccuguacuaugagcugccagcagugugcuauaaucaggaauuguucccuuucuuuaaugaaguauuacagaagucugagugcccaacuuucuaaccuugagaauacaaugaagacauuuuuuccaaaaaaggcugcuaauaagcugaacaaccugaaaaagggcuggaaaucugaaaccauuagcuaaaacuauuuaucauuccuaacgugcuucacgggauugcaaagccaccaccagaugucacuauggaaacugacuuuaaauaugcaucgguugaaauugcuacuaugcugaagggagagaucacgugacuucuaaaagagcacucauccauaaaugggauaucuuuuaucaaauaccuagggauuuagggauggaggaggaggaggaagaaagaugcuaagagccagaggugauaggggacucugaggaaacaagagucuuccagauacugauacacagcaagaaacuaagguagcacacacaagaccugugccugguucaaaccaaacaaaaccccugcagugaacacaggaaguagauaaaaagucccgccccuaacaagaaggcuccugcaaguuuugccugcuggcaaagagaaagucaguuuucucgaugggcgugucaccagguaucucaaccagacccgaggcacacccugugcugggagaggaggccaacacaagaaaaggcucccugggucuuuuguauuuuugucauauuguuaagguuuuuugguuggguuuuuguuguuguuguuuuguuuuguuuuguuuuguuuuuugguggguaaggaaguagguaggaucuuggaacuggggguaagaaaaagaauauaaucaggauauacuauaugaaaaaaaauuuaauuaugaaaaagaaaacauagcuguggcagacccucgucccagaaagacucagcagauauuuaaccaagucgguauuggugucauuuuucccuggccugguuuuucuaggcuuguggcacaucauaccaauugcucaagaaaacaguuacagguccaucaagcuuuccagucuugcuaccacuaaggcugguuucacugucacuucaaauccugucugcccucagcaucuaccucacagcugacacuguggccuccauuccaacauagggacuuuuguaaggcaaaaugacguugccacacugccaaaacaaaacaaaacaaaaagugagugauucaacuuuccaugcccacagaacaccucuccuauugaaguuugccaauuuuaguuaacggaccaugguugcuagugggaccuagugccagagauucugauaaaacuguuauuucugaaucuuuggauacuccuacucaaaaauaaaguucagaacacaacugcacaguagccuccuuuaaaacugggaggggcuggggaugcaacuucacgagacggcacuugcuagggagcaagccucggauuugggugccagcauuaagucacccaacccuuaucuccaaauguugcaguuuagugucuuucuauuauagauaccuaacaccugggacaaguaaccuaacuugauagaagcguuauucugucucacaccaucagaauaccaugaucaacagucauacugauaaaugucauagccuuugaggcuuuuaaaggagugaaaauuuuaaaucugacucaucuuuaaaauaaccaccaauuuuacaugcaacauuaucuaauaagaaacccuugaauucuuuuagaacugugugaucgaucacauauauacacauauauauaaaacauaguauauuauauauaauauaugaucacauagaugucuguauggacauuauauaauauauacauauauauauaacuuaauauauauuauauacaauauauaauauauagagaugauuaauauauaagaugggaaaauguaaagacugaaauguaaugguuuuacuuuguacagaaacaaugaaaaacuaaauucuaguacuuuugaaaaccagaaugcuccaugaauauuuacauguacauauaaguaccuaaaauuguaauuuucugaagucagaugacuacagaaaauaccaaacacuuuauaaguacugacagucagcuggaagcgcugccuccugcuuguaaucucaaggcucugaggcuuaaguaagaaacugccucggacggaguucagugccagccucggcuccagugugaccacaugucaaauaacagaagaaaugcaagugaacacauaaucgaaaaccaugucuuaggggccacgcacaguccuacagagaaaccacuuuguauuuaagaacauaaucagccacagauaaaaucccagcagagccgaggacagcuacugaccaacauggcucaauccuucacagccaguaacuugucacggcugucauuuauauccgggaacacaggaaauccacggcaauaaugguagcagcagcacucgggagcaccacugacuucugaauagauauguccucgcuggaagcccugagaugaaucacugggagggggcuuggaggauucaaagacccaagccagacccagugagugagugaguguguguguguguguguguguguguguguaugugugucugccuuugugugucuauguuuguaugugugugucuguguguguaugccugugucugacucucugaacaugcacacacauuucuucagagcaauagaacacuaagacagguacauuggcugcaggaagaaaugccaaugguguacaaacugaguaaaaacuaaaaaucugccuuauacacauuaaaagauaugcagaaaaacaacagccagaauaaacaagcugaaaggacgcagaaaccuagugggcuaaaauauuuucauaaaucuguaaauuucaguaacaguucaaaaauccauacugaaaaugcauacaauaaguuaaauuaaaaaaaaaaacaaaaccaaaaugcccucucuguaguaggauauucuuaauucuuucucuagaucacagauauguaucuuuaaauagauuuuucuguacauauuuaagguauguaaaugguauucaggcaugcauacaauuaaaaagaauauucauggcuaaguaaauuuauauauauauaguuucucaaaacuacuuuucuuccuccauugcucguaagaagagcagccaagaucuauauacucauuaggcuagaacccaaaaccaacacaauuuaacucugucuuuccuugugccuuagagacgcaugcuuguccauucugugugucugccucucugcaggaaauaaaacaaauauucauuuucaaggaguuaucuccauuucauguacaguaaguagauguuuaacaaugcauacuguaacaccuucaacaauuaacauuucaaaguacacuuccaagaaugcacaagguuuuaguucuaagaugucuguauuuuguugucuagcacuaagcagaaauuaaugauucaagggagaggcuuuuuuuuuuaauguggcaauggucauauuugcuuauuaucuugucuuauaucuccuuaauuaaaagaauguguaucucuaaacuuccauuugaaacuguugagguagcuuuaaagggagcuaagcaagauuuuaagauuugaagcuuacuggucuuacauuaauuaaguacauaaucugauuuggggcaucacguuucaagccuggagauuucuucagcucagcaacgagucacugccagggcugccuugcagaggacccacuccacauucagauguccauguccgaaucguugauacuucuuaucagggcucaaauggauaaacucucuuuguaaaagaggggcuccuccucggguauuaaaaauuauccaaauaccaauacauaugaagucugccuuuggagaaacuuucccccuuuuuaggcuaguggaugcacuucacaaguaccuuacacgcaccaaauuguguguguguguguguguguaugugugugugugugugugugugugagagagagagagagagagagagagagagagagagagacugacucacuuuauaguucuggcuguccuagaccuuaccauggagcccugauuggccuuagauccaacagccugugccuucugugugcuaggauuaaagguguuuguuugacacuguucaugcaccauaaauuuaaucucaucuccaugguccuguaagcucaacgaguauuuucccauuuuaaguauuuaagaauggagaccugaggcugaagucacaggucuaaaauaacacaccagucauccuagcagcaucuccacaaacuaaguccccagcuacucgucugcauguucugcaucccagagguugauaagcuucaaaagcuaagagagacuucuucguacauugcucgaccugggaagaaaagaaccagaaccuaagacuugacuaaaugaauaucucuggaggccacaccagggugcugcggucuucugcaagggaagguagucgcuauccaucuguuaaggggaaguuacacacugucugaaguuggucaacccuugacuaugacagagaagcaacaugguugaccugaagaacccaacuaaaggcugaggagccgauuaaggaggcucaggggauacaggugagugaaucccacgaagacaaagaaggaaaagccugcaacggaagagaacucugcagcgcuccaccacaaacaccacaaaguuacuauacgucguaccacagcaucucccuacguugcgcagacuauacucacacuaaaaugauauccuguauuaauaguaggacagauaucaugagauaacugggaauacaauacuaauguuaaaauauuaagcgggaaguaucggauccugaguucugaaucauaagccaguuuuaaguuuauacaaauuuccgggugugguggggcacgccuuuaaucccagcacuugggaggcagaggcagguggauuucugaguucgagcccagccuggucuacagagugaauuccaggacagccagggcuacacagagaaacccugucucgaaaaaccaaaaauaaaaaaaacaaaaaacaaaagugacaaauuaagaaaaaaacgcuuugggaaagaaauagauucccugucaguccgaauucaguccucagcggugaccuaucagagauuugaaaacuaccgcaugcuuuaucuuccucgucaacagcagcaccucaugcuguuuauugaaucuugaguuuggcuggaaauaauguagagcucacaagaaugccacuuggccuaaugcaugugaccaacaugaaguuccuaccaugugccaggcggccaaggaacucagaagagaaagacggggucucggggaggaaauaauuaagugaaaauucauucgccagaccagcagggucaagaaguguuuaagaaggagaacgcugaauuuuaccaucuuaguagaucacagcucucucccaugaucuuacacaauaaucacggccuagcuccaucuugaggcacugggggguuagaacugugggcagacauuaauuaguuccuccacuugacauuuucuaacuugugccaaagaaguaucucuacugauaugaauuaaagcacuguuucacuaaggguuaacugaaggccuuaucaacacacugaagaaaucucaagaauguaaaaggugagggcaacguacagguuucccuaagccgacuaacgaccgcuuagagcguguguaugaaaaaguuauguuucaguaugaagacaaagccccauucagggagugaaaugucaguugaaacaggcgggccugugccagccucccaggcuccuugcuaaagaaggaauggaaugagcucgggccugccccucuccagaccgcccagcucacugcacacacagagcuccugccaagacggccaguugucucccaguccuagagugcacaagcuggaagagagcagaagggagcaggccuccccuucccugagcccgcucgggcuccuacaaaacagaauuuaaaugcagaaaaggaccggcaacugauucucuaaaaauaaaaucuaagauccauacgcaauucagcugugcaaaaaaguaaggcguguuccacgagaacggagugccaaccgaacaaauaaaaauuccacuugcuuuggacacuugugcuaauggggcugggucagcucccaccgccuucuuucuuuuauggcuagaacuuuugaccagauguguggcagggauuuuuucuuuuaacuuuaauaaagcaauuucucaauuuaaaaaaacucaaaguuacuuacauauugaaaagaaagaauguacaggaacuauccaaaauacucauuuuugcuguuaaaucccaaaauuuaucagaauucaaacacuucugggugaaucuaagcaagucauggacugcuucagaaacacugcuugguuacuuaguagauagaaacccugaccaccacguuuuaugcuagcaaacaucucagauuacuucagcuaucuccaaugaucucaauucacugcaagguuugauuacacagacccgggagccuuuguucaaacagaggucaccgguagggguccugcauagguuuucugaucucccaguuuucuuagguaaaugaaauuauuuacauaacugaggaguucuaauuugauauuuuaaugacaaaagauagcgugcaaaugggugcuaagagaaguaaucaagguuagggaaucuaggcaggcagcauacaaacaaaccacccuaccaagauuucccaaccuuggugguggcggguuaucuggaggacgcuauuuuaagcagauaggaaacaaucaaggcucuugaaaacagugagcucaguucgaagacuaagaaaagcuguugcugauucaucaguucagagaccaaaaaacuacaacucuuaagacauggaaagacgaaguuaagaacagacugguagggccgggaagguagcucaauugauaaggcgcuugguaggugaguaugaggaccuggguucagaucaacaauaacuacauuaaaaaccaugcagaagucuaugccuauaaaucccagggcuggggaggcagagacagaagggucuuggggcuugcugaccagguagugcuacccauucugugaguuccaggcucagugagaggcccugacuuaaucacaaauccucaaaccauuacucgggagauuacuauaugacuauuucaaaaaugaagaauaaaauaauuccagcacuacccagaccggccucaagcucaagcacgccuggaaucaaccuugcgagugagucauggacuacagacauauuacaggcauuugcucccacacugagccguaaugaccaaccucugcacuuacgaagaagcauuaacuccguagagagaaagcuggcuaacagaaggacguuauuaugaaaacggcuccaagacagagagcuacuggaaucacuggcaacuuuuuggcauggugacauggucuacaaaugacccugggacuaagacacaugcggccuguggaccucaggcuggauaugccuaaaaggucuggugauccaucauacuagcaguuacuuaaacaagcaacaucaaggaaaaaaaaaaaagaguacguguguguguguguguguguguguguguacugcauguguggaugucaaaaaaguccauacugaugccuuccuccacugcccuccaccccaucuuuaaagauuuaucuucacuugucuguaugaguguguguaugcguggauacuauuuuauagaggccuccagagacaagaagaggacaugagaucagccagaacuaaagguacaaagguugugugcugcccaaugugggaccuggaaaccaaacacaggacuccuugcagggagagcaaguguucuuaagucccaagucaucccuucagcuccuccaccauauauuaagacuagacuggcuagucggugacuccccaggguccuccuguccccaccucccagcaggaggacuucaagcacugccacuacaucccauguuuuacgugggugcugguccuuacgccuguguaacaagcucugugcccgcaaggcguguccccugcccugacuaaagacaggcagccacugcacuccuccacaaagacaggagcggagccagaggacuucaggaugauguuaguucuaaugggcauguaaaugugacaugagcacuguguacaucacuguuggcaaaacaaaggcuccauguuuccccaacuccaauaaaauacagaacugguuuuuauaaaguuucacuucagauaugaagugaaauccaaacugggggaaauggcgugacaaacgccuagagcacaaacggaauggcgggccagaagcaguguugccuccugcucucguugcuauguauuuucauuaaauuuagucacugcugauucucaaacuagccgaguccgugaaacucauccugaaggugaauguuucaucccuauggaauacugacuccuuaguugccaaaugaauuuaucagcaccauauuaaggagacaagagacauugcaggaacccuuccaggagagcugaaagcaagcccagguuguugugaaugcaggacucugaaucacacaccuccuugagaguucccucuacauacugccuuaccuucugcuacaaaaagcugcccuugcuucuaacauggcuuuuaugaaugcuaugcauaaagacaacuuuucagaaaguaaaaaagcacguuucugaaaugaaaaaaaaauugcuuuuaaugauuuuuuuuaaguaguuaaaacagcaaucuggcuuauaauguuuauauccaaaauaaaaucuacugccagacagguaaaucgguuuggguaggccauccaaacugagaggagccaugaggcacacagaagagcauuuuucguguaucuugcuaucagugaauacagauuaucucagaggcucugcgggaagccagagguaaagcucagacuaggacaaaaacugucagugggcuuccaggacaauaggucggccagcagcaagaagggggugcacugacccccaagcccagagagcacaaacuccuggcucugagaaggccuggcuguaguguaggauguggaucuucaggagagacaaacgaccaguggccucuggaacugacugggguauccuggcucaccuagcccaagcucaaggcaaacuuagaguacaacauacaaacaggacuguaugugaagacucacugccguuuccguucagaagguaucuucagacaccugucuuuccacucaggucaccggaccuagcuuuuaacuccucccuggccggcuuucccggccacucacucuacaggggcacugaccaccacgugccaccaaggugcugcugugccauuuauuucccuacacugcugagcuccaucaagguggggcucgaaggcauggaguucauuugguucaccuuguuucaucuguagaaagcaagcuucauaaagaacauagcacugucuaccuugugucuaccuuguacauggaagaccuccgccgcacucugaacacguucuggcaggaggagcuguccauaggugcuaaauacucggaauggaaagcaugcagaacucuuccgcuaagucagcgguucucaacccuccuaaugccgccacccuuuaacacaguuucuccuauggugacucucaaccauuaaaucaucuuugaugcuacuugauaaguccaauguugcuacugucaugaacuguaaugcaaauguuugcuaagggggggggggguuugcgacccacagguugagaaccaguccuaugccuuccuucgucugcaaugaaggguguaagggugauggacuguacacacucacugcuaaugagcaguccuuggggcacagguggcauccuaucccacccccaccccacgcugggcucccacacucugggcuaauucaauaaacaaguuaucgucuuccgaguacaggaucagcuguucuuauacuuuguucuucacucugcaaguuacccauuugggggaggaaugggagaaauuucucaaaaugguuaaauucucucaguggcaccucuaaaaucuucauagacccccucccaaaauuaaaccacaaaauauugcauaaaaauauaagaaaacagaauuuuccaguuuuuacuacuaauagcucaacaggauagcuacuguaucaguuccacggagguaacacagacaugacucacuuaugcaaauaagugaacaagacaauuaaaugcccagcuagaacuauacauacgcgcuaccuccuuaaggaaguaaggcagaacucgugugcuuuauuagagaaugaacugucuguaagaagccuucuucacagaggaaucucaccugcucacucaauuaaaugauuauggacugcauauuugacaagaauaagguacacucugucuuaagcuauauaaucuagaucccucccccaacuauaaauauauccaaggacagccuaaggcuugcaggucugaaaccuugguucaggagggcaaggccagcugugugagagaacaugcuuuuauaauuuuauucuauaaaauuucauaaauuccgcguuggcucccauccaagacucacuacuguugggugcuucaucccuagaaaaaugugccuuccacaccucaguauuccgaagccggaguggcgcugacacuuggccagcaaucagcugacaaaaacacccuccccacuuccucuuuaggaaacuugaaacaaucgccaugccuuuuccaaggcagucaauauauccuugcacaagugaacagccagguguuaaucguuaacucugggauagcaggggcgagacaagagcauuaaugguagcacucagacacuuucaggcaaacaacgcagacccgguagcaauucagcaacaauggaacaacuauaaacaacauggugaccucucauuaaacacagacguggcuuggauuuaauacuuggcuuuuaguuuugacuagcuggaaaggucacucuccucccacuuugccaauuccuuuuauaauccaaaagccgugaauuugggaauuaagcagccaaccccacuuaugccugaaacacuguaucuucgagggaaaauuaaaagcuaaccagugcccucuauaaucccuugggcaaaaaaggugaaguacacagggcccagccucaaagccgagaugccagcugcaaccuggaagcacauuccuccccuaucugccauccucggaugaagcucgccuuucuuucacuagggaaggguacuccaagggcauugaauccccaucaaacaaaccagcucagaaaggcaaggaaagggagaacaaacccuacauuucaggaaguaauacgcugaacccaggcguugccugcauccuucaguacugucuaccauagcagagccguucagaacugcaauuggagagugugcaauuggugugcucucucacaccagagcggccacuggugugagagagcaauuaauuuaaucuauacacugauauuuguuagagcauaaugugccuggccuagagacuccuaguucaacagagagaucuucauauacuuacauucagauuuuacaauuagagcaggagaaagaacagaaacuaaaagcccaugguagcuuuagacauccuaauaacagaucgagucauccuuuguccucagauacggauggauuauacaaucaacacauuuaguucuggcuaucuuuuccuuuggguauauuuuagagguuccuuucuagaacuuuugggagaauuucccaaguaaacugccuucaaaaauguauuuaguccugcuuaagacuucccaaauauggaauucugugacugcuauaacucauuuuuauaaagccaacauacauucuauggcuucucuaacaggcaaggcuuucucuuaauuucuacucagaaucuuucccuacaggugaaguaagaagcauuggguuuugaacucuuguuuaguuugguagguugcaccaugaagccccgaagauuuauuccugcaucuguagguaauggacaauuuccaagcacccaagcaguggaacccacuguaaagaaaucuguucccuuuagcuucuauaacauaacaaucaaacaaaaccuaccugaaaacacgcacaggccccugaguccugugcugcccggcucucugagccaccuaagacaagccccaaagugagaccacaaauggccgaggaggcaagcauuuggaaauacagcccugaaagagcuauaaucaagagccccacugaagcaggcaagcacugucucauuuacaagcaauggauuccuucccuccagaugacuaaagacacauccguucagcaucucagccucuuagaugagcaguaccccuacuccccaaaggcaggaaccuuagguaguagcuaccuuaaccaugugugcccuugguccuccacccaaauucguuagggcucuccugacacauacuuccaucuuuaccgaguaguuggugagcuacauccuacagugcaguuuuugugaauuaccguaauuauaaggagaauacauuucugagcuucugacugugcggcucgcuccuccuuuucccaagggcucacucuuaccuccgcucauguaaaucuguacauuaaccuauuacaucucucccagugcagcacucugccuggagaacaaguaucauguguauacuuaauuccuaaacccacagucuaaaugagcaacucugaaauagcugucaucugcuggccccugugcucagaacagaacccuuggcgucuauggacuucucacaggcuuugcugaaucguggggaggcaggaacagauauugacucaugagcacacaagugucuguaauacccacucaccagcacagggaccagaggucaguccugggugugguuccucaucccucucagaguuuuguuugucgaucuuugguuuugguuuuugggacaaggucucucaauggcugucagcucccuaaguagccuaggcuggggauccagaagcccugaugacccuccucucaaaucucucacuuaggguuacgagccucacccagccauuuuacgugguuucuaggagggcaauucagauccaagcacuuuugugagcggagcuaccaacacaagcuuuccuaacuuuucagccugaauuaagagcuagaaauggcuuguugcuuaaaugcaaauuuguucgucucauagcauccuguagugaagacuuuugucauugaaucacuacugcuuguuauauauguguggacacagaaagggggguuauuuuagaaaauaggaaucacuuagagaaggaaggaagaauguauaguuugggaguuuuaaagguaaagucacuuuucaaauuuaaaaagucccauggcaacuaaaaccauacauucuucuuaaauaugauguugcagagcaagcagcauccagccaaggaaaauaaaaguacaacuugacagguuucuccuacacaaccuucaccaggcacaugggagacauugacuuuauaauaaugaaaaaaaauuuaaaaaaaaaaccugaaacuuaauauauaaaaaugagucacaggauguuacugggacaagaauccaaaaaaaaaaaaauccaaguuaaaccagaguacugucccaaaguuuggcuuauuaaaaacacacuagauuuccaaacaaagccagaaccugagccccgcgaucaacaucggcuguuuccacgcuaaacggugccucuggccaacugguaccgguuugauuucaugaagucuaaaugacucaaaggcagcagcaagacagccaagacccaguaagcugcagguguguuacuguuuccauccagaaauguggcaaucuguuuuaccccacccccaccccccaccuuaaccuacugaccuaggaacuccauuuccuagaaugcauacaugccagguaaccgaagacacacggacaagggagccagguaccuauacaaaagucacacucugcacgcuguuaggcucuggggagccgcagcuuacugccccagauccuacucuugaaggguguuuacagaccagaaaaggcuuugcccagacuaaagggcagaaagccgguaugucugcugugggggaaucuaccucauagugcucacaguaagaugcagaugcacaucagaaaaaguuuccacacggcguugucccgcagggucuucuccuaagcuucauguagcccuacauuuucccagauuucuacaauacucuccuuuuucuuuuauggaaaauaaagauuguuuuuuuaaaaaaauaaauaaauaaagguaguucuuuccuaauuuugucccagugcuauggggaauccacucuucaagaaaagaaucaacauuaugcaaucauucuuuaaauccccccuuucaagaccuuuaauggggacuucagaagccgggcagaagccccagcaggaaacaaauuugcaauucaacagacgcacccacugagagacugcaagaugcacccucgguaguuuuggcaauaauuuccuuuuaucauuccuuugcucccaagagcuuuucaacuccaagcaagcccugcagaaguuaauaggcucuuaauauguucuccccggccugaaccgauuccuguucauaagguaauagugggaccccaggggccccuuucacaggggcuuuagcaaaucuccugcagggggauggccccuaggcagcuccgcuucucuacagcacaggcaguaaccuagucaauagguuccuagcaagacaauuccuacauucaccagccccaagaaaugaagugggagggaguugaagcuuuauugaggaaagagauuuaccugucaccaugaugguuagcccugcgggaguuuaaaaaaaaaaaaagcaguuuucagcugcuguggauuuccuggucaacagccagcacuaaauaaacauauuuacuuaaagcuucauucacaacuuuugaugugaaaccugcccaagccuaacuggaaacagguagauuuucuuucuuucuuuuuuugagauacaaggggcagcggggacaagaugacauagaucuaaaucgcccguguucauuuacaagcaaugacaggagaaguacugagcauguaagaauaaacagaaaagucagcaggugugccuguccccaaguuuacacagaaagaucccacaagcccugaaaauauggccucguuaacagaacggagcaaacaacacugaaaccacacagacaaaagguuuauggaggcacaacuacuuuucauuaacgccucucguuucccgagaaggggaggugagguuuaaugauuacaaguuaauaauuuuggaaacccaugggaccuucccaguuaacagcuuaugauuuucaaguucacuucaaaauggugggcucagacuaaauaaaucauuuggaagauugcucaguaaggagcuguuuuaagccaucauauguaggugugugagaagucaggucucacaggugaagucaaguuagauuuacccacccccaccccacccccaaaacccguuugagcggagcaguuucaauacaauggacauuuauucacucagaauuuuccaaaagcuacccacuggacaguuuuuauauaggaacaaaguuuaggugugaaacugaucggugaguuucuuccccucucccauacacacacccauuaagaagacagcgccaaagucaaauaauuacaaaagucaccuuuaagaacugcgucacuguuaagguuuuaaagccaagucagaggccaguguuucgccaucagcaccucugacaaaggcauuucugccacagcagcacaacaacacuuuuaacgucuuuguugagacggcaucaggccaggcggcagcagcacuggacugucucugccaacacuucucucacaagcgugcaccaacccaucacugggaauuccaccacggccuugcucagaugacaaggcuuuggugguguccccugcaaaauacccacggcaaaauggaaagaaaagagguacccacuaacguaaugacccacccgacgcccccacaccccacaccuccagcaacgggaggaaaaacuguaauuuuuuuucucacuacuaguuuuuuuuuucuucagauuucaguagccauauccucgguuuguaauuaucauguuccccuuccucuaugaagcccuccaugaauaccuaauggcauuaguuauuacaaugcacuacuuaaagggcaugggaaaccagcggcuggcugaaucauaagcagguagcccccauaccagcuagcugcaggaguuaagccagggccacacagcuagacucggggugagggaauaaacacgguagugcucgcugcaauuuuuuuuuaaagggauugcagaugauugagaaauaaacuugguuucccagaaccagcucugcucccguccuucccaaugcucauaacuaagacagaaaaagaccgaaaggcaaaucauccgacacccuggaagcauccagagaaugaguuccagauucuaacuaaucuaagagugugaugcuuuguauauacuuggcccagggaguggcacuauuaggagguguggccuuguuggaguaggugugucacugugagugugggcauuaaaacccucuagcgcugcccugaacucagucuuccacuagcagccuucagaugaagaagauguagaacucucagcucuuccuguaccaugccugccuggaugcugcaauauucccaccuugaugacaauggacugaaccucugaaccuguaagccagccccaauuaaguguuguccuuuauaagaguugccuuggucauggugucuguucacagcaguaaaacucuaagacagggaguggcuuggucagaccuaccuguagugcuauccacauuagacuccaaugaccagcuacccaaugcuaacugacaaauucauccuguacuuaaacccucugucuuaacauguguuguggcccaauggaaccccaagcaggacuagucaauuugagacaggcuguauuauuuuaaacaaagcacugcaacuuaaaacuauccuaugaaaagaagaaugugcggcacuuuccaacaaccggacuuccauccccgggacccacaggguggaaugagagaaccaacuuccacaagcugcccucugaccacauaacaacuagaauccgucacucgaacacuacucuguucaaaauggcuacaugucuauuuccccaggucagaguagccaaagaccccaauccuaaccucaaauucuccagacagaaaugcuaucuggaugcguggggagcuaguccaaucaaucacuugagagaaacagacucacuucagcugaucucagaacacucucauauucuguugcauuuauaucuagucuaaucuaaguuauacuuuugccuaacacuaagcagaauuaaaauguaucaaauguaucuuuaacacauuucuuucuuuuuuuuuuuuuguuuuuuuuuuuuguuuuuuuuuguuuuuuuuugagacaggguuucucuguguagcccuggcuguccuggaacucacucuguagaccaagcuggccucgaacucagaaauccgccugccucugccucccgagugcugggauuaaaggcgugcgccaccacgcccggccauuucuuucuuaauacauuauuuuuauuacauuucuuuuuuguuuuguuuugcuuuuccagacaggguuucucuguguagcccuggcuguccuggagcucacuuuguagaccagucuggccucgaacucagaaaucugccugccucugcaucccaagugcugggauuaaaggugugcgccaccacacccggcaauacauuucuauuuaugcugaaauguaaacagaaauaccaaaaguguggauuaguuuaaauagaaauauauuuaaaauagccugaagauguauuuuaauaugguacuaugcuuugguauuaucuuuuuuaaaaagugagcuauguaagguagaaguuuaagacaccaguuauuuucagaaaccauuuucaaaagccuguaauuucuucaguauacuuaacuuguucucucccaaccaucuuccucuccccacccccacacacauaaaagagagggugggggggaggagacacauuggauaaaaguaccuaugcagauugaaacaugaacacaaaaccuggaacaccuuaaaacccacuaacagguagguagucugguuugaauccgccuacuaacaagccaaccgaaugugggagaggcaacaauguagcauuccugacgucagccuuaagagaagccugggcaccuuugaguuccuggggccaccacgugaacaugacagcccgcgcugagaacacacuauaucaagccaacaccagaagccuagcuacaagcuguacugcagcuaagcccagaagaaccuagcaaagaaaacacccacagaugcugcacaaauugugacagauagcuccgcccaggcucuggguuucccuuccccuacuccaugugggucuuccacauaaucuagacucugcuuccuacgcugcucaaccuuucuaacacucugaugcaucugucucuucugaaaaggauuccacacagaugaugaggaagaaagggcuccuguccuucaaucuucccaaggauacuucuaauuuuaugcucguacagguuaaaaguuuagaaguggaggcccaaauagcaagaaggcagacaaaagauuaaaaguuugugccgggugugguggcacacgccuuuaaucccagcacucgggaggcagaggcagguggauuucugaguucgaggccagccuagucuacaaagugaguuccaggacagccagggcuacacagagaaacccugucucaaaaaaacaaaaaaacaaaaaaaaaaaccaacaacaacaaaaaaguuuguucagauacagucacuaaaauaggguguuuuaauguauuuccuggaaccguuuuuaguuucguacauauuaugguccuuaaaacaguuuggcaaccaggaaugggguauggguuuauaaccccagcuacacaggagaauguggagagagguuugcagacucuaggcugccugaacuacugaaugaguccaaggccagacugagaaaacuggugagaucugucucaaaacacaaaauguaaaaagaaggcuagggauacagcucaucgggagaacacuugccaagcacacaggcaaggcucuguucucaguccccaguacuccaaagaaauggggggcggggggggggggcucuggucacuuaauuaccucccauuauucaaccgggcuuuuaaggaguuugcuucuaaguuaauggcccccaccaacagaaccauucagauuauuaugguguaucuguguccaccaugugggucagagggcgcuuguguggaagccagaggagaauucugcacaggagucagucaguccucuccugcaacacugaaauggcuuccaggacugaacaaguagcuuuaccuggucacccaucuugccagcccuggcuuaucaaaaauuauaucucugcaugugcucagcucaaugcagacagcuuuaaaggugcucugugaacuuuagaagccguuauuaaaacugcagcuuuaagaaacucauuuaacaaugccaaccaaauauagcucccacuccuaaagagagucggacgagaacucaaggcuuggccaaaugaauggcaugaaaagggauggguauucgaacauuuuucaggaggacuauaaagcacacuaucaccauucugcaacugcagggaaauaguucacaccccaggaacacgcagagaccgggagaggagccucagaaucggagacucuucauucuaggcuuuagaaugcaguaugacaaaugaagccguuucuacagagggggaaauagaaacccaaagaggccagcaucguggcuggacucacuucuuguucuaauucuuaccuuggcacguugacaaaagaaugcuuuucaagugaagaaaauagccacuaccuaaaaagagcgugccaagccacagaacaaauguauaaggucuuuccagcagcguuuauuuaggugcuugccuuuaccauuuuaugauaaucauuuugaugucaauuuuugacacauccaaggaaggcuugaugcaugcucuugggccaggcagugcucuaaggcaugagacacagagcagccucugccuccacagacccugccuucuaggcggacaaggcagauuuuaaaaaugcauccacauaauuauuaaaauguaccauaaguagaacaaauuuuaaaaaccuuuggcccagaggggaagagaacgggcuaagccaaggaugugugaaaaucccucacagagacccacuauuuuauaagcuaacuuuaaaaaagugauuugaacagaggugcucugcauggcuugacauggguuauuaaaugaaacucccaggggcugggugugggauagcuucccacuaguuacugcuuggagaggaccccagaggucuccaaaacaacauaagcuauugcucuugguugcccaccagaacuaaaugcuaagacccuauugcuggagacaaaacacacuuugguuacaggacccagaaaaaaaaaaaaaucagguugcgacugaccugaaaagucccucccugcugguuuguucucucgcucuggcaggugauacgcagggcagaagauaaacccagagagaagacaucaaugguccuaaucagugcuggacccugagugccacaaaacugaccugccaggcaagacacgccuacgggggccauaguggcgugaagguucugguggggcgaucaaucacuuuccgauuagaucugaggcccgcuccauaggagggaauucaugacgggugcuguaaaucuggucaaaagucaaaggcuugggcgaucguagaguccaggaggggagccuacuauugcuguuuuguugucaaaaucaccuucucagcacuuauauucauaauaacgcuacuccuauaggaacucccucagccagggcucaggaacauuuuggaugagaggcagaaagagcgugagagucaagggacgagagggugcugagaaaucauguccucugccuaccgcagggccacuguacucaagcuugcuacagguagcaauggcuggccucaguuuagggagggaagaagggagggaaggugggccauaaaggaagaggaagcugagauuagguaagauaaaaaaaaauuucaaagcucuucaaucauaguguuauacucuaugcugugaugcuuauuaauuaggucuuucugguagcaauaacacagacaauuaaaacccaauacaaauuaucuguguucacacuucucuaaucaacacccgacagcuguauaauguuaucccaguauuauaaagaaacacuuucugggggaauacuucuaccaugugcaucccuccugccuuguguccguccccucaaaccccggcagaaaacaccacaccuuugaagauccuuccaaggcauuuccaucugaaauaauggcuuccauucuguugccuauaauaaccaaaugaccucagcaucaacagggccagcucacccgccuuuaaacagcuuaaccaucuucuucggcugagcaacaaaucccaagaugaaaaacaccaaacaacacugguuugguuuauccaaagauggccaucaagaaauaucaacugugugccauguugucuuuuuauaaaagauaagaagagaaggaauauguuugcuggguguguagucagguguggggggaagagguaccucugcgggcccaugcugagguauccucucccccugagggaccagcuucaugaugguauaauauagaauagcguuuauucagggcauggggaaaggaguuaagaggguaguagagacgagagagaaacgcagagagaguagaggccggccaugagcacauggagaggcggaaagggaguugggggaggggaaggagcaagaggacagagcaagaguaagaagagagagaagagggaucgagcagccccuuuuauagugagucaggcacaccuggcuguugccagguaacugugggguggagccuagacuaagugcuaucaugucagguacuaggauaaaccggaaguguccuaauguuaagaggacuccagacucaaguuacaugagugucacugccuuuaagccacagaucagaugucugccacugguacccugacuucaucuucccccaaagguguuugaaccucuuucauaaugaacaauaaccucucagaagaaucacuuucgugguuuguuuuuguuuuguuuuugucuuaaaugagaggccuacucauaaaucuaaccuaguuuauuaaauccuacauaccuugauuuauaaguccguguggacaggaaacuugagucuuugagaaaacugacuuugcuacugaaaugugaguuuucugacagcuuacccaaauaaagaaagacaugcuaguaguggaacaagaguggucagcuggcucgccuaaggacucaaugggcgcccagagagcugcuuaccuuaaauaaaaauagccuguaauguuuacuuuuguggccguguaccucacacaacucaauggggaggcagcacgagcuuaccaaaaaaaaaaaaaaaaaaaaagcuuagcuacauuggguuaagugcccugucauguauauaagaagcucauucaaaugagcauuauuaucaucagguacccuuccucucuuggucagucuccauggcaaccugugaagacuggcaacuuugggacacuggaacagagggauuuaaagcuggggccucuaaggacauggcagguccaucaauagagccucagcccaggauugagcacaggcugcgcuccucaaccugcucagccucugaaggcagaucaaacaucuuuuaucagagcugcaaagcuucuguggcaaccaaacacgcagagcaaugcugucucccgagguuuagaucuagguaucggggacguaggacauuugcacaaucuucauaacuaugauuauuaugucagucgguugcuuguugacccaccagaaauuaugugcugcaguguuggccaaugugcuuagcagagagaugauuacggcuggacucuguccuuggguccaaggagacagaaacggaagagccagauaccaguucagugagaacaccauccccuugagcccagaggagcagcaagaccuggugcuaaggaaaaucugcuccagggaaguaagaaagcaccaaugacuuaucagaccaaccuaacagauuaucuacuauugacugccaauucuaagaauccaaggggaaaggacuuagaauuucccacaauggagcaaucuacaagacaagaacggcuuuuuuuaagcgcauaaaaagaacaaucagauccauaugaagaaagaggcucgugaagaaagcaucugaauggagaauuacgugggaugggaagaagcggaucaggugguggaaguagacccagaaacagggggauggaaaaccaggaaagccagggcaagccucccccagggcaaggggauugggggagggggggggcaagggugcggggacagggcuggcuccacagaucaaucaaaggggaugcagggaaccagugaggggggcacacagacucuuaucagggaaucagggagcgagcuuacaugcauuacccgcugaccacagaacugggaacuugaggccacacgggccucagaagggugaaggggaaggccaugacugauggaggaggugcacaggaaaggcaguagagaaagcuguaacuguaucacaguugaaaucauacugacuucuggcacacuccuguuuuaucaagaaggaauauuucaaggugcaaagccagaaaucaaugcgcuuaaucuugguucggggucacgucuuguauccuugagugaaaaaauaaaaaagauacaguaacagaaggaguagcaucuaaguaaauauacgcacagaucaccaugacacaauugaggccacagccuagguaaaggcucguuauaacaggugggaugcaaugcaagcauccaguaaccagccacuaaacuauccagugaccuauccagaugaggaggaugaaggguguggggugggagaagcucgccaguggcaaggccaugagauaagugaucaccaacuaaaaggguaucaaaauagccagguaacgccuaguuugaaaugugugugugugugugugugugugugugugugugugugugugugcacauauauauguauguauauacacacacacacacauuuuuuuuuccacagaauuccauuccauagguuaguucaucagccaugaaacagguucagugcaaauaaggaauagcuuaaccggcaaggcaagcuaagcuaaaugaugaggucgcccucaauguucauacauguuucuugcuuugcaucauugcugcgaagcuggagagcugccaacucacaagcagaggcauguguccuugaauggcaaucuucucaaguccauuuauuccugguaacaaagucaugaaagacucguggcacuaggucuuauauggcgaacacacaauauuuacagccagcaagguauuaagaauaaaucaauagaugcgggacaauaaccacaaaaauaacacaauaaacaaaacauaaagcugaaauauuaaaaacauggccaauccugcaugccaagcuaaaaaaaaaaaaaaaaaaauccgugaucaaaacaaaagcaacuuaaugguugugggguugaaaauucaacaugggcagauaucuaagguguuaaaaucuauuuucauaaucauagaaggugguuagaugagaaaagaccaaagauucacugagcauuacaucuuuauacacacaggccacgcaucaaauuauaaacaucuaaaccuuccacccucuuagaacacaagaacagcuccuugacagcacaguguuagacuggcuuucuuacuaagcaccagauggugguggggacagcugcagaagccagagcacuaguaagaacaaugucugagcaccaugaccacaaggaacucagggcaaaggggaagcacaaaugagauuagcuucaacuaccccgcaggguacaguggguuugaaggaaccuaguaacuaccuaaagcauugguccucacccucccuaaugcugcggccuuuaacucaguuccucguguugugaggacccucaaccauaaaacuaugcucguugcuacuucauaacuaauuuugcuacccuucuaggccauaauguaaauagcugugcucugucauuuucguaggugacccugugaaagggucauuugaccuuuccaauggucuuagguagccccccugugaaagggucauuugacccccccaaaugggucacaacgcacaggcugagaagcgcugaccuaaagcaccauuuccacuaggcuggggagucugcaugcucaacauuccagaaggcaggcuuuucagggaugcugccgcacgugcuucugguuacaagcauggcugaggcgcaugucagucuuggugcugaaauacaguacaaggcucugaggaaaucgggccccuagauugaacccuaccccacccccaccccguucauguccacgccuaaaaaguaggguucaagcuuccaagacagccagaagucaggcaagggcuuugacguggguuuccucugagcauuccucuggguaccacaacgagcaagugagaagcaauaggaagcucuccuguacccaagcggccuugggcaaaucccuuacucuccuuccccauaaauguuagcuuccgugaaacgcaggccaagugucugguaguuuguaaaaauuaagaagugaauucacauaaagugcuuacaacacuuccuguugguaggauucagaaaguggcugcugcuuacuuuucuguguuguuugguuuuguuuuguuuuguuuucuauuuugucuggggggacaggauguuacuacauacacggcccaggcugguuugcggaugcucacuguguuaucccuaacauggauaacggcuaucuuauacccucuagcucccaugccccacgccgcuucauuugaaccugaaggaauggcaguaagagaagguagcagaguucugaaaaccuuguaaggacuacucuccuccuaucuagaucuucaccaagcacuuaaagcaucgacuugguaaggaccacaacaaauaaccaaagaaaagcgacuacuguuuccuuucaaaacacaagggaguugccuggguugcuaauuagauuucacuuacaccuuuaaaaaauccuccugccucaggagccuuugcagcagcaggcaaggcagccugaccugccucaaccaaacccagcaaccacauaccuucaaagaugauuccugccacagccugacuuucugucucacuggggcugggaaguaaauuucuuucuccucaacucugcuagaagaacaaaggggggggggggggcagacagcagcugcugccacuuaagggaggagacagaaacacaaaaggccuuucaccagcacauuucuuaccucccgaacaggccucccacccuugucucuuuuuaaguuccuguuccuuucgagauguuuuagacccaguuccagugaggggaaacuguucccaccacagcagucaccacaccaccacgggccacccagcuccccagcagucauggccagggaagaccugccagucaggaacaagacaaaaugaccacaagaucuauacguacacacacgcacauacgcacaauauccuucauaaaguuagaauacaacauuuuucagacugggacaaguaacuacauaacauuaauauauucagacuuccagaacauucuccuucucgaugaggugagcagucauguuggcuugaacaagaauucuuucugcuuccgccacagaaacaguauccaccucacagaggaaggccaggggccaaccuccagaggaacaaugccagaaucagugacuaggaugugcccaucaggagaacaccaugaccuguauguacccuuaagagaaaggcagucuguccugggccaggccuagugauggaagccaguagucccagcuacuccagaagagcuggggcaggagucaccacagauggcaaauccaaggcguaccugggccacuuagcaagacccuauaccaaaacuugaaacaaaaggucugagaauacaguguuugccaagcaucagauggauagauggauggauggauggauggauggacggacaaauggaggaagauagguagguacauacagccuucacuuucucuucuauaucucaaauaaggugauucucuuguuaaaacagcuagauuuccauauuaauucauuccaacuuucccauggaaacaaacauaaauuucaguucugaaaacacaaugacagccuaccaguaacacggcgcuaauuagcuuacaauuugcucuuaucuuagugaaagacauggauuccccgcaacagagcaguuagaaccaggaacacucugagacgcguuccuguaccaacccaacacugagccacacuccuccagaaugaagagaaauugugcccccuggcaugggauuaccccacccacuguggggaagagacucaaccagcgugucgacaccauuaacagcuaacaagcacugcuaagcauuccugcagacucacuuaagucucggaaaauggcguaguaccgugguccucaagcaaggacagacaugggggacaagugaccuaagcaauuuguucaguauggaagggaagcucuuucucuuuucugcuacaggucgaagcucacaacaacgcaaccaagagccacggcaaaggagcggaaagcugaguguaauguggaugagcccaaaucuaaaugccagcccagacaugcauuaaagacaccacaaaguguuucuauuaauuccuuuuuagaauucccagcaaggauauuuuuaagugugugugugugugugugugugugugugugcgugcguggugugucugggaacacaggugugugcugguggauaagcacaugaucguacacuagggagcuacggcccagcuuuuccucgauccucaucaugauuuccugaaacggucucucagggaacuuggugguuaguugauucggccagacugucugggcagccggcgagcuugaaggaucugcagcucuacccccauccuugcacuaccuaggggccagcaccacucugacuggauuuacuugccuggguaccggggaugcaaacucaagucuacuuggcacacacucucccuauugaaccacuugcuuggccccuucggagacuucaagagccguaauuagagcucaggaaauugguacucagagaagacaagcuuucccacaccaugcucgacccuugcaaacccucaaguggcagggugaucacauagguccagaucugugagagucgcugggacccaaaagcugcccagaaaaacauaccgagagaugucagaugggcaggcgacugccacccccaccuugaaacgacacagcaguuauagcaaaacauacgaaacucacaacugguaaggcuguguauuuuaaucacguauuuuagggagucuguagaauuuccuuaauuacuacuuuuguagguguuugaaauugacauggauaaagagaagacucccaaacagagcaagaauuagaugucgguugcuggaguguucucugaccuguaagaagcacguaaaaagggacgcacaucugacgguguugaaauaguuaaagccaccacaaaaaccugcucacauuacucaaucuucacgagcagcugaaagccaaaggcgagaggcagaaggcggcgguuucugggucuccggagccaaaacaguugucccaguuuccuucgcuggugcgcucauuuuuuuuuuuuuuaagaagcaacuugggagaaaggagucuguugcauccacuuccagguugcacuuggaucacugcaggaaguugggacgcuggcuuaucucccguggcuuacgcaacccaaccgccacccaagaccaucugcccagugauggaacagccacagugggcggggcuugcccauaucuaucagcauuccaaaaaaaaaaaaaaaaaaaaaaaaaaaacuaaaccccacagguaugaccucaggccaaucagguggaagcauuuaucaacugagggucccucuucgcaguugacuccaguuugugucaaauugacaaagcaccuggcacagcagcucugcccaggcccugaucacugggcacaguaucaagcacacccauggcacaggaaguaggugcaguggcaaugggcagagagcaaagugcucaccugacgucagacauucccaccuccagcuuccuugcauuuuagggcugucuucugugaggucccccacucuucccaaacugucccuacuuuucuucauuagacagguaccuuucuauacuucuauacuugucaaaugaaauaauuagcuugcuaacuuuagcucuguguguauuuauguuaauaucuaugugguuccacuugaaucacauguauaugcagauguguagaggccacugaguguguuccucaaucuaucuaucucucucucucucucucucccucccucccucuaccucccccacccccacaucuuccuuguagggagacgaggaacccugaguuucagggacugaacucugguugucaaggccuugugcagagagcccuuacuuccaagccaucuugcaggcccuucaucuuauauucuuaaacaaggucucuuccugaacccaacguggcuggcuaggcugcccagggacagagcuccaaccgugucugucuccugaggacaggauucaacuccucaugcuuguacagccaacgcuuuuccuuuaccacuaaccccuuaaucuuagcauuucuacuccauuagacaugguuuuccugaagaaauuuaacacuuaauacccaaucuccuggcuagaaaucuacaaaauaacuaggucagacagauuuaccgcccaacauacauuguuucaauacaacaguucaaagucuagcuaguacaucauuuaaaggaucucagaaaccauauacacauaccaccgcccagggagacuaucccucuguaaaacaagaaccccagaauaaugacuuagaaacauucuagcuccacucucaccuuuaacuauaauuauagacguguguaagagucuuucauaugguaaccaaucucagucccuagaaucccggugccucccucaccuccccucccacuaaauuaccacuggaaaaaguccguggccacugcacacugcucuggaccuauuucaggaugcuauccauccugucuccuucuccccauuuggcagcgggaacaaccccaucccuuacauuuauaggugaaaaauaccaguuucuaugugauccuuuuuaaaaagcaaacuauuuucacaaaaaaaaaaaaaaaaaaagacagagccaaaaggcagugcucauaauuuaagucacgaagagaaugcaaauuaaggcucaaauuauauuuugugacucaacuuuaacuucuaacagcuccuuauaggcuuggaaauuuacguugagaggggguaaaaaaacgguuaagaauaacuucccagaaaaucuacaggaaaaguaucaauuucaaccuuaacuccugaguauucuucaauauugauacuggaccaccaauucugauuucuauuggacagaagggcaccccuccaaaaagugucugcuccagaagacuaauuaccaaacacuauugauuacgccauuuuccucugccuuaaacuaauucugagaaguccauuugagugacgcuagugaaauauaaucaaugaggggaaagccccuugacuuaauagaaagcaaaauuuuagugagccuggagccuucgaaucauguucucaggcaaagguuuuauuuuccagaugcugggcacccuaagauagggugacuuacggcuaaaauacugcaggcuuuuguucuugucuuauguguccgguauuaccaaacauaucaaauuuuaacauaauaaaaagaucuucuuagaauacacagaucugugaaagaacaucaaggagaccuguaaacuaagucccacccagaccuuacugguguugagacauuacauuucccuguauuuaccacacucagagggcagggcagucaaagccaaaaccuucaucaauucaccuauuacguuacuguuuauuaagcaguuucugugcacugggcacucuaaagaacuagaugucagagguaaauagccugccccagaaagcccacauccauugcaacacugacuuguaagggcagaucuguguccucaaaggaaaacaguacccacucaagaacuggacacuggagagggguggagguugggggaguaggggcuuaucuaggggguggcaagccuuuaaucccagcacuugggaggcaggcauacaucugaguuugaggccagccuggucuacacagugaguuccaggaugggcagagacacccugucuggaaaaaaaacaaaaaacaaaaaacaaaaaacaaaaacaaaaaaccuggcuacuacagagauuccaggaauugaacuguauucuggagaaaaacuguauguuauagcaaaacaccaacaccauuuccaaaaccuauuaauaaacccaacacguuauuacuuaaugacuuccucacauaaaccuugaugcagccaauccguguauagagugccugccuagcaugcagaagguuaucgguucaaucccccauaccacaaagcauaacaaaacaaauuaaaagaaaauggaaugucuccaucuuauagauuaaauaauucauuuugggaagauccugacugaaagaggcagccugugaugguuugucuaugcugagcccaggaaauggcacuauuagaaggugugguccaguuggaguaggugugguacugugagugugggcuauaagacccucauucuagcugccuggaagucaguauucugcuagcagccuucagaugaagauguagaacucucagcuucuucuguaccaugcuuccugccuugaugauaauggacugaaccucugaaccuguaagccagccccaauuaaaugugguccuuuauaagaguugccuuggucauggugucuguucauagcaguaagacccuaauacacagccaccagccagguauucucaguucaaccuuccacuacccuaccacggccucucaaagccugaaggacauagagcagaugauaaaguaguuuuagugcauaaaagucucuggguauguuguauaacuuugcacguaugcacuacccuccagauggcacuccaacuggugucgauguuaccguaccaccacggaaacaucacaccacgaaacagccuaaucagaaugcuuuucaagguuacuauaaaaccacagugaugaucuugauaauagaguacaaacuucaaagauugguaucccuucuacucaucuuauguacacuugauccuucaguguguagcuucauagcgcaaaaaguguaaacguacuucaaugccaagcccuaacagaaaccaacugggaauucugaugcaaagaagaggagagaggggaggaagugcagccagcagaagagauuaacagcacuugccuguuucuucaucuauccugaagacaccaauuccagagccaucucuaauggaauaccggaucucuccgucucugccugugucuucgucgugagcugacacggucaugacugaugagccaguagggacgucuucuuucacuacacccuucuccacaaagcuggagaacaccggaguguguagguucucauucacgucaacgaccuccacuuccacauagcaaguggaagacagggacacgggcuucccuuugucuuuggcccucacggugagauuauacaguugcuucuucucaaaguccagcugcuggacaauucuaacugcgccgcugaguuuauccacaucaaaguggccuucuccgugauccaggaggcuguaucucaccugacuugacugacccacaucgggaucauaggcuucuaaccacaugaugaugguuccuucugguagaucuucucgaacuuucacugaguaauugggugggaugaaccuagguggguugucauuaacgucaucuagugacaccuucaggagcacgguggagaacaaccgggguuccucuguggcuuggucccuggccucgaucuuuagguaaugcacagguugcacuucacgauccaaaggcuggauaauuuucaccacaccggucaugcugucgauggaaaacuucuccguaucugugagaauagcguaggucacaugcccgcuggggcccagaucuuuaucaguggcuucgaccuggaugauuucacuguucaccuccuugucuucacucacuuccacaaaauagcucuccuguaaaaacucgggcgcauugucauuggcauccagaaccgugacguccagaaggcgccaggcagcccucugggguauaccgaggucguacacgguaauauucaggguguauuuguccauuacuucacggucaaguggagacaggacuuucagcacucccguuuccaugucgaugguaaagcaacuaucaucauucccuccagaaauagcauagacgagcuuuccauugaagccagagucaaggucaguagcauucaugaagaguauauuggcacccaccgggagguucuccuuuaccucaauuccaguuggaagaguaaccccgaacuguggaguauggguauugacggaguaagaaucaaagaaaauauccuccacgucccccugacuguguaacuuauucgccugcaggaguuucucugccaacauuuuggcaacaccggucuccucgcacugcaaguugaccggcuugcgacuggcagccaccguuagguugauguauaacggcguggcaaaauuuucuccgucugucgcugugauucucaaacugugaaaggaaaccuuugcgcccaagccauccgugagggagugcuuuaaggacagcacaccggagcugggguuuaagccaaacaaauccaacucauuuccggcuucaaucugguaccggaccagcugcagcucgucggcgucaauggcagacacggugguuaucugcucccccacaccuaggucucggggaaugguccccucacaguuuauccucucaaacagggguguguugucauucagguuauugagaguaaucguggcgaggacuucgacuucccggcgguauggcaagccccagucagacgcacggauccucagcguguacacgcgaggcaucaguucauaguccagauucucagagguacucacgguucccgugaaguggucaaugacaaacggcacgugauuuaaguuugcaauacuguaagucacguagccauucucccccucgucgggguccaucgcacucacccucgugacugcggcaccgauaggcgcguucucaucgauggaugcuuuguacgaggucuguguaaacucagggggguugcuguuuguaccuaaaacuuugaccaccacucgggcggaggcucuuuugucacuuguugucaccucgaguucaaaaugggaugugugcugccuucuaauggguucuaaaauggaaaugagacccguguugugauucaaaccgaauuuagguuuuccaggagcgcuuuuaaaaacauaccucaaaugggaauaacuaggaauggcuuugaccaggaccacggguguauguggaggggcaaacucacugaucucggcucuguaaacauccauuucaaacuugacagggccagcucugaacuguggagaaaugaugugaacaacuuucacgggggaaaacuggggaggagucccuuugucuuuagccugcaaugucagguuguagccguaaggauggcugucccagucgacggccccgacggcuuucacuuugaaugcuuuacucccugggaaagaccucacuguuuuaaacugcugaaggaggucgccagccacgaugcucaaagacgcuaucuccccguuggcacccugaucacaguccuccacggugaugauggcguagguuggguccuuguccagcucagagggcgacaacgucaccgcgguuaugaugggcgcgcacucguuggccugcuccacgugaacugucagcuuggccaggcugcugaccccacugcuaccguacagcuucaucccccgguccgcagccagaaucuccagcucauagagcugggucucuaggaaaucaagccugccagucaaaacaacgacgccgcuggucggguggauagcaaacacgucaguucugucuuuaaaacuguaguaaaauucgccauuggucccaauguccgcauccguggcacugacucuugcgaugcugguccuuauggcuguguuuuccggcaaagagacgcuguaggaggugggggagaauaagggccuuaagucguuuguauccagcacuuguacccgaaccuucgcucgggccucagcaucgguggcuuucuccacugccuugacgaucagcguguaauggucucucacuucucuguucaggauggcgguauucccuccuuugguucuuauccuuagaaagcagaagucuccgagaacauacucuuccgcuuugaacagguuuucgcugucuccugagacgauuuuguaccuuaucucccacgaggggucuaagauguagaugcccaucuuucugggguggccaacauaggucuucgcugccgaguucucgugcacagugacauuguacuggaaguguguaaacuggauaggagggguggguucaagucuuuggcugccaucacugucuccaaacugcuggaggaagaggagcagaagcagaagcaaggucaagugucuccccauuuuuuaa

SEQ ID NO: 4423 - RNA, 5172 nt, Mus musculus
ucuuugaaucuagauuuuuauugcuuuuuuuuuucucguguccauauguaguuugguucaauggcaucuuuucaauauguauguauuuuuaaguauuaaaacauaauugugaaugugucuuuaugugaguguccuugccacucguuccagguccucaucaaaguaauagauaccaaugaccaccgcccccaguuuucuacaucgaaauacgaaguugcuguuccugaggacacagagccagaaguggagauucugcagaucagugcaguagauagggaugagaaaaacaaguugaucuacacucugcagagcagcaucgauccagccagccucaagaaauuccgccucgaucccgcaacaggcgcucuuuacacugcugaaaagcuugaccaugaagccauucaccagcacguucucacggucaugguacggaaggcacccuuuacccugccgucucucuuucugacuggcagguuuccugggauggaaaagcauagugauuuuauuuauguauuuauguauguauguauguguguauuauuuuauguuuuuguuuguuuguuuuuaauccacaagaaagaagaaccccaguagauaacauguugacuuuucucucccagguccgggaucaggaugucccugugaaacgaaacuuugccaggauuguugucaaugucagugacaagaaugaccacgcaccgugguucaccaguccguccuacgacgggcggguuuaugaaucggcagccgugggcucaguugugcugcaagugacagcucuggacaaagacaaagggaggaacgcugaagugcucuacucgaucgagucagguaggucggaagccgugcagucucgugacugugcuugaacggcguaucucgcauuuucuaaaacugcuucuaggugcugaagcauacuuccacauagcgcugcagaaauggauuaaaucuuuuuuaacuacuguuuaauguauaaggcaaaagggauuuagggggggaaaaaaaccucugccaaggaacaaagauaaaguccuaauaagcuugagugucaagaauucuggagauuaccaguauuaacauaaauuaagacugauaaauccuacgggagugggggaacuuuauuuuucuaauucaguauuuuuuuuuuuuuuuuggagucauuuuaggcucuuaaacuagucaggcaaauucuggcuuaguaauucaacauuuuaaugagaguauuuucucuggcucagaaaugccaggagaguaugauaucucccuguguugggucaauucucagagaaaaaggggauacccuguguccugugccuugugaacuagccccacaguccuuuugacaguagaguaucaugcauagaauccagcuguugaaacaggccacagagugguggcuucugggaaggggccugucacauugucuagagguagcacaguuauagcccaagccaggaaggucagcugagccugggccaaggaguuccagaauaaaaucaggaaagaguuggcccugcuaaauaccucuaaguguagagucuggagaaggcuucaguuucccaccguccucacagucaucgguaguagaagacauagagccaguuucacgcgucauuuugugaaaugguuuuagcguauccuaaucuacugauuuucuuuaagccuagaacucuacuuaacuuguugucuguggucucugcuaggcauugcaugcagagauugcagguuauagaucucagacucuaaaucugaguauauagggagcaaguuugacaaaaauacuugcccauuugcuuucugugccaauuaaacuuauuucuuuacguguugggaaacucguuuguuucccuuaaaagaaccagguugacuuuguuauuuacagauaagauuuucuauaccaccugggaugagagcguuaaaaugcacuguuaccagguuagugccuuggauaaaggagauaaagaauuuuuuccacugcuugagaaauucagcaguuagaaaaacagugcauuccauucgugcaugcccgagcauuucaaugaagagacuuugucauagacaaacugacuggguuuauguaggcgaaaauguucaacuuuccguuggcuuucacauaauuuucaacaacugggugguuaaaauaugauuguuggugucugagugaaggcaugugcauucuuugaguguuuguaaugacugaugggauuaguaauuugguauucugagaauggaacucugugucuccccaaagaauagaguaagcgccauuggacuguucccguguggaauaaggcuguaagacacagcuuucauaauguaaugugcuaaaaaaaaaaacuucuauaggaagccacuacugugagaguucagaaguguguguguguguguguguguguguguacauauacccauuggaacauggugaacuguaaaauguucauauugccuuucauugaacauuuauucauaauuagcuguuucuaauuuguaucugauugcauuuaauaaaguucaagagacuugguuauuaaauuuaccugcauguuuaauuaggagaaauuuauugagcaauaguuuuucucugauuugaagucuucagagaaaguaauuuaaugaaaggguuuuuccaguaguaacugaauuacgcacaagagacuaagugcuguacucuggguggugucggcuugucagagaagcagauuagagcauuacuuuccuacuguugucagcccuggagauguauaacacucggugaaucuacggauuagaguuggcuuugucccucagguuuacaguauaauugccacugacacgugggagagguuuccacacugucagcaaguccuuacugaacacgcacgggccaugugucagacauaggaagagauggggucccacuacaugucucuuuucugugcuaucuaguaaauagucacgacuuaagggcaacauugacuuguuaguccagauaacucccccguugaaaugcaagacuauaauuuaaaguuauaccacuucagcaagcauaaaugucaaccccacccugguacaaaguucgcccacuaccuuauucccauucucagggggcaaaccuguuauuucagggcugagaaaaacguaccuguugccagucgcucacuuuccgcagucggcagucugggcugccuucuguacggcugaagcuuugugcccgauacguaccugugugagguccaaauaccaaaucacucugggcuccuguuuuuaccauuuuuaugucagcaacgggcucaggguccuguuaauucaaugcuaggauaccgcagaugaugauauuguugaacuucacauuguguaugcauaguaagaauguuauccauacuauagagaggauucaggagcuggguaugauggcauacgccuuuaagcauagcccuugggaggcugaggccggaggauggugaguaggagucccgccugcgauacauaguguuuucguguugagucucagcuauacagaaacaagagagaaagcaaaaauaaauaaauaggaggaaagagaacacguguauaauaaaaaauaaacguagccacaccggauagggaaggaaggaggagucuucaggcaggggcauucuggugaacgaaaaaugaaagaguaaaugggugacuagagagauucugagaauagccagggaaggcugcguuaggggagaacaggguggaauauggggucccuggcaugagaggagaggagagcagagaggauguugaucugaccggggcugagaacacuagugcaucucuugaacacugucuugcaacacuaaacauguugauucacuucuacauuugaggccuaggauguaugaacuuuuacgagcaaauaagauuucccuguggaaaaauaagauaaacacguguagaagaauggauaugaauguugccaaaugggcugcuuuccaaaacaggccucagaaagcuagggggcuugggagagauagagucacuugccagaaaggugagcaggugucaccuccuacccagccagucaaguuuggaaggugagaguaaugggcagguggacaaagagaagcaucugagguuuggugauugccugaggcacaaggauaaccuagaaucgagauucucccaaaugcagacaggccggaaauuagcgucugcgcagccuggcagaggccugggccaaggcucagcccagaccuucagggucuggagaagcccggggccuccucccuguuucaaacccaggcacugccuuggggcuuggacacagagccaggccaaccuaaugaaaaccagacuaugucuggccucaggaaaaaaaaaugucauggauuuuuggaaaauguauuuaaugaaggaaaugaauuugguagaggaaaugcuuacucuuaauggggagagagaggggcuugcuaauccuuggcuugacagaugacacuaaguaguuugcugguaguaaaacccagcaagaggagugugagaaaaguuuaguggcaggugacccgagcugggccaccaaguguucaucagggaagaacggaucccguucugggagugauguauagauguuuguuuauaagacagaaaagggauagcgaggaucagcgaagggguagaccccagagaccccccacggugcccaugcuccauccagaacauggagaguacguacuggucucuuaggaacucccaacccugugggguuuugaggcauugggggaaauauugaaucugcgugggcgagccugggaagguccgaggagaugccagcaaagcccaucugucguagcgguuugcuucucggcugcaucagugcgguugauguuuggaagcaaaaacagcuccuuguugccgagggaggccguugugcguggcguacgcuguuuuugucucuuggcugcuaucaucuacguggaagcaacgcuuccuccuuuccaagugcuguugacagccgagcucugccagaugucccccuggaagcaaaaucucuccuccuugagagucaccaacuacaugaucaagucagcuuggcaaagguuaagaagggaagauuguggacaucuugaaaacuccugaagggcggugggcuacagaaaacgguuucucgguccccuaacuucuuacaagaagaagcccucugaaaccccagcguaaaauuucuuagug

SEQ ID NO: 4424 - RNA, 9529 nt, Mus musculus
uaaaacacugauuucuuuugaaauuuauuuacauaucuuggauggaagccguugauacaguuuaugugguauuccugaaaaagaaaagaaaaugucuuaaaaguugugaaugcuaaguacauuuccaauaaguauuuucaaauacuucuaccucccaaagacgcuagguaaacauucaguguaucuauagaacaaaauucuuaaaugauucuauuauauaacaaaucagauacacuaucuuacaaaacgaaauuguauucaucuuuauguucucuuuuaaagauuuuuuuauuuuuuuguuauguguauauaugugugucuccauggggaucugcacaccuauggaugcaggcaucccugaaagaagacgcuggauccccugaagcuggguguuggguccacuuuugggguaaauggguaccagggaccaaacuuggguccccugcuagagcaguauauacucccagccucugagcccccucucuaggccccucuucuuacuucuauauuuuguuuagugcugauaagcuaauuagagucuuaaagaugccuacuuaucuaucagaauguacgcaccuuucaagucagaagccacaggccgauuccuaagacuggaagcaucuucauaggcaucguaguuaucgaaguagaguuuuucucgucuugaaauauagguugauuuugaugcgcuguuguucugacuggagacuuuaucacuuaaacucaaguagucucgcugaagauuccgcaucucaaauuccagggugucuuucucauuuucuaugcuucucacguaguuuuccagaaguaucuugucuucggugagccgacugaugcuauuuucgaacuugguguuuucuugacuguguuucuugaguucuucuuucagaaucugguuauccgccuuaaucuccaugaccauuuuggacaagaucucacacuccuugcugauuucggccaaguuguuuuuguagaugcuugucuccgacuuugcacucuugauuucuuucaggaacuucuccuccgcggcugacugguaggcuugaauauccacgagcuuccuuuccaacuucugucugguggaaguggacuccugcagugucgccuccagacucagcuucuccgcuuuagcugugucuagacugugaagaagcgacuccugcuccgcuuuaaucagucucuccuuuucuuucagcugcaggaucuccagcuugcucucuuucaggucacucucgagcgugcucuugucuuucaggagcugguacgucucuuucucuagcauuucccuuucgucuuguaccaacagcaugcuuguuuucauggcuucuauuucuauguucauucuacuguuuucguuuuggaggacggccaugucacuuugggacuuguguuccuugcucuucaggugaucuaucguuuccagcaucuguugcuuuuccagagagagcugacuauuuuucuccucuagcauuuuguguuggccuccgaggacguuguaagugcugacgauuuucuuaaguucccugaggcagucuuuguucucuuccucugcuuugcuuaacuuggacugaagagcacucuuuucuucagccagagacuucaguugcuucucgugggcuuccaccuucuggaucagggauugugcggugaacacaaggggcuucauuuuggucuuaagggcuagguuuucguucuccaguucggucaucuuuuucugauucugcaaggauucuuuuagguaauucuguagguaaugaauuuuggcgacgcucugcuuggggacgcacugcucugggaugaacuugccuuuggguaacuucucguuuucaagcguugcggguccuuggcugacuaugaacgcuuggccuucuuugucuuuuauuuuguguuucccuagguccaggaccgacagaguguaccuuggagcucgggaguggaacuuuaaauccauaauguucuugcuggugauagggaugucuuuauuuuucucauucuucuucccacgguauacuucacuuuuagauaacuuuuuacauuuccuacaaaaguucacaugcaguuuugacaccgugucccugagugggagcaguuugcucacuaaggccucuaauucggaaauucucuucgauuucaugucuucacuuaaguuaccuuccauguuuucuugcuggauaaaauuaaguuuugagcuaugcaugggaaacggcucauguuuguggugaccuugaguacucgcgucugccuggaaaguguggaguucacuugugagugccagcuccuugucgugugacuucugaagcuccucuuucaugugcuugaucgaguggcagaugucgucuaaguuugcacagaacccaugcuuugggaaagggguggugaugguggauuuauccagaaucacgggagcagcuuggggcaccgcuguuugaggacccugagguagaaacugauagaggcugaaacucuuuguggcgcugggcugcuccgaaguguucauagcuuucuugggaggugaguuaucagcgguaguucucaggcccugcagagcuagcauguccuugaccugaaucugggguggaauaucugugcccugagggagaccagugucacuguuacuacugaaggucucucccaucgaauggagagucuugguggaagguauuucuucuugugucucguuaggcuggcggcaauagaaagcaugcuauaaacagguggucauuucccacgugaccaagagauuaagaaaguuugaggcagauuuguguguacaaccucacuaaguauuucccuacuaaccagagaagucagugauguaucccucucuguuuaucugggcacgcaaacuaacaccaacugucuugagaucuaccacagagugguuuagggcugccuuccuuccuuccuuagagggugagauaccucggucaaccucuuaauuucagaggcagaaauguaguauacguauuaugcccuaagagauucucuuaaguagauaggccacacgggaaaucaaggaaaugaguguuucugcuacugggcuaguuguuagccuucguuuccaaguuccuggauucaaagggggugauuuuaggaccacagguccuggaaauguaauuuucuugccagcaugaacaauauuggccacucugguguggggcuuuucuauagacuucauccuuaguuggucaauccccucuggacagguaggccaaccaaacugcuuugaugcuuggguauuuucagcauuuagacgaagugaaaugccucucuuaaagggauggucaaauuuuacaguauagagagcaacauacuucauuuaagugucucaagacagauauuuccuuauuuucaucucugaugcuccauuauuccuuuuugggauagacagauagaugauugauagaugauagaucaauagauagguagauagagagaugugagaaccaguuguagggauagaucugaaacaccagaagggggaaugauuuacugaaaacauaccaaauccuuuucaggaugcaugcugaauacuagacuuuuuuccgaguuaaauugugggguuucuacuucaacaauacuuuuguucaguauuucacugauuucagacuguaccuuuaaaagauaaauugacaguguuagaguuugaaaguuugcauaugugcagaagcacauuguugaaagauaguaucacauuuccugaacguaaguucuuugccauuaagagaauagguuaaacuuauuuauuguaauuucagucauuaaaggacuuuuaagaaaauacuguguuugugaaaaaaaaucagaaaccucuaguaaaauaguaaaaaauuaugaacuacauuugcaauuuuagagggguuacuuuuuaaauuguggaguaaauaagaaaucuuugacaucuaucaucggaacggagcacauccugucaacugccacaaaguucgucgucuacuucccugcaguucaauacaaggacauugggucagaguugaugucaggccauuagugacuguguuaguacaccugcuauucgcuuucuacuacaaucccucucauuucuccagauguagugugugugagcccuugaugacaccaguucucccuuuagcugcaagauugggucuacaacucagcaaugagucucucucuagagagggauggucaugaauugcuucugaacccauuugugggacucagagucacagcaagcgaccuuaguaucgccagcuuucagaacgaagugcauucucucccugccccuugccuuuccucacccuucccuucccguuucucuccuucuccagacuugaguuuagaaggcucuggagcaccuuccaaccgguucccaagauguguaaucugacaaccccucauucuggaaagcagaucacagugugcccgaggcucgcuccugaacacuaaaagccuugaucguaugaaucgugccaccgggagugaucuguuccuaggaucuucagugacucggggugauagaguauaucccccgccccccaggaccacuuuugaguuuuaguuuaaaucguacagagagagucucuauguaggaaggacuaucuacuuauuugcagugcgaggaucaagcccaaguuucugcgccuaggcaacggcucaaucacugagcugcaucugccccaggcagccuuuucauucggccucacagucaaaacuccgcauccacuuaauaaccggcugcugacggcuuuagaagauggguugguaccuacaacuaggagaugcccuccguauggacuacaccaaucauaccaugcugacguucuguagagucugcauccgcagagccugaaacgacuccagcugauguuguaggaccuagaaugacauuuaacagcgcgucaaauggaacacuuucagguggccaggcauagucuucaaaggcuaggauuaacaaacaaaccccaguguggcuuguuuccaaaaaggaucacaugagccagcuaacucauccuuagcugggcugcugaugcucugucuugauugacauuuggggguggggcggggauuguguggaauuucuacgcaugcgcguaguuuuuuuuuuuuuuuuuuuuuuuuuuuuuuggugagaauaacguggaagacccaguauucacucagaaaggguuuugcacauaauuaaaugaaacagacuuacuuucagugcugauugugguuggauuugauuuucugguucugacgcacagccauauucuaaggagcaaaauacagaacaugugucauuuaguuccuaaaguuaucuuuguuuguauuuuugcuuucugagccaggucaucucaccagccuaagaggauuuauuuuuaacuuaaaauuuuagcuauuggagauuccaacaugcuuguuugcuggaaacauaugggggaggggagagagagagagagagagagagagagagagagagagagagagagagagauugauugauucuggagaaugagagaugccaugacagaagaauucuggaugaggagggcuuuggaucaguugaguauugauugaauagggcaauccuuccauugaaacaggaaguagggagcuuagcagauguaaggaugagagauuuugguccaguuguuuccaccuuuuccauaagaucaugccaugagagaaacgacauaguuauuuaggggagggagcauuagaaaaagauuaauuuuggcaauaaagcaagcacuccaaauagcauuaagcugcucguuuuagcuucauggugugauucagaaaugaauaguuuuucuucagcagagugauucagugcaggcagugagcaggcaggaaaucggacccaccuaucuuuaaagguaauaaaauuuuuuuugguuucuccuaugagucuuuggguguuacuuguuccuaaggaaaaauacuuucaaaauucaguaaugcuuagagaagucacaugacacuauaugauucuggaaugugaaggggaaugaucacagauccacgggagacaacacagaaucacaguuuagcauucacuaagucuuugcuaaauguauccuauugggagucauuagaaggagugaggccuauggccccaccccugaagaaucuuaucaucuauugagaauguaagaaauauuauucauaucuaucuuacuguguauuaaaaagagaaaagaggcuaggauauguuugguagagcaaguuggaagggggcaccucugcaggcccaugcugaggcaucccuucccccugagggaccagccacaugauggauauagaauggaauagaauuuauuuagggcaugggaaggggaguagagacagacagacagacagacagguagauacacagacacacagagagagacagagagaggaagaagaggaggaggaggaggagagagagagaaggagaagaggaagaaggagaaggaggaggcaggagaagaggaagagcagcaggggaggaggaggggggagcaggagagagagaagagaagagacuggccaggaacacauggagagagggggcaaggccaucuggagagagggagaaggggcagagaguaagagaguaagagagugagcaggggccaagcagccccuuuuauaguaagccaggcauuaccuggcuguugcuagguaacugugggguggagccuagaaggacugcuaacacuuauguuuucuauuucauauuuaagugcugaaauaaaaaaaaaaagacucaauuaucaacggggaugaccuuuuuaucagaaagaaaaagggaguuuauguccaagcccgcagaaaauuauguccuauucaauauaugcaaaaaguguuaagugcacgccugugacugaggcuaagggggaacaugacgauuuaaaaagcaaaaaguuaaagugguucucaagugcaaacacuaacuuuguugacaggccuagugacaucugcaguguagguggccuguggguuggagugcacucugccagggaaguuaggguaucagcuauggaaucaggcugucuggacaucgacuucuggcuuuauaacauaaugugauggguaacucuacgcguguaucacccuucgaauucguucaugagaacaauucuaguccaaacgcaaggugggggggggggggcugcucagaacuucccagugcuucucaguuuguucagaauagaaccccaaauccuugcccggaguuacaaaguuacuucucuccuaccccacuccaaccuucaccugauaccccaucccccgcccuacccauucugccucauccacaggaauuaacugcucaagccagccagccucucucccaccucagaccucgggcuguugcuggucuugaugccugaaauguucuuuuguagaacuuuuuuugcaauuucuucuuuaccuccucuggucuuugcucagaugggaccugcuaacuggagcccucuccggucaccuccucccuuuaaaacagaagagaccucgccuaccuguaacacuccagauacuucugccuucucuuuccccauaggaauggcugcuaccuuguaaacaaugucugcucuccugcugacagauaagcuaaaugaaagcuuguauauauagucuuggauccugucuuaguuuguuuucuguucuacuauaaaauacucugacaaaagaaaccuaugugggaagggauuuaacucagcauuauagcucaagaguacaggcuauucuuucagggugaauuacaaugggacagauagcugaguugcauacacaguaaauaaacagagagcaaagaaugaguucaugugggugcucagcuuccuuucuccauuuaagcuguguagaccacagccaaggaauggugccacccacagugggcagcucuucccaccucagccauugaaagccauaugauccccuacaggcaggcucagagguucauuacccgagggauucuagcuucugucaaagugacaacugucauugauaauuacagaugcccaacuccuagaucagggccugauacagcagguucuucaaaaugcuugcaguugagcaaauggauggaggcucagaagcagaaaaggagggccagaaccaaccagaagguaccccucauacgcauccugacaaguuaagguuaguuauguuaguuaguuaacuagcugcucuuauuuguauaagucaugcuguggaguaucacaggaguaucagucaucuacuguguuugaggugaacucuucuuauuugcugcuguguucaugaggcuaaaugguccauggcuucccggauucugucuccccugagucugaccuuuacaggggauucgagcugauguuugcccaguaagaacuucacuccugaaaccaucuccucagccucuaagugcaacacacaugcgcuugccguauugaggcgacuccagcuuuucugaccuuuguugagcgcagggguaaauacuaggcuauuuaaaugucuuuaaccaucugugaugguauuuagucucguuacccugccccacuuugcugguuccucagggaagauuacaggucuucaugccugguaacagaggaauacagaaagcgauggucuacucauccuccauguucuccaucuucaaucaaguugacuuuuaucaggggagguguggccuugcauuggcuaacgugugaaaaggaacccagucccaugucuacuccaucaauucucucugccucaccuggggaacucacgauuggggucccacccaucaaucuaaaagccaccuuugcucauaaguccuggcuccuucucuugaugucccacugugcacccaugugagaggggugcugucccuuugggcuucucuucaggaagugagaucccaauggcaguguucugugguccucaaguuacucuacacaucugagucuuuguuuaucggaacucguggcuguuugaauucuuucaaauauccuccccaugcuauagcucauuucccaccaauauuuacugcaaaaacguagauuuuaccugguucauugcccccgcuuuccuuuacccccucagaggaauucaggaucuuggaugcugaaaggagaauggagucaacuucaucuucuuccgcgaggugcuucucuggaacagacccgagcacagcuuuuggagcuggaagguagccugggaaggugaagaagcgaggcacggacauucgggucgcccacgcccucuguggccaccagagggcgcgcuaugaucagguagagaugucaacucugcaaauaggggugaaggcggcaucccgccagggggcaggcgagugcuuucucacugagcaggggauuugaggucgggaagauaacgcacaccagacccauccggaaaacuccggaggcuuugggaugaagggacaugggugugguuccacuauccuccauuucccagagccucccucuagaggacagccucccggaucguucuuaccggggcucauuucugucgcuuaagaucucuccaccaacugccuugccccaagcauucagcucugccgcuucuagccgcagcaucccguugccuagua

SEQ ID NO: 4425 - RNA, 21916 nt, Mus musculus
cacuuccgggacgacccuugcuugcacgaaguagguguucuugccaucgccaguggugcuugguaagugauucugguugucagugaccuccccguauuuaccccuaggacuucgucaaccguuaggagaauggcuccaggccccuaaaaggagcugcuccugagaggccaaaagucgcgguacaaacuauccucacuuggaucucuugggugaucuggucaccagcagcaccgggucaugcgacucuccgggucagucagugcaucuugacaguaaggcacuauuugucguauuuagaagcuagcuaaaagaacuuuugguuuugaaaagauagaccuaacuuccuuaaaauagucuucucccuucgcuuacguggcacagaacucuccagcuucccccuucuccuagcucagcuaaguccugccaucuguaccgcagaugauaaucuucagcuuacacccugagcuuucucuccgaacccaauucauaagucuagucaacugcuuccacuuaaauaaaucauucaaacucagcaguuacagagccggcucaucauuuccuguucuccccgcacucuuccuucagaauucccauucgauaacccagcucaccccuccuugugcccaccaaacccuugacaaacuugccucaucucaagaacaaagucaauaaucaagucuggguucuacuucuggcuggcuguauuaaaaccuucuuuaccguccuugagcuuuguccuugcuguccguccaugggucauagucuaagugaucuuuugcuuugguuuuaggacagagccucacaaaacccaggcuguccuugaacuggcuacacagucaggaaugacuuugaaauccagaccuuccugccucuaccucccaaguguugggcuuacaaucguauacaucagccuuccuacauguuguuucaauuaagcgaaccuucaccaauuggccacugugcuuagaaugggcuuacacacauaagaauaccucuuuaccuuggaaaauuuaaggcuucuuuuaugggcuacuuaccugcccuucgaauuucagcuuaaauauuacaucuucauagaguaucuugcuuuaaaagccuaaagagacccuggcgcuuucacauaugauugcuuaaagaauugucauaacaacccugguugaaguaccauaucuuuuccccauuuuuuacagaaaagaauaggcgugacugauuauguuaagcagaaaucuuauuguauaaguacccgaguuaaaccuuacucuugcuugucuuuucuuuuuucuuucuuuucuuucuuucuuuuuucuuuuucuuucuuucuuucuuucuuucuuuuuuuuuuucaagacaggguuuuuugcuugucuuuucaaucuucaguuuauguaaguauuuuucuuacucaaaugguaauguuguucuaaauuuaucaaacuucucacugguaguucucacaguauuuuccaguuuugagggguuuaguuuuuuaugauaaacaacagaaugaauggacagcauuauuaaacuuuuuguuguucgcuuagaaugaaguuaauggagugaaauugggacaugguguagucuuugaacagguuacauaaaagcugucacucuugcagagaugugacaagaaauuuacaaaauaaaaaacugcaccggcaccuacuucauaauguucugacaaucaaagguaauauaugcccaagguucagucauuugaagccuuaggagucaguucuagcucacuuguuccagaauaggguuugucugagggauucauugcugugaacaggcaccaugaccgaggcaacucuuauaaggacaacauuucauugaggcuggcuuacagguucagagguucaguccauuaucaaggcggaaacauggcagcauccagacaggcauggugcaggagucgcugagaguucuacauccaucugaaggcugcuagaagacuggcucccaggcagcuaggacaagggucuuaaagcccacacccacagugacacaccuacuccagcagggccacacuuucuaauagugccacucccugggcuaagcauauacaaaccgccacaggguucuucuguuagugucuuuuggguugcuguaauaagacaccgugcacaugaccaagaguuuaguuggccuuaugguucuggaguuagugccuaugguucuaucauuagugccuauggugacgaagcaaagccaugacuuggugaagccucuggagcagcauaugagagcucacaucuugaucugcaagcaggaggcagagagcaucgugggaauggugggaggcgucugaagcccgaagccagccucuauggcacaccucuuauccuucccaaacaguuccaccagcucaggaccaagaauuucaauaugagccucugggggccauucucagucaaagcaccauggauucuugggucauguaguccuuaaguguucaagucauaguuuaagaacuugauaaaaucuuugaaaacuuuccucaagaauccaccucccccaaacacauacaaacacauuaugagacagcucuuuuguuauauguaucauuugcuaccugaaacucaacauggaucccagcuaagaacugcuagucgcuuccauuuugcagaugcuuuuuaucucucucugucaguggcgaccauugucuaagccaaauaaauucugucucgcacacucucuagcucugugguguucucacugcugcaguuugguucacaucccuguaucuaauccugguguauuuucuaaaugugaaaucacuguugagccuugccaaugaugaguucuuccagcgugucaccaucgguagcuccuuuccucccgcuggcuuagccacagucucuccguguguuaagcucaguguucuugacauguuuucuuuuguuguuguuuuaagaauuauuuauuugggcugggcauggugacgcacaccuuuaaucccagcacagaggcagaggcaggcagauuucugaguucgaggccagccuggucuacagagugaguuccaggacagccagggcuacacagagaaacccugucuugaaaaaccaaaaaaagaaaaaaagaaaaagaauuacuuauuuauguuagguuucugaguacacuguagcugucuucagacacaccagaagagggcaucagaucccacuacagguguuugugagccaccaugugguuucugggaauugaacucaggaccucuggaagagccgucagugccaccucuccauccccuucuggucauguucuucaacuaguuuuuuaccacugacaauuucaugucguugcuaaaugcaucaagauuccagugccaaaugcagugcuucugaaccuccuuuucauauuguaaucgccaugaaaggcagcagggcaggcuuuuacguauucucgugcccaggauggccuuaugcuguuccagaguuaggaggcauugacacuccuaagugucccuagaugacuucaguaugggauuaagguuugaaaacuuuuuaaaaaagaauuuacagggguuguuguauauuuauacauaagucauuaacucaugaaauaaguagaaaaaucuaguuuaauuaaugccauauccuaacugaaguauauucuaauucauaugaagacgaguuugucuugcacuucaagggaauugugguuuccuuuguucuaggugguuucccaaaacuaugcucuauggauauacucuucagaauaagaggcggcuucgaucuggcuuuucagcuagcaccaccuaaagguaugucuuccaaaacaccuuuuaucauagaauuuagagugauauauauuaaguaucccuccauuuugccaauaaaaaaaugaguuaauaagauaagaaaaauaaacucaaauuaaauaggauucaauagaauuauauacuaacucccucagcagcccacagggcaccucuguguaaauuagaagguuuaaucuuccuuuugaaccuuuagggcugucuugaagaaaauugucacacaauguaaguagaguucuugaaacuauauauugcagaguuguaauuguguguuacccauguuucugguaucagacuccuuuagaugcuauaguuuauugaaauguuagaaggaauucgggggggggaaauaaaaauucagcaugauguguaugaagcaaauuccaggaugucuucuagcuuuuggcugaggcugaugccaaagccugagauaaguagugggggggaggggggggguagggcggggagggggaggagucggggcugacacgugguacgcuugagaugccacugcagcauuggggucagagucucaacgagcgcuugguucaaucugacacuuaggacaguauaguccgagcaggagauggagaacccgaagugagacgggcagcagcucgcucccucccugaggauaaauuaugucaguuuugaaaaugccgucugugguguuagagccacagaugauggaagguaaggagugagagacgaagggggcgugaggacugcagagaagggcaggguuucuuuuggaggcaaugaaaauuuuauaauuauuuuaaaaaguauuguuuguaaauuuuuauagaaauuuacuaaaagccauugcauggaauuuauggucucagaacccaaaagauagagaggcuaaaaaucgugauugugguugaaaaacagggagggcgucugagagucauguguacugucuucuacuuuugucucauguauaaaaugcuucguguuggaagcucaugaucuuucuaacuuucgcccuguucaucuagaaauguuuaucaagaacgcacugagacagguguugagcgaccugacuaccaagcucuccucagaugcucuugugcucagaguuugcaacagcuccguguaccuguggccgaacagcgacgcaaacacgggggagcugacugacagcucugccuguaagaacguagugcgcuucauucagugaguguucaaagaguuucugcaaauacuuuaaaguaucauaucguacucguaaaugucuuuguauaucaacauuuuagauuugaucaagaggaggauacaaagcgaaaauucauuaaaaagaaagacaaaaaguuaacugacacgguaagcaaaucuuguuuccacuacugauaaaauaauaauaaugaugauaaugauaauaauaauaauaauaauaauaauaauaauaauaauaauaauaauauccuugaguuuggagcuaagugggauguggcugauacuuauucuugcccuccuagaauauugaggcguggaaauguaacaugcuuguuuuacauaucuaagcuuuuuuucuuguugccauguguaauuucaacaguuuuuuucacuuugcuccugcaaaggcagagcugaguuuugucauuaccacugcaguguucuucuaggcuggacaggaggcaguaacuaaaccacuagguaugaauaugaaagugguaagaccugacccuugucuuggcuucuuuucccagagaugcgaugaaacacucugaccaaacuaaccuaagagaguuucuuuuagcuccuggggguaagucaaggcaucaggaacaggacgcagcugguuagaauggcagugguuagaaugagagagagcaguaaaugcaggcaguugcucaggccccuuuguggauacgguacagggcccaguuggggaauggcagcgucucauuuaaccuauccaguccaccccaacaaguauucccagagcaucucccaggagauguuagauucuaaguuggcagucaacacuaccauagucacauucaggagcacagugggagguguuggaccuaacuagauacggcguagcuaguuccuuccuugaguagacauggaagguggguguuguguuugcuuucuguuucuuugauaaaccccaugaccaaaaguaaaacuccaugggcacuugggguuggggucuccaugucagacuuugacugagggaagccagagcaggaguggaaauagggaauagggaaaacagcugcuuacuggcuugccucuggcucuggcucagccagcguucucgugcuacccagaaccaccuggcccgggaauguguuacccacagugggcugggcccuccgacaucaauuggcaaugaagaaaguacccucaagccagucugaucgaggcaguucuccgguugggcuuccuguucccagcuguauccaggugacaguaaagaucagccuaccuguugaggaguucaguuugcauucuauucaagacgccacugagaugugcugauaagcuggguuuuacacacauggaguguacaaaauauccauggcuuagacauaaugauuucaaaauuauuaaaaggaguuuacccuuugaacaauaguauguucuccaauguagguucauuugugcucgcuucugauuagaucuguacaucauuagcuggcauauuauagaaguuauguugugucccagcauaucauauuaaacaagcaggugcuuucaguguguucuacauuggugauguugacauuuuuaucaguugcuuaugguauuugccaguuuuauacacuguaaaaguaccguauuuucuguaauaccuaauaccucagggaaagaaagugugagcccguagguacaccucgucauauuuuuacccaccuuccccuaacucuaaccucuguuguuagaacagagucccaaguacacuuuccacggcucgaggaagccaccaaacacaggaccaguacccuacugauaacaauauuaaucuaaugacugagaggcagggauuuuucuaagucuggcauuccugugcccaaacaagcuuuccucuuuucuuuuuagucuuuggaacuggguauuguauaucuaguuccuuccguaggucaagauggaggguggagacuuauggaguggauucgaaucuguugcuaucauuaauuauuuuggguuuuuaaaagaauuuguuuuacuguuugugugugugugucuguguguguguguauguauguguguauguguguggcucugugugugugaguccaggugcccuuggagacaagaggcaucugaucccccaagaaauggagguacaggugauaguaagcuauccaaugugaguucuugaacaguccucugcaacagcaguugaccuuaaccuuacgcaguacugagcagccucuauagcccccacuguuagcuauuuugacauccauguuucccaagauuugguugauacaagcuucuucaagaugauccugguaugcuuuuggaauuuuuggugcucccuacuuucauucauaaauuaucccagaugugucuuucccucuuccaguuuggucagccauucuccuuggagaauauaaacauauauguuuauauacacauacaggcacacauacauaacacgcauauacauguuuaccugcauauauuguauuucuguguccaguuucacuucaguuucacgaaguuuguaacuaaucugagugagaagccagauugcuucugcuagucugcuaguuuguucaguacacagaauguaguuucaagagguuccuauaccaagaguggauaguaugcacuugguguggggcuuuuugcuugcuggcuuuguuguuguuuugagauagggacucaacacacaacucaggugggcuuggaacuugauaaguugaccaggcuggccucaaacuuaaaaauccaccugcugaacacguuauuuguugguuuuuuguuugguuuuguuuuucuuuaggucugggcaaagaaggaaagaauaauaacauaauaacucagugagcuguacacacagcucuguaccaauaaacacaagggcggucugaguccaucuuaacaguuacucuagaugcauucagguuacucugagacagaaaggaauuuccuagaguuaccagcuuucuauagccuuuaaaacucugcccuuucuauuugguguuugcuguuccacaaguugacucuuacugucugucuguauagcaacagauaguaaauauagaccucaugcuggagauaucgaccccucugggagccguaacccccauccuggagagggaaaaugaagagcaccacuacauuaacaugagcuugccaauugacgccguugugucuguugcuccagaggaaucauggggaaaguagguauuuuuuauaguacuauugccacauuuaaaugaggacauuucuguaaaguaaucagaacucauuuuuuuuaagaaucauauacaagaugauaaggcuguuuuugcugugacauaguucuuguuaucaagcuaagagucauggagaauuaaguauuuauuuggaaggagugggauagcaugcugaaacugagaaggcuuccuuuugcccaccuacaguuacuuugacuuugcauaauuuagacuuugcuugacaagccucaucaguaaaaguguggacuccacucagggcacaucagcuaaaccucauuuuagcugcuauaucuuuuuaauucacuucaaugucuucuccugcagagugcgcaaacuucuaguggaugcaauucucaggcagcuaguugauguggaaaaaugcauccugagauauaugaaaggaacgucuauugugguccccgagccacugcacuuucaauugccagggaaaaagaaucuuguaacgguuuuauauccaucaggaaucccagaugaucagcuccaagccuaucgaaagguaaacgcagaucgguauuaaagagucucuucuucauuuugugcuuaaugauaauugcaauaaauguaaauuauuuugugguuuaauuuaaaaguacagaaaugggcuaaauucuuucaugaauuuuuuuuguaaugaaaacaugccaguuuaguauagcauauaacaccuuaauuucagaugcucaguguggcucauauaguuaugaaaugcuaucauuuucuguaaugaaaaauagaaauggcaagaugcuuacuuaccuaccuggagugcccgguggaaggcguuccucucccuuucccucugcugcuccugauuugugagaaagacaacaucagcacaggggaagguggagucugugcuaauccuguuuauauaaauaaauacgcuuauuuaaguuucaguagagaagcuuuagagagaccuguccagcauuuaaagaaaugagaucuaucaacagaagggcugguuuucagaaucuaacuuuuggaccuguggccuugacugggagucauuaaauuauguucuaaacucugcuccugagaauucauaacacgaacucucucuacuguuucaaaagcuggagauaaauugauuuucagauacuucauaagcuaaccuguugaagccacgagaguauguuggagauuggccagauguuacaauaaguaucguauguuuuuaugcuguugagaaaauaacgcguuacaaacauuggucaguguuuccguucauggcauguugguuguuuuccagucacuaacuuuacuguauuuaauaacugcacuuagaugccugcagcauuaugaacauuguuuuaugaaauacuaaauauaucauuuugaauuguaauuucugauuuacaaaaaucccaauucuagcgaguaauuucacauuucuaucuucuucugauuccuacuacaggauuauaaacugcucucaguuuauuuauccauugaccuuaaugaaugaagucuuuuuuuaaaacuuauacucaauguauuuucuguuuuauaauucuugaguuugacuauauuaacuuaaagucuaaaauuguuuucuuugccuauugauucugauuuauuuaggaguuacaugaucucuucaaucugccucaugacagaccuuauuucaaaaggaucaaugcuuaucacuuuccagaugaacuauauaaagauggcuauaucagaaacccacauacuuaucugaguccaccuaacauagaggguaguauggugagucuaauuaguuuccaugaguugauugaucauugucuuucauucuuuuggauugguccccaagagacauauuuugagaauugauucauauuguaugucaucccuaaaaaauaaucuaucacuugucuuuuuuaagccuuuguucaagaccuuguauaaggagccagguauaguggcgaauaccuuuaaaucuggcauucgugaggcagaggcauguggaucucugaguucgaggucaaccuggucuacguagcaaguuccuggagaaauccugugaaaaacaaugcaaaaaagaaaaggaaaggaaaggaaaggaaaggaaagaaaagaaaagaaaagaaaagaaaagaaaagaaaagaaaagaaaagaaaagaaaagaaaagaccucauuuaagauagguguaauuagugggugagagauggccucguaguuaaaaguguuugcugcucuuccacaggacacgaguucaguuugcagcacccacauacucacaucaagcaacucauagcuucugcaacugccgcucuaggagaucacacacacauacacacacacacacaaaguaagucuucuuuuaaaacaauuugaaaaauguaauugguugagugguagcacacauggcuuuaaucuuagcaaguucuggcuaaccagggagaccauacccugccucaaaaacaauaacugcaauuaaugaccuaaaaggucugugaguagagaguguuuacuacacaucuguuacuaacauagcauucccgaauuccucuaaacguuuguuccuuucugcucauuccgcagccagcagaucaugcuaguuacgggcuucccaagccacagcauggacaaggcuaagaugcuuguccuccuguccucuacauacagcauguaucuguguaaguagcuuagauaacuggauuggcacagagugaggacaggcauuaaauuaaggauacaugaagggcacuaaaaggaaucucauugccacccaagagagggagcacaggaacacaaggccugguagcaacagaccagugcagugacuggagcgggcuuaggcucuccaaagggcugccaggcuccuugcugccaugcagcugcuuucucuguguuggccccugguugcucuuucuguucuugucaacuucuuccucauguaucuugcauuguuucaguuguguagauuugccguucuuucaguaccuuuugagugucugggagcuuugcaagaaaauccuaagaaucaaaaugaguaaaucuaugauaacugcgagagagagcugaggagcccaguuuugaacuuagccaucaguacacacaugcagccacaaccccaucuguaagggcuguagacagaccagcuuccauuggaaauagcuuuagcuggacgccugccaguguguguauauucgugagucagcauuuaugggugucaaaugacuucucuugcuuugagaagacagggagaaauuuggggaaaguauuguuaaaauccugcucaccagagagucauagauuaggaaauggaguuaauaaugucacaacaaaacucuuuguggcauuuggaaauggaguuaauaauuucacaacaaaacucuuuuucuacaagcuccugacuuaaauauuuuucucucaaaccaguuuuagaacuccuccauggcauguguggcauucucuuauuuauuuuaaauucuuaauaguuccuuuuaaaaagccuggagaugguaaaguacuaagugcaugcugauugauuuugacaauaaaacagaucccuuauccauguuacggaaugcaaaaggcaucucuucauuguaguauuuauaauauuuggccuguauauauacacacacauguguauacacacauugauggauaaacacacagcguuucacagcauagcaaaugaguaacuaggaguuucuauuuaguuaagaaacagaacacuacugaucucucugcccuguguccacucacugccuccucaagauagccccaaguaaaugacucuuacacagccuccauaucugcuuguuacacaucugugcauucagccaaucuuaguucaaaaauauuugcagaaaaaaaucugcacugaauauauacauucuugccuugccauuauuuccuagaaaauguaguagccauuuguauaguauuuucauuauuuuuaucuguuuuuauagcuaaucuagaguuuauuuaaaguacaagggaggagccuggcagugguggcgcacgccuuuaaucccagcauuugggaggcagaggcaggcggauuucugaguucaaggccagccuggucuacagagugaguuccaggacagccagggcuacacagagaaaaaccugucucuggaaacccaaaaaaaaaaaaaaaguacaagggaggauaugcauggguuauacgaaacacuaugucauuuuuuauaaaggaacuaaguauccaagguuuuauaucuguauugaguccggggacagauucuaugucugcuaaagggccauugcacagggacacauucuucucuccacuuuuagcgguuucauguguguguguccauagaaggcaugcauuaccuuagcaguguuuguuucauuucgaguuuuauaaaaccuaccauuguguguguguguguguguguguguguguguguguguguguauauguauguauguauguauguauguauagucuuauacaacuuguuuuuccacuuaacuuucugugucuaaaaaguguccuauucugucuaugcacucuuauagaaaauauuuaaucucaaucuggggcuucuaacccaccuuugaucauucaguucccagauaaaagacacacacgaccuuuauauuucuaauaagccuuuauuagcacugaugcuaggcagauaucuauccucuaugcuauuaacaucuguuuccuauugauaacccugaguuacaugcugugugucaucuggacugcucuuagcuccagucagccagucucauggccuugccgacuccuaacccauggugucuuucuuuuuucuccaccuucuuuucucucucucugucucucugucucucugucucucucucucccucucucucucucucucucucucucugucucucugucucucucucuuucucccucccucccucccucccucccucccucccucccucccucccucccucccucccuaccagugacucccucucaggccuccagucccaccuuuccccuccacugcccagcuccagguucuagccuuuuauugacuguuaaacuggggagaagguuccuguggcaucaugaguucuugaugguuugccacuucuaaggaaccaguaguagcacuagaauacaggcagugucuggccagccaacuaccacucuggcuuaguuagcuugauuccuguaugauaaaccuuuguauaguguuuuccagguuuuugugauguuaggcagucuuuuaugaacguucccauucaugugucugguguauauguauguaaacaauuguaaauguuugcuucuuuuuuuuuccccuccauuuuugacucuuucuuuuuuucccugaaccauuucagagaaagcuauaaacuucauauuauuugccccuaaacacuuaaucugaucucccaguaacaauggauuugcauucaucauauaauccaguuuaccauguucauugucaugucuuauucacggcuggauucaguuugaugauauuuugugaagacuuuuucuucucuauuuauaauugauauuuccuuauaauuuucccuuaauuaaaaaauguaucugugaucuacaaccuauuaaaugaguuuauauaugauugguaauguuguauuuuugaucauuugaaaaauaaccuggacuuagcauuuucuuuaugagauaauucuuuauuuaaaauauuuuauuuuaauugcaugugugcgugcgcacacacaugugugaagguggcuguggaagccagagcuccuggaucccucuugaauugugagcugccugaugugggugcagggagcugagcucaggccucugcaggaguggugugcacucuuagcugcugagccaucucuccagccccuuugggaauauucuuaauagcauucaguuuuguuaguguuugugagauguuuucacuuuugugagucauauuuaccuagguuuugauuccucaguuauuuucuuuugaauugcucauaucacuuugugagguuugcuuuucuuuaacaauuugccuucauugaccccucuuuuguaacuucgguuuucuguccuauuaauuuuggaguuuacuuuguuccuuugauuugauguguuuauucuaaauucuuaaauuggaacuuaaucuguuguuaaucuuuccaauuuucuauuguugaguuuuaaauuuuagauaaaacaguacuuuuguuauauucuauaauuuuaauuugaaagauuuuguuuuauucacuuuuaaguauuuuuuauuuauauauggugauacuucagucuuuuagaaaauuauuuaauguccaacauauaccugaaauuuuccuuuucuuacuaguuuauaauaauugauagaaagaauuucuaaggcagacauuuucugagcauguguuaugaaauccgugacggacagaugauacacagugggcaacugcagggaugugucugucacaguucugggcguggaaguccaaagcuaacaucacuugguugagcuaaaggcauccagagccagccucccugcacaggaucccgaggggggaaucauuccucgcuucccuggcuucaggcaaccgcuagcauccuugcugugcucacagcacgcggagcugaguccucuugucccucugugaugaaugcgcacauguuggagaugaggacaucgcuacaguagggagcagcuaguuuucuuccuagcacaguggucuaaugauacauucuaggugauccuuugucagccuguugccuaguugucuugugcgugcccuuucuuuccucacuacucugacuuuuaaaaaauaauaugcuugaacacuucccaguaaagaaguguggacaaaagcguauucacuguugcacacuacagcuuccacaacgacaucuuuuuuccuuugcgggugucgggggagaucuuuacaaggaugcagggcagauaugaguaggauuagggugcacaauguaaaauucacaagaaacuaauuaaaaaauuuaaaaaucuguuuugucuauagaaauuucauuuuaagcauuacacuaugaggaagucccuauuuuaagcguuacuaacacacacuuaaguggcagauuuauaaaccucagaaccgccguuccugcgccccaucagcaagcaggaccugccucuguuugcugaugccuuccucugguccuucccucuuucccucaggcagcauuuacucagcagcaguguguucaucagcugggugcccugccuuucacagaagcuagggccuagagauauuugaauaacaugcuuauauuugaaugaccuaggcuugcuagcccacaugcuggugugcugucacugaaaaacauaauuaguuauauuugaaauaacuaugacuuugaaauuuaaauaugcauaugcagcauacaugaagacaggagagaguugguagccacaacaaaggggaagugguaagaagugagcaugccauuuuuaaacaagcugccauggaaggcuucugguguuugaagagagacugaagugaaaacaggguucauacuauaaaguuaauuggaaaaaggauauuuccaggcaagaaaaucauaaggcuucaugaucagauaaccaauagcauauuugaaaguaauuaaauuaauaaaagggaaagugugggagcuggcauugcucuccagaacgcacaucguucuggguugguuucuguuuagguccacugguaaggaugcuggacuuacaggagaaagccaaaagaauauagugcuaagccacuguucugugaacguaucucuauaggggucuaaagcagugguccucagcuuuccuaaugcugugacaccacaugcuguggugacccccaaccauagauguuguuacuuaacugugauuuugcuacuguuaugaauuguaauauaaauaucuguguuuuccaauggucuuuggugaccccuaagggguugccacccacagguugagaaccacugaccaguaaaaagucuaggucgcaaaacaguaaacaugauuuggguguuucuacagagcauguacuucugucuguaauauuauauuacauuucuucucuuuuauagauuugugugguccagggcaccuaugcuuaucaucauuauaugcaagaucggauugaugacaaugguuggggcugugcuuauaggucccuacagacuaucugcucaugguucagacaucaggguuacacagagagguccauucccacacacagggaaauucagcagguacagaugugccauucuaaauucuaaccaacuguguauuccauugguuuuuaaggucauuaauaaucauuauucuguggcauagauuuauuuuuauuuugaaaaaaaauguuauuuuacugguaaucagaauguccuaaauacaacuuuaguagcugucuuacauauggacuuuuuucuucuugauacauuaaggcucuaguugaugccggcgacaagccagcaacauuuguuggaucacggcaguggauugggucuauugaaguacagaugguacuaaaccaacugauuggugugacuucgaaaauacuguuugucaaguaaguaugcuuuguaaaccacauucaucauuuacacauaacaguuuauaauuuuuauuaaaauaauagaaaaaugacauuuucuuauuucuagucauugcuuuucuuuauuaccuccuugcuuuauaaaucucauuguuuuaaaacaagcuaugugguaaacauauauucucuagaacuaauuuuagucuacauguggaaacuuagaaauauauuaucuuuggguauauauuaguuuuagauacaaaauguaguuuacuaauguuuaaaucuucuaaaagucuaauaaggagaaaaccaaauguugaucacugaucauuaagugaguuugguuuuugguuuuuguuuugguuuuuguuuuuguucuuuuggguuuuuuuuggaggguuuuuuuuuuuuuuuuuuuuuuuuuuuuuuuugcuaagaugugaaauaagccaacagauguaaaaauauauucaauuuacauuuucuacaauucuaguaacaaaacauaagagaaaauuuaaacuaucacaugucaauuuauguggccguaacuuguuuuucuauuaaccauuaaagaagcuuuugauuuuauuaccauaaauguuauauuccauuuuuucucauauauuauaaacuuacuuugggcuuacuuuaaacugcuuauugagacaagacuuuaaacugucuuguauuaauaacuacaguagcaguauuuauuguccaaguauuuagaauauguuugcucucacaauaggaauuguaugaaucaguaagaauaauggcagaaaaaguaguaaagaacuauuuuuaacauuuagguuugcggcuaaugaggcaaaagacuuuuucaccaagccugacuaccugcgucaaugccuagaacccccacauguguaccauagcacaaguguacgcgugcacacacacagaauaguguaagaaacuaaagaaugguuugguacauuaaaacauuuguauguuagcugcucagcuaagaacuuaccagguuuaacacuaccuggugccuccacaaaaguaauaguuacacugauaauucaguuuacauuuuuuuuuuacuuuauaaugauaugaaauuacuuuggauuuuucguuugaucuuacaaauagcaacccaagacucugauaugauggcaguagcuucaaauaaccaaaacuaaauucuaaggagaaaauaauaaguguguuugaacaauuaaagaauuaaaaaggugaggugugcugcuagcuccacuguuguuagagauaguaaauucauuucacucccaauauuuuuaccucggaauguugaggaauauaugugcuuuuccuccugccuuucagaagcgaaaaguauuuagaauucccaaaugcuccauggaauacggugcacuugaaaacacuucgaaguuuucacagaaacauauauuaguccuaaaagcuccucuagccugcauaugggacagguguuauugguccuaauuuaaagauagaaaaaaauauagauuuuuuuaaaaaaugacaaagugaccaguuucaaucucauguuaaaaauccagaaccuuuauacaaccccagaagcagaaagccgaagucuuuguuuucuccccaguuagaagucuuaacaauuuuagguuuaugcuguuuuaagauacagugaaucaggucccuaccacuuaauuuguuuuucaagauccacaaacaaaaagagugaaaguauugcccccuccccaaacucauuacuugacugagugcugaaaauaguuuugugauagaagaugauuucuuuuuauuuagccaagguucagaaauggcuucucaaggacgggaacuagccaaccauuuccagaaugugggcaccccagugauggucgguaagcugcuguggacauguugggaucuuaggcaggguggagaacaaggaaaauguauuugcauucuuaauguuacauaaaaacaagucauuuuaaacaucuuaaaauuggcuuuggagagauggcuuaaugguuaagaacacugguggcuuuuccagaagaccuggguucaccagugcccaccugguggcucacaagcaucugugguuccaguuccagggaguccagugccucugcuggucucuacaggaagugcaucacauggcgcacagacaaagaugcaggcaaaacacacacacacacacacacacacacacgcacauguauauacauauauauguauguguauauauauaauauaauaaaaauuuaaacauuuuaaaguaaacuuauacacacuauucuuuggauuuuaguuuccaaaggguagcaaugaugaaaaaaagaauuaguaaccaaaaaaaaaaaaaaagcuaagaagaaaagaauaaugguauaauacuguuugagcaauuaaagaaucaagaguaauauauauaaaaguguauacuauauauauauacuauauacauauauauaguauauauauaguauacacauauuauauauacacuuuuuuuuuuuuaguuuuuuucgagacaggguuucucuguauagcccuggcuguccuggagcucacuuuguagaccaggcuggccucggaacucagaaaucugccugccucugccucccaagugcugggauuaaaggcaugcgccaccacugccuggcuaagaguaguauuuuuuuuuuucaaggugacagacacuugacuaagcaucguaaaucaugauccugcuacuaacuugacugguuuuaugguuuuaugacacaacagacuacuuaccuuuuuuggguuuucuuuguaaaauaagauuugauuaacugaacuaaagauagaugauucucgcugggcgucucgaaaaaccaaaaaaaaaaaaaaaaaaaaagauauaugauucucugaaaaauagcauaagaucaacugcucuaguguguaaggaguggggguaaguauauaucaguagucacagagaugggcuagacaugcucagcacaggcagggggaccugcuggaggaggugccucacugacauucccgcaucaggaggagguugaccucuuggugggccuuucucaguugauuuaaagaaacuuuauaguuauagcaauggaauguaaacuuuuuaugauuauagauaaaggcauagcauuuuuuauauauuuccauauguaacagucauuaaauguguaaucuuauccuuuaaguauauuugcuaucauggucuuuuacaauaauugacaaucuguuauaaugcugucaauuaauaggaaaacaaucuuuauuugagcugaauaagcaguugaaacuaacuuaugcccuguuacguauuucuuuuucccuagggggagggguauuggcucacacaauacuaggagucgcauggaaugaaaccacggggcagauaaaauuccugauucuagacccacacuauacaggugcugaagaccugcagguuauguuggaaaagguaacucacucucccugucaccuaaacucaaggcacaaggcagagcagagccagagacagcuguuagcaaagaagccaggccagggcagugaccugacagcaguuguucuaagucuguugaguaauccuggcccuauggaggaaagcuaggaaauacagcagaaaccacgggacuaaauguuuauaaaagcuuugcaauugacuaagcuucauaauagaacaugacacauuuccuuuacagaauuuauagcacaugcaguuguguugucucaucgaugucuuaaaaacaagagagcagaauauacuuucuuccuuuuaagaucagacuuggggagaugagugggcagccagcagcucuugcccuuccugcagaggaacagaguucaguuuccagcucaguucucaguguacacgucauggggcucacggccaccuguaaauccaguuccaggaucugcaucucauguacaaaugcacauaugcccuuaauaauucuaggaucgguuaaucaauaaucaaaacaccagucauuaugaagauguggcugcuucucacuuacauacauguaacauaauucuaaagguuggaaguugaggcaaauuuggaaguauuuguuaacauuguaucaacuacaugagguacaaauauaaauugauuuauagccagcuaauucucauaugacaggcuggugagauggcucagcagauaaaaacacuuucugccaaaccugaugaccugacuuugaccccuagagccuacaugguagacaagaaccaacucuugcaagugguccucaggccuucacaaucacaaaauaaauguaauuucuuuagauaauagcaacauuuucccauuccggagcaauuuacugauugucuagcacaggauacaagugauuuuucuucacuuagaaaauccuuuaauuacaucaguaucugagucuuaugccaaaguccugcugacagagcuugauauuauacaguuucuauuguggagucuuguguuguaaaggauuuguucuccuuucucccaaaucuagggcugguguggauggaagaguccagacuuuuggaacaaggaugcauacuauaacuuaugccuuccucaacgaccuaaugcucuuuaaauuaucuuggaggcaagacuaugaauauaaaagagcuguucuaauguuaauaaaagcauacauaauuuuaaaucuuagcugugauuuaaaaaguaguaaagaaugcacagaaauuuuaauuccuugaauauucuuuuaauaaguuaaguaaaaaacaugcacauccaaaauauuguagucauguaaauacauguauucaugaauguucucuucacuuagaagaaaguuuuccuccucaggaguuucaucaugugaugagccaaagcaauggcuuguagaucugucugaagugaagcucuucuucaagccucuucuuuccucuugcccaacaagacaucuguuuuggagagaaaaaaaaaacaaacaaacaaacauguugagacuaaaaauauuucuaaggggaccugagaaauggcccagugguaggagcgcuugcuccauaaucaugaggaccggagcuuguaucccagcucccaagcaacaagacagacagacagacuacaaaugccuggccuggccucccagcuccaaggggucccagguccucuccuggccuccacacacacaggcacaugaauguguguacacacaaacacacaaccuuaaaaaacuuuuaaaagaaggucucguccccaaauucccaccauacaggac

SEQ ID NO: 4426 - RNA, 9765 nt, Mus musculus
uaaaaacaagagagcagaauauacuuucuuccuuuuaagaucagacuuggggagaugagugggcagccagcagcucuugcccuuccugcagaggaacagaguucaguuuccagcucaguucucaguguacacgucauggggcucacggccaccuguaaauccaguuccaggaucugcaucucauguacaaaugcacauaugcccuuaauaauucuaggaucgguuaaucaauaaucaaaacaccagucauuaugaagauguggcugcuucucacuuacauacauguaacauaauucuaaagguuggaaguugaggcaaauuuggaaguauuuguuaacauuguaucaacuacaugagguacaaauauaaauugauuuauagccagcuaauucucauaugacaggcuggugagauggcucagcagauaaaaacacuuucugccaaaccugaugaccugacuuugaccccuagagccuacaugguagacaagaaccaacucuugcaagugguccucaggccuucacaaucacaaaauaaauguaauuucuuuagauaauagcaacauuuucccauuccggagcaauuuacugauugucuagcacaggauacaagugauuuuucuucacuuagaaaauccuuuaauuacaucaguaucugagucuuaugccaaaguccugcugacagagcuugauauuauacaguuucuauuguggagucuuguguuguaaaggauuuguucuccuuucucccaaaucuagggcugguguggauggaagaguccagacuuuuggaacaaggaugcauacuauaacuuaugccuuccucaacgaccuaaugcucuuuaaauuaucuuggaggcaagacuaugaauauaaaagagcuguucuaauguuaauaaaagcauacauaauuuuaaaucuuagcugugauuuaaaaaguaguaaagaaugcacagaaauuuuaauuccuugaauauucuuuuaauaaguuaaguaaaaaacaugcacauccaaaauauuguagucauguaaauacauguauucaugaauguucucuucacuuagaagaaaguuuuccuccucaggaguuucaucaugugaugagccaaagcaauggcuuguagaucugucugaagugaagcucuucuucaagccucuucuuuccucuugcccaacaagacaucuguuuuggagagaaaaaaaaaacaaacaaacaaacauguugagacuaaaaauauuucuaaggggaccugagaaauggcccagugguaggagcgcuugcuccauaaucaugaggaccggagcuuguaucccagcucccaagcaacaagacagacagacagacuacaaaugccuggccuggccucccagcuccaaggggucccagguccucuccuggccuccacacacacaggcacaugaauguguguacacacaaacacacaaccuuaaaaaacuuuuaaaagaaggucucguccccaaauucccaccauacaggacaaacuuuuggucucuagaagcuggucagcaguaacuauaaccaaugauaaaauuuuaaaaaacaaaaauauacuggaccuuagaucagagugccaacauuaagugcaacaaucaagucugccaggagagccaauccuaaggagaaagcaggccacaccaugaggcacucaccaacacuuucucuucaucacuccacucuccacaguccugaaacuccgcuucugucucagcacaggagcacgggggucacgcuccuguugcucaccugaugaucuugccgucugcauacauuuaaucauuguuagaaaccuggcacauucuggaaagccauaugaccaagcaagaucuucagcugucugcccauucuuauugcauacgcugaaauuagacaaaaauugaguuaagugaaaauuauuguuuauuauuuuucuaguagaggaaauuggaauacauaucaacacagggaacaggauaaaagaggucucacacucucgagaacauacauacacaucacaccggaauugggccaaagaaagaucaaggaaauuaaauucuguucacuguaugcucagugacuagcacaccgcauaucauggacagucuaucguauuuuuauuccauuaucauauuucacuauugaaagaaucuaacuacaagaauauuugguguucaaauucacuguauuuaacuauaugguucaguagauagccagugagaacuucuauaggaaaagucuuccugagccaaaacuguaguagaaugccaugaagacuugcaccucuggaugccgaacaucuguuuccacuuacucuauuugauaauauucaauuccuggaaggauaacauuauauuaccaguuaggcgaguauuauuuuuaagaucauauauaauuaggaguaugguuaauuuaauccaagaaaccacaaagccucagaccacugauuucagacucacccaaucuggacaucacuggccacaaggaggcucaggcaguccaggcuuccaaccuuugcugccuuguggaguggaguuucucccaagacauccuguaagacaagacugcacauuagggucucccuaacauucuguagaagccagugggcaaaguaauaccagcuauuugagggagccagugaaaacuaccuuguaacaacuggauuauuccacuaauuguauuuuucaugaaguucucuugcugugcuaauacaaaguuuccauuaauaaaaacaugccaucauauuugcacacauuaaaaaauuaagggaaugccagcacacuauagaguucuauagaagccaaagguuuacaauuaaaaacuucgucacacucuaaugaagaugaagacuacuggaagaauugauggugggcauguuucccacauacuauuuccugguugacuggaacuuggacaauagcaaguacuuuuaaaaguacaguaaauacaugcuauauauauauauuugaaaugugguucgacuucacugagcuaugccauaaaaguaaaauacacacugaauugggaaccgugguacaagagcaaaauaaaauacacauaaaucauugcugauauaauuacauacugaaagaguauuugggauuagauuauuaaaagaaaucccauggcuuguuuuuguuuuauuaauguggauacuaaaaaguuccaaguuaccaucuugcaguauguauuuuucuccuggaaauuccuauaugccuguuuauaccaacugaaacggacaucuaggaaauguccgugcagacacuggguggaggagaggguuguacauagcaacaaucgguuaccuaguuaccuguugguugaggucagcaccuguuugcagcugccagagaagaaagcacgcaaggccgccaccugcagcuaggugagcaggcgacugcuccuggggauccggaggugcguucacugaugcuccugucuccagcaaacucuuaaggucauccuccugcaggaaaagaacagcuugucacuguccugucccgcucgagcccucugagcugaaaauccaccccuccacggaaaaaaaaagaaaacaagaucugacaagguuugacuugguaacccagcaguuugucacugucacguuuguuagagcuccuaagacacacagaccucugggagaucuagccugcaggacuuaaaggggcgagagucucaccuccaaguugcaacuaagcaacagcaucgcccaccuaaagcagaugacaaguguccccgggaguucagagaggcaacacuggccgguaagaaugcaagggacugccccaguucgggagaauuuaaagcucucgggaaccugcagggccgcggcuccuccccgccgcuccccagccugggagcguucccacggccugguucugcccagcgcgauguccccagccccgcugcggccucacguacccaaacacugacaugugcagccuggaaccccaagcaaaagaggagggggcggagccugcugcgcggccugccagcugauuggccaggccgaccucccccuggguccgcccuguugggagcgaagcccaggcggccgcagcacgcgugcgcagugaagguggugggcgaagaggguggaaggccuggccuuugcgcuuuggcggcggccaugaugcgagccgagcuaggcacguacugcuggguggagucaagcccuuuuagcccucuggagaagccgcaaucgccggugcauggcuuugugacugagagcacgcacguagcccggaaaagagggaagcagaaguagcccacacccauccacccccgcaggccccgcguccuccaccuccagcuugguccgaaggugcuuccuccugccccacguccuccgccgccgcgcgcgccgcaggaugcuuuggaaggggaugcagcgguggggcguuagagggcaugucgaugagacugugacggaggguuuaccauaggagaugcucucccaaacccagugaauuaccuaucagucaguguugccuuugugagcaagguggcaauuccugugaaauaagccacccauugucacacguccccugaggguccgaaacccguccugguuccggcaauagcuaguaaauacaaggaguuugccaaggggauggcccucacuccgguuauuaggaauaauaagaauacggaaaggaaagaacaaaagauuaccgugaagaaagcagccaagugauuuaauguuagugaugugaucugcugacagcaugaaccccugcgcuaggacaugagaagggcuucaucaaaacccagaacccaaauuagagcaucagauaagccugaggaacaaaaggacucuucccaggauacuacuacucaaagccuugaagucaguaaagucugagaagcagaccaaaagaaacaauaauuuagggugagauuuuaaaacaaacauggcauuacugguaaaauucaugacaauguaauaacugcaaaguuugaauuccuuuucaugaacccuguugacuucugacuguaguuaaaguuaaugguagcaggugaaacauagagguaagaaacuauuaacagcugguuagacaucaaauaacauguagaguuuacuugacacagaagaccgugucgcuuaaaauagucuauguugugcuucuuccuguaaaucuuagcuccuaaggaaguuuuauuuaaauauuuggcuucccguuuuaaugaggauucuuuuucaauaguuguaacagaagauaucugaaccaguaugguuuuaaagaacagcaaguuuaucauagucacaguuuucccaacaagucacaaaauucucacccauuaauuuucacuaaccaauauaauucuuuaauaaggcacacugcucauuguggugguccacaaucuuaggcuguucccuagaacagggcuucuuaaaacuuuuuucacucauggcuccucagugccugaaaaaaaaaaaauuguauuuaacucuaguuauauagguguguacaacaggugcaaaucaaaccugauaaucugauuuuaauacaguucucucagauguguauaauuugaccauuucuaagauuguaauguaauuugcauacuaaccugaguucagucuucagcucccacaugaauaacaaaacaaggacagcuaccugcaccugucauuccaaagcuggagggggugaacauaggagaauccccgagacuugcagucugauccugacacacacacacacacacacacacacacacacacacacacacacagcuauuugaaaaccuagccaucuagaaaaauaacaauggugacuucuaccuuaagaccuaucuaugacuuccccauccaugggcucucgaccaggauuacaguaccaaauaugauauucucuccugaggagccagcuuaaaguccaaucagaaagcaguuaccccaugacaguugugccccuguugcaguagugggcacuuguugcuuggccagguuuguauugucauauguggaguccagcacuagguaaaagcucucaugucuuuccccacucaacagacugcacugcaccuucuggcucugugaaaacuagauagcaggaggcaauuucccagucgcuuugagauuggugucucucugcccuaaagccaugggguauggugucuucagcaagaggguuuuaccauguacuuuggcaauggcaauagcuuacguuguuucggagacuucuuuaauugcgguuuuccuguaauaacccaagucgucuuggaguuuacagagugcucacucacccauaacaagacuucuucaucuacuccuuaccaccaccuccgcugaggcucuggggaugguggcaaagaaguguuagaaaauaggaucagcaggaggauggcaaggaguucugugcgaugcugacuucugagcagagucuggguaucaccgcaugggcucacaucugcuggacuuagcugcacuagaucaaaccaagcaauauuccaauauaaacuuggggagggggaguucucuucaggccccaccccuuguugacaagcuauuagcaguuuauaaauaccgaagagggaaucuuuuuuuuuuuuuuuaauuuugaugguauggccccuaauuaaguuuccugugauucagcagauggauccacgcccacgcauacauagauaacacugaucggauuuaguauauuauuuagaagaagacaaugacaugauguugggaggggacaugugagggagguuagggagaaguugaauaugaucacuuccguugaaugcauggaugaaauucucaagaauaaagaaaaaauaagacagaauugaagaagacacccaaagcugaccucugucuuucauauacacacuguccuacuuuucuauugcugugaagcaacaacaugaccaaggcaacuuaaagaagaaaaaguuuauugggggcuuauaguuucagaggguuacaauccaugaccaucauagcaggaagcauggcaguaggcagacaggcauagcucuggagcaguagcugugaguguauaucuuuauucaggaaagagagagagaaagaggaagagagagagagagagaggccaaccaacuggggaccaaguaaucaaauauaugagccuauguggccauugucauucaaaccacucacaugcgcauauguacacuugcaacuacccacaugaacauguauacacaaauaagcaaauaauagggaacaucauucuacacuaguguuuuucaugggcauuucaaaagucauacuucuuuuaaagcaaccuauucauacaucagcccaugacuuaaagaagaaagagacaauuauaaacucucacagcucaccgcuacuuaaauuguuucagcauacaagaaaaaaguggaguauaauaguuguacguguuguaaguuaauauguagcuggugugcuugucuuagucaggguuucuauuccuggacaaaacaucaugaccaagaagcaaguuggggaggaaaggguuuauucagcuuacaucaucacugaaagaagucaggacuagaacucaagcaggucaggucagggagcaggagcugaugcagaggccauggagggauguucuuuacuggcuugcuuccccuggcuugcucagccuguucucuuauagaaccaggacuaccagcccagagauggcaccacccacaaggggccuuucccccuugaucacuaauugagaaaaugccugacaguuggaucucauggaggcauuuccccaacugaagcuccuuucucugugauaacuccagcugugucaaguugacacaaaacuagccaauacaugugcuuaugguuuuuugguuaaucucuacuuuuuuccuuguuuaaccaacucucagucccauuacuauaucagaggacaucuacugcaguuuuaauacauccuaucucuuucauccaugggacauaaaaggucagugagguggcucagucuguaaaggugcuugcuacccagccaaacaaccuugagcucuacaugguagaaagagagaaacugcucaagcaacuuguccucugaccuucaaacacauguacacagugugcaugugugugcacacacguacacacacacacacacauacauugugaaaauuuuuaaauaaaauauucauauaguugaaauacaauuuguuuaacuuaacuugaaacauucucuuauuaaaaacucaaauauguugaaauauuagcaucccauuugaauuaaccuuuccuaagaggaggaaaauaaaugcugaucuuaguagucaaauaauagcuaaaccaaaugaaaagcagugcaaugggugacacaaagagaagucugcucaaaguauguacucaguauauuuucugggcacuuuaaguaauagacaguuuuaaaguaagccguuggauuuccaaccuuuaacgugauuucccaaaucaucuaauacaucugauuuugguuuauuuguucuuggguuuugcuuuuuugugacagacccccuuuauuuagaucccuugagaucaccuacccuugcuuucugaacgcugggauuagaagcaugaaccuauaggccuagcaauaaaccuuuuaaucauuaaauuauccuauccaaguauaauugacaguguguauuucugagaaacuuggacuuuugcaaaaaaaaaaucauugcaguuaugcacagaaauuuuuuauaucuagccguuuuuaaaccuugcugaaauucuguuacuugcucaaaggaauugaaaaguagagcguucuugggaaaaaaagucacucaaguauuuagaauguugaaaguuuuuuauuauuauuauuauuauagaaguaauuacaucacagucauagcauuacauacuggcggcuaucauuuguuuagagacacauaguuagauucaaaucuucacuccauuacugccuacccuuccugaaaauuuacuuacaaaucccgaggaucaaaugaugauacagcacuuaacagggaaaagucgggaaacaaagaauuguuuuuguaaugaucugcauuaaaauauauauauauauauaguaggcuauagucuuugaucaaucuuaugcaugcauuuuccuuggggcggggggggggggggauguaggcuagguagggaugggaaggaguggagagaguuuggccagcaauaaaauacaccuaagauaagauccaaagugaaguauugauuccaccuuugaaacuuccugaagccuuccaccagcugauugugugacucaggagaggacauuucagacugaaaccagaacauugagagcaggagcguaccccacccagcccccagucucaaacagaagaccaccuuuuccuccuagaaaacaucuccucucugucuuguucuaaaaucgaaaucugugacuucucugggaaagaaagaccuuccccggacuaaagagacaacuggaacuuccuguaaccugagaaggaucuaaggaccuggggcagggacaagcaaccugugcaacucucagaauuguuuucuagauaguugaguuucucugcuugaugcguuccuccuagucacugggacaacaggacaacguaaacuaggcugcuucagacucuuguuuuguuucugugcucagcuguugccacgcugggaggguaaggaacaauuuuccauacuaaagagcuuuacugccuggucuccaaacgucagucaccuuucuacaacagcagcaugagcuuacccgugcaaacacucuauguagcuucuauacaaucacuauaugcauuucuacuuaccauuggguguuaaauggaauccaccaa

SEQ ID NO: 4427 - RNA, 9765 nt, Mus musculus
uugguggauuccauuuaacacccaaugguaaguagaaaugcauauagugauuguauagaagcuacauagaguguuugcacggguaagcucaugcugcuguuguagaaaggugacugacguuuggagaccaggcaguaaagcucuuuaguauggaaaauuguuccuuacccucccagcguggcaacagcugagcacagaaacaaaacaagagucugaagcagccuaguuuacguuguccuguugucccagugacuaggaggaacgcaucaagcagagaaacucaacuaucuagaaaacaauucugagaguugcacagguugcuugucccugccccagguccuuagauccuucucagguuacaggaaguuccaguugucucuuuaguccggggaaggucuuucuuucccagagaagucacagauuucgauuuuagaacaagacagagaggagauguuuucuaggaggaaaagguggucuucuguuugagacugggggcugggugggguacgcuccugcucucaauguucugguuucagucugaaauguccucuccugagucacacaaucagcugguggaaggcuucaggaaguuucaaagguggaaucaauacuucacuuuggaucuuaucuuagguguauuuuauugcuggccaaacucucuccacuccuucccaucccuaccuagccuacauccccccccccccccgccccaaggaaaaugcaugcauaagauugaucaaagacuauagccuacuauauauauauauauauuuuaaugcagaucauuacaaaaacaauucuuuguuucccgacuuuucccuguuaagugcuguaucaucauuugauccucgggauuuguaaguaaauuuucaggaaggguaggcaguaauggagugaagauuugaaucuaacuaugugucucuaaacaaaugauagccgccaguauguaaugcuaugacugugauguaauuacuucuauaauaauaauaauaauaaaaaacuuucaacauucuaaauacuugagugacuuuuuuucccaagaacgcucuacuuuucaauuccuuugagcaaguaacagaauuucagcaagguuuaaaaacggcuagauauaaaaaauuucugugcauaacugcaaugauuuuuuuuuugcaaaaguccaaguuucucagaaauacacacugucaauuauacuuggauaggauaauuuaaugauuaaaagguuuauugcuaggccuauagguucaugcuucuaaucccagcguucagaaagcaaggguaggugaucucaagggaucuaaauaaagggggucugucacaaaaaagcaaaacccaagaacaaauaaaccaaaaucagauguauuagaugauuugggaaaucacguuaaagguuggaaauccaacggcuuacuuuaaaacugucuauuacuuaaagugcccagaaaauauacugaguacauacuuugagcagacuucucuuugugucacccauugcacugcuuuucauuugguuuagcuauuauuugacuacuaagaucagcauuuauuuuccuccucuuaggaaagguuaauucaaaugggaugcuaauauuucaacauauuugaguuuuuaauaagagaauguuucaaguuaaguuaaacaaauuguauuucaacuauaugaauauuuuauuuaaaaauuuucacaauguauguguguguguguguguacgugugugcacacacaugcacacuguguacauguguuugaaggucagaggacaaguugcuugagcaguuucucucuuucuaccauguagagcucaagguuguuuggcuggguagcaagcaccuuuacagacugagccaccucacugaccuuuuaugucccauggaugaaagagauaggauguauuaaaacugcaguagauguccucugauauaguaaugggacugagaguugguuaaacaaggaaaaaaguagagauuaaccaaaaaaccauaagcacauguauuggcuaguuuugugucaacuugacacagcuggaguuaucacagagaaaggagcuucaguuggggaaaugccuccaugagauccaacugucaggcauuuucucaauuagugaucaagggggaaaggccccuuguggguggugccaucucugggcugguaguccugguucuauaagagaacaggcugagcaagccaggggaagcaagccaguaaagaacaucccuccauggccucugcaucagcuccugcucccugaccugaccugcuugaguucuaguccugacuucuuucagugaugauguaagcugaauaaacccuuuccuccccaacuugcuucuuggucaugauguuuuguccaggaauagaaacccugacuaagacaagcacaccagcuacauauuaacuuacaacacguacaacuauuauacuccacuuuuuucuuguaugcugaaacaauuuaaguagcggugagcugugagaguuuauaauugucucuuucuucuuuaagucaugggcugauguaugaauagguugcuuuaaaagaaguaugacuuuugaaaugcccaugaaaaacacuaguguagaaugauguucccuauuauuugcuuauuuguguauacauguucauguggguaguugcaaguguacauaugcgcaugugagugguuugaaugacaauggccacauaggcucauauauuugauuacuugguccccaguugguuggccucucucucucucucucuuccucuuucucucucucuuuccugaauaaagauauacacucacagcuacugcuccagagcuaugccugucugccuacugccaugcuuccugcuaugauggucauggauuguaacccucugaaacuauaagcccccaauaaacuuuuucuucuuuaaguugccuuggucauguuguugcuucacagcaauagaaaaguaggacaguguguauaugaaagacagaggucagcuuugggugucuucuucaauucugucuuauuuuuucuuuauucuugagaauuucauccaugcauucaacggaagugaucauauucaacuucucccuaaccucccucacauguccccucccaacaucaugucauugucuucuucuaaauaauauacuaaauccgaucaguguuaucuauguaugcgugggcguggauccaucugcugaaucacaggaaacuuaauuaggggccauaccaucaaaauuaaaaaaaaaaaaaaagauucccucuucgguauuuauaaacugcuaauagcuugucaacaagggguggggccugaagagaacucccccuccccaaguuuauauuggaauauugcuugguuugaucuagugcagcuaaguccagcagaugugagcccaugcggugauacccagacucugcucagaagucagcaucgcacagaacuccuugccauccuccugcugauccuauuuucuaacacuucuuugccaccauccccagagccucagcggagguggugguaaggaguagaugaagaagucuuguuaugggugagugagcacucuguaaacuccaagacgacuuggguuauuacaggaaaaccgcaauuaaagaagucuccgaaacaacguaagcuauugccauugccaaaguacaugguaaaacccucuugcugaagacaccauaccccauggcuuuagggcagagagacaccaaucucaaagcgacugggaaauugccuccugcuaucuaguuuucacagagccagaaggugcagugcagucuguugaguggggaaagacaugagagcuuuuaccuagugcuggacuccacauaugacaauacaaaccuggccaagcaacaagugcccacuacugcaacaggggcacaacugucaugggguaacugcuuucugauuggacuuuaagcuggcuccucaggagagaauaucauauuugguacuguaauccuggucgagagcccauggauggggaagucauagauaggucuuaagguagaagucaccauuguuauuuuucuagauggcuagguuuucaaauagcugugugugugugugugugugugugugugugugugugugugugugucaggaucagacugcaagucucggggauucuccuauguucacccccuccagcuuuggaaugacaggugcagguagcuguccuuguuuuguuauucaugugggagcugaagacugaacucagguuaguaugcaaauuacauuacaaucuuagaaauggucaaauuauacacaucugagagaacuguauuaaaaucagauuaucagguuugauuugcaccuguuguacacaccuauauaacuagaguuaaauacaauuuuuuuuuuuucaggcacugaggagccaugagugaaaaaaguuuuaagaagcccuguucuagggaacagccuaagauuguggaccaccacaaugagcagugugccuuauuaaagaauuauauugguuagugaaaauuaaugggugagaauuuugugacuuguugggaaaacugugacuaugauaaacuugcuguucuuuaaaaccauacugguucagauaucuucuguuacaacuauugaaaaagaauccucauuaaaacgggaagccaaauauuuaaauaaaacuuccuuaggagcuaagauuuacaggaagaagcacaacauagacuauuuuaagcgacacggucuucugugucaaguaaacucuacauguuauuugaugucuaaccagcuguuaauaguuucuuaccucuauguuucaccugcuaccauuaacuuuaacuacagucagaagucaacaggguucaugaaaaggaauucaaacuuugcaguuauuacauugucaugaauuuuaccaguaaugccauguuuguuuuaaaaucucacccuaaauuauuguuucuuuuggucugcuucucagacuuuacugacuucaaggcuuugaguaguaguauccugggaagaguccuuuuguuccucaggcuuaucugaugcucuaauuuggguucuggguuuugaugaagcccuucucauguccuagcgcagggguucaugcugucagcagaucacaucacuaacauuaaaucacuuggcugcuuucuucacgguaaucuuuuguucuuuccuuuccguauucuuauuauuccuaauaaccggagugagggccauccccuuggcaaacuccuuguauuuacuagcuauugccggaaccaggacggguuucggacccucaggggacgugugacaauggguggcuuauuucacaggaauugccaccuugcucacaaaggcaacacugacugauagguaauucacuggguuugggagagcaucuccuaugguaaacccuccgucacagucucaucgacaugcccucuaacgccccaccgcugcauccccuuccaaagcauccugcggcgcgcgcggcggcggaggacguggggcaggaggaagcaccuucggaccaagcuggagguggaggacgcggggccugcggggguggaugggugugggcuacuucugcuucccucuuuuccgggcuacgugcgugcucucagucacaaagccaugcaccggcgauugcggcuucuccagagggcuaaaagggcuugacuccacccagcaguacgugccuagcucggcucgcaucauggccgccgccaaagcgcaaaggccaggccuuccacccucuucgcccaccaccuucacugcgcacgcgugcugcggccgccugggcuucgcucccaacagggcggacccagggggaggucggccuggccaaucagcuggcaggccgcgcagcaggcuccgcccccuccucuuuugcuugggguuccaggcugcacaugucaguguuuggguacgugaggccgcagcggggcuggggacaucgcgcugggcagaaccaggccgugggaacgcucccaggcuggggagcggcggggaggagccgcggcccugcagguucccgagagcuuuaaauucucccgaacuggggcagucccuugcauucuuaccggccaguguugccucucugaacucccggggacacuugucaucugcuuuaggugggcgaugcuguugcuuaguugcaacuuggaggugagacucucgccccuuuaaguccugcaggcuagaucucccagaggucugugugucuuaggagcucuaacaaacgugacagugacaaacugcuggguuaccaagucaaaccuugucagaucuuguuuucuuuuuuuuuccguggagggguggauuuucagcucagagggcucgagcgggacaggacagugacaagcuguucuuuuccugcaggaggaugaccuuaagaguuugcuggagacaggagcaucagugaacgcaccuccggauccccaggagcagucgccugcucaccuagcugcagguggcggccuugcgugcuuucuucucuggcagcugcaaacaggugcugaccucaaccaacagguaacuagguaaccgauuguugcuauguacaacccucuccuccacccagugucugcacggacauuuccuagauguccguuucaguugguauaaacaggcauauaggaauuuccaggagaaaaauacauacugcaagaugguaacuuggaacuuuuuaguauccacauuaauaaaacaaaaacaagccaugggauuucuuuuaauaaucuaaucccaaauacucuuucaguauguaauuauaucagcaaugauuuauguguauuuuauuuugcucuuguaccacgguucccaauucaguguguauuuuacuuuuauggcauagcucagugaagucgaaccacauuucaaauauauauauauagcauguauuuacuguacuuuuaaaaguacuugcuauuguccaaguuccagucaaccaggaaauaguaugugggaaacaugcccaccaucaauucuuccaguagucuucaucuucauuagagugugacgaaguuuuuaauuguaaaccuuuggcuucuauagaacucuauagugugcuggcauucccuuaauuuuuuaaugugugcaaauaugauggcauguuuuuauuaauggaaacuuuguauuagcacagcaagagaacuucaugaaaaauacaauuaguggaauaauccaguuguuacaagguaguuuucacuggcucccucaaauagcugguauuacuuugcccacuggcuucuacagaauguuagggagacccuaaugugcagucuugucuuacaggaugucuugggagaaacuccacuccacaaggcagcaaagguuggaagccuggacugccugagccuccuuguggccagugauguccagauugggugagucugaaaucaguggucugaggcuuugugguuucuuggauuaaauuaaccauacuccuaauuauauaugaucuuaaaaauaauacucgccuaacugguaauauaauguuauccuuccaggaauugaauauuaucaaauagaguaaguggaaacagauguucggcauccagaggugcaagucuucauggcauucuacuacaguuuuggcucaggaagacuuuuccuauagaaguucucacuggcuaucuacugaaccauauaguuaaauacagugaauuugaacaccaaauauucuuguaguuagauucuuucaauagugaaauaugauaauggaauaaaaauacgauagacuguccaugauaugcggugugcuagucacugagcauacagugaacagaauuuaauuuccuugaucuuucuuuggcccaauuccggugugauguguauguauguucucgagagugugagaccucuuuuauccuguucccuguguugauauguauuccaauuuccucuacuagaaaaauaauaaacaauaauuuucacuuaacucaauuuuugucuaauuucagcguaugcaauaagaaugggcagacagcugaagaucuugcuuggucauauggcuuuccagaaugugccagguuucuaacaaugauuaaauguaugcagacggcaagaucaucaggugagcaacaggagcgugacccccgugcuccugugcugagacagaagcggaguuucaggacuguggagaguggagugaugaagagaaaguguuggugagugccucaugguguggccugcuuucuccuuaggauuggcucuccuggcagacuugauuguugcacuuaauguuggcacucugaucuaagguccaguauauuuuuguuuuuuaaaauuuuaucauugguuauaguuacugcugaccagcuucuagagaccaaaaguuuguccuguauggugggaauuuggggacgagaccuucuuuuaaaaguuuuuuaagguuguguguuuguguguacacacauucaugugccuguguguguggaggccaggagaggaccugggaccccuuggagcugggaggccaggccaggcauuuguagucugucugucugucuuguugcuugggagcugggauacaagcuccgguccucaugauuauggagcaagcgcuccuaccacugggccauuucucagguccccuuagaaauauuuuuagucucaacauguuuguuuguuuguuuuuuuuuucucuccaaaacagaugucuuguugggcaagaggaaagaagaggcuugaagaagagcuucacuucagacagaucuacaagccauugcuuuggcucaucacaugaugaaacuccugaggaggaaaacuuucuucuaagugaagagaacauucaugaauacauguauuuacaugacuacaauauuuuggaugugcauguuuuuuacuuaacuuauuaaaagaauauucaaggaauuaaaauuucugugcauucuuuacuacuuuuuaaaucacagcuaagauuuaaaauuauguaugcuuuuauuaacauuagaacagcucuuuuauauucauagucuugccuccaagauaauuuaaagagcauuaggucguugaggaaggcauaaguuauaguaugcauccuuguuccaaaagucuggacucuuccauccacaccagcccuagauuugggagaaaggagaacaaauccuuuacaacacaagacuccacaauagaaacuguauaauaucaagcucugucagcaggacuuuggcauaagacucagauacugauguaauuaaaggauuuucuaagugaagaaaaaucacuuguauccugugcuagacaaucaguaaauugcuccggaaugggaaaauguugcuauuaucuaaagaaauuacauuuauuuugugauugugaaggccugaggaccacuugcaagaguugguucuugucuaccauguaggcucuaggggucaaagucaggucaucagguuuggcagaaaguguuuuuaucugcugagccaucucaccagccugucauaugagaauuagcuggcuauaaaucaauuuauauuuguaccucauguaguugauacaauguuaacaaauacuuccaaauuugccucaacuuccaaccuuuagaauuauguuacauguauguaagugagaagcagccacaucuucauaaugacugguguuuugauuauugauuaaccgauccuagaauuauuaagggcauaugugcauuuguacaugagaugcagauccuggaacuggauuuacagguggccgugagccccaugacguguacacugagaacugagcuggaaacugaacucuguuccucugcaggaagggcaagagcugcuggcugcccacucaucuccccaagucugaucuuaaaaggaagaaaguauauucugcucucuuguuuuua

SEQ ID NO: 4428 - RNA, 1865 nt, Mus musculus
gccccuucuuuuuuuuuuuuuuuuuuugucaguuacugcagcacuuuaauuucuuuacacaaugucguguugcuggggccuaaugcucucauugaacaguagaaaaccaaaauuugucauuucuuaaagaauugaguacaaaaaaccuuacauaaauuaaaaggauggauacauuuacaggugucgauucaaacguucccagcucaaggcaacuaacaacccauggcggucaggagggaagaaaccagaacggaaacuggguccuaaggcucggacuuucccaccguguuagacuggcaagaaggagugguaacugguucaggaacccuugccagacucgggaaauccuggaagucugcuauugguuaauauccugcacagaucacuccguagugcucacagagaucaaccaggcugggguuuucucgcccacagcgugcucucuccagccccaagugaccgagccacaugaacuaaggacuaaaucaagauaugcacaggguauuaaacauauaccaagggagcaguuaacuugaauacaaggucaaaaaucagcaacaaguucuacgauccagugcugauaucagauacaagcuucaaggacaaauuucuuuucaaaggcuuauuccaguuucaugaggcuagcaugagguguauacauuugccagggcaaaucgauacuucaauaucagcucaugcagcagaugccuggcaccugcucaguccaucuagaagcauuugcgguggacgauggaggggcccgacucaucauacuccugcuugcugauccacaucugcuggaagguggacagugaggccagaauggagccacggauccagacugaguacuugcgcucagggggagcaaugaucuuaaucuucauugugcugggugcuagggcugugaucuccuucugcauccugucagcaaugccuggguacauggugguaccaccagacagcacuguauuggcauacaggucuuugcggauauccacaucacacuucaugauggaguugaagguggucucauggauaccacaggacuccaugcccaggaaggaaggcuggaagagugccuccggacaccggaaccgcucauugccgauggugaucaccugcccaucgggcagcucauaacucuucuccaaggaggaagaugaugcagcaguagccauuucuugcucaaaauccagggcaacauagcacagcuucuccuuuaugucacgaacaauuucccucucagcaguggugguaaagcuguagccccguucagucgggaucuucaugagguagucugucagguccgggccagccagguccagacgcaagauggcguggggaagggcguagcccucauagaugggcacugugugugugaccccgucaccagaguccaugacaaugccaguggugcgcccaguugcauacaaggacagcauugccugaauggccacuuacauggcugggguauugaagguuucaaacauuaucugcgucaucuucucucuguuagcuuugggguucaggggggccucggucagaagcaccaggugcuccucaggagccacacgcagcucauuguagaagguguggugccagaucuucuccaugucgucccaguuggugacaaugccguguucgauaggguacuucagggucaggauaccccucuugcucugggccucgucacccacguacgagucuuucuggcccaugcccaccaugacgcccuggugucgggggcgcccuacgauggaagggaacacggcccugggggcguagucaccagcaaagccggcuuugcacaugccggagccauugucaaugacgagugcguuugccccuucuuagaauugggaaca

SEQ ID NO: 4429 - RNA, 342 nt, Mus musculus
auugcggaaguccuguauuccuagccaaggacuguggcgaaacuugguguggggaccguggugaaacuggauuaaagggguucguguauaucugugcuaaagaaagaugggacuucuucagcuaccguggucccuccaagcagagaagcaagcagagaggcuaugccaaggugucagcuguggaagaauguuaaggauggaagagcuaaagggcaccugcaacauuccauagcaucacauuaucaggguucaggagacuuccagauuuacccuuugcccuaccucagauucguugugaaacuagagggcaguuugggugaccuuaguggcuuuugcuugcug

SEQ ID NO: 4430 - RNA, 107737 nt, Mus musculus
gauuuccagccucggcuccucgcaguuuccucuccuuguuuugcuuucgaucuggacuguucucaggcaagccggggacuaacuuuuaguuuugcuccugcgauuauucaacugacgggcuuucauuuccauuuuacacacccuaacaacacucacaccuugcgggauuguauugguagcguggaaaaaaaaaagcacauugagagguaacauuuuuuuuuuucaaauaauaguuguggcugugcguguguuuucucucgagggcauguugacggggacaggaggagcuauguauguaugugcguccugaugcuuugacacgauguuuugcagacggaaaaaugccgggguucauaaauauuaauaccgauuuuuggaggaagagucggcgcaguuauggaucaucugauuuuaggggaagcaggggucugcugcuguugccgcugguacuggggcugcugaggcugcaaagaggaggagguagagagggaggaggaggagguuagugaagguuuaauuucacuuuuggauuugcagaugagaagagguggcuccauggacacagaucugcucugugugauucugcgcuccaggugucguguguuguggguacagguccguuggaguccggccucauuuaaaauaaaauugguguguguguguguguguguguguuguauguguaugaguguuuacagacacugucgccaccagguccgaggaagggaaccggguucuucucggugcccagcggcccuucuuucccggcggucucugguguaaauagacuggcacccgcggucccuagaugcccgugcccgggcagugaccacuguaaacuugaaggcugcccuaaggcggucccaggaugcgcucgcccgcggggcuuggggucgggugaccggcgucuggugccaguggacacucgggccgggcgggcuccgcgcgcggcugggcgcgggccuggccggcgcgcccggcuuccuggggacugggccgccgccacacgccaggaacgucgcguccuccuccccgccggccagcgucuggccuggccuccgggcuuugucacugcacuugucccagcgcgugaggcgccucggaggcgcguccccggagggcuccgcgcucaggggucacccaccccggcgcggccuagcugcgagugccuccggguccccgcgggcgcccccggggccggccuggcgcgcugggccccgacccgccuuggcuacggaacgggcgaggugugggggcggggaaccuccggggaccgagcggcgcccggcgggcuagcaugggguugggggugaggcugacgaacgcuuggggucuccgggacguggugggaaugagugcccgcccugugcccuccgacccgcuccgggcgccgggugacauucgcccgccggccgaacaugguuggugcagagcggcagccaccacuuccucuccgccccgccggcccggcucucugggcgagcgaugcgggccgcggccaaucgcggugcccagcuagucccugucgcucggccuugggggccggcuccccugagcggcccgggaagccuucgcgagagcucagggccccggcuccccggacgcuguccgcugggccccggcucucggaccguuugccacccucagucccucgccccuuaggagcagggaagggaaggaggcuaguagccuccgccgcgagccaggacugugcucgggccccaggugagacgcccggaucagucgguggaggcgagauccuugguggucggauguaaauaagaccccugggauuggcaggccaccuugucacucguuugcgagcggguuugcagguccuuaagcccaguguguuugaaacuugggggacauguuucuuguccccuccucccucccgcgugggcacuccuuguccuuccuugguugugucuguaccagggaggcaaaguaguccugggguuagcuuucugccacucgccucccuguggcugggacuccgggcugcucuugaugaauggcuccugaggguggaggacaguuacauuuccuguugugcauuuucaggaaucacgggagcuugggagcuuguugucaugccugaagucauuuauuaguuuuguuuguugguuguuuuuguuuuuguuuuuguuuuuuuuuauaucgacugacugcaaguaacauuugaaguuagcagccugcacuuaaggugcuuaagggcaggugcagggacccguuuguuuagccuacuguuuuuagaaggugguugauugcaugguagacagaugcacacugcuugguuagggcagagcccuagagguugcccuguuuaacuuaaucacucgcccaagugcaggagucucugauuuuucucaacucucauucuuuuuuggggggugggguggcgugugucacaaaaauagaaaccaauaaaagcuuggcauuuggcuuuucuaaggcagcuucaagcaaauggaauauuucaggcuugaguuggcaucucuaagggguaacguuggagcaucuauugauugauggggcaaaguccggaacgucacugugauuggugaaugauuauaauuuauagccuagcuuguugcguaagaaguuagauuuugucuugugcuuagauccaagagaucuugccuguuaugauuuguuacugcuucuuaaaauuaaacacuuacauauuucauucucaaugaguggucuuuuuucccccccuugaccugcaaaaguuaggaagaguugcacguguuucagaaugacuuaaccuguaaaaauggcaucuucaugaaacaaaaaaagaggacuuguaaucaaauuggaagcaaauugaggcaaaagagaaauugacaugaaguccugaaggcucuaggaacuaugggcuccugaaauacuuuauuaaguaaauauuuaauauaccagagcgagugaaagcuguuuaaaucuaagaguggaagacuugaaacuuuggauagucccuugacgcacauugauuuccucacauauccaagugcaccacucuuuuaaucucagcuuuauucgguaaaaucuggauccucuuuuccagcuuuccccccaccccacccccuuuuuuaauggcaaauagacuacugaacuacaccgggaauuuuauugcagaucccuuaucugccuccugccaaacaggccuuagcgcaaucuggagaacuuauuuauauauuugacaaauauuugugggccaugaacuaccagacacaguggcaggcucugugaacccaacuagaaccgugaaggacagauagccucuucaaguucuacagaaguugcauucuagcugugagcugacaacaaccaaaaauaaauccaguaauuaccucuggggguuggucuaagaaagggaauaguguauucuacuuaccgggcugcuuugggggaacaauugugauacuguguguggaagaacauuguguaaauuauaguaacccacaaaugugucauguauugacuuucuaaguucuguuagauuacuguuaaagcgaauauuagagaggugagugucccgguacauacuuuuuaucccauugaggcugaggcaggaggauugugaguucaaguuuagauacaggcugagagcuugucuuuaaaauaaaagugaggaaucacaacaggacaggacagugccucugaggguacacaaaucauggcaaagaauuacacauuuggauaacuauuauauguaaaguaucaaaaauguuuagcagugaaauauuaugugaauuuuuuucucuuuuuuuuggccugcuaggagaacaguugacugguauccaugaagaccaaaugauguggggauaacugacuuggaugcauguuuuuccaauuuauuuauacauuaaauucuuuauuguaaugaacuuacccauaaagacaucauaaagguagagagaggcggccauucagacaaacacuugcccaauccccgucucugugauuucucugaaccucucugugguuggaaagggccccucugaaguccacaaacaucaccuggggggcuugcauuucguuaaucguuacauaguuacaccuaccacuaacauuaaaaccuagaaaaacauuagcuuuauguucuccuucaugccucaugguucccuuugcagucugucuuuccccaucaccuaauaguacucuuucuuggucucuuuucuaaauagcauaggacacccacacuuauagcuguguacauagggguguguguguauuauaggcuaggaccugaguaugagggacaauauguuuccccuuuuuauaaugcaacacacaggugucacuauucuuuggucugaauuuucuucaccgucgugucagacucauuaaguuauugcuguuauggguauggcuuaguucuauucugcaguccauugcgcugucauuaaagggacuuaguucuauucugcaguccauugcgcugucauuaaagggacuuaguucuauucugcaguccauugcgcugucauuaaagggacuugguugacuuggauucacugacgagugcgcaacacuaugugaguaaaauaauacgacauuauaagcgagaaugaacaucaauaguauagauuuguaauauaugauaugugaacaaauacauugcugugaaguaacaggaaguauuaacaguaaagccaaugcuauucauauguauggcacuccauacuccuuccuggacagggggagaggugagcaggacuuucuaccucugucugcccuacuccuguacugcucuuugguuugcauggauuaauauuuaguuaagaauaucagcuuaauguauaauggggcugaguugaguggggguguuagccaguggagauuguagcuaaggagguuugaucaagcuuugacuuagccccaaaggaauaauaaauuauguauagguaccagauuuaaacaugaagccauuauuuucaaauaaaaugccaaggaaaacaaugacccagaaaaaugcaagccccaggcagcuaccacccaaacuguggccauguggugaagauuucccaggcucugugugaauucagagcgagcaguaggccuaugauggcuagcccuugacugucagguagcccuuuaaguugauuuuacaccuuacaggauucaucuuaggacagucccugagacaaacuguucacguaggaagccuucaugugauuucuuuucaguacuuggauaccuguggcuuccagucagaacuccuggucaacuuguaaaaaaaugugauucgggggcuggcgagauggcucagugaguaagagcacugacugcucuucugaagguccugaguucaaaucccagcaaccacaugguggcucacaaccaucuguaauaggaucugaugcccucuucuggugugucugaagacagcuacaguauacuuauguauaauaauaaauaaauccuuuaaaaaaaaugugauucgcaucaaaucuaguaaaaucuaguaagccuuauucuacccaaacagagggaaacccauguguuggcgcucugggaagguccugacauacugggaccagcugaggccuucccucagaacuucgaguuccucuggggacccaggaauccuauaccauuacuugaagugaauaauaguuaaaugucgugauccacaaacauauucauuuaucaaggauuuguagacaacuagccauguacaggguuuuguauagagaaaggugaaugggcucagaagccuagaauucacuacauccaugcacaaaacacacacacacaaaacacacacacacacacacacacacacacacacacacacacacacacacacacacacacuugcacccacaagcacacauguauaugcccugaauugaacccauagccuggagugugcuaagcaagugcucuaccauucagcuauaccccgaaccuuggcauugacuuuuaucucuauuauucauucuuuacuaacuucccccuuuggaaccuuaauuccacaaacugugguuugauaguucugcaauccucaggggaccaggcuaguacauuugcuuauuauuaaaugaccaagggaaaggaacauuuagaaaccauucaggauucuuuagauuggagacuggcuccaguccauagcauuuauaguauauuacagaauauaguauaguauaguauaguauaguauaguauauuacaguauaguauauuacaguauaucaucuaucucuuccucucucacucaguaugagccucuuguccccuauggugugccgggcccaucauuccagucuuccuccauugugaggccagggcaaaaguacggaaccacucaguguucaagggucucuucccaggacuaauauggauaaccguggaugguuaagucuuggccuuggcuuagaggcuaugccaagcaaacagcaagcaaaagcugcuugcuucuacacaguccauacagcuuugaauaggacucaccuguuuugggguuguccuuauuggccugagcccucacaccccagaugauauucacaucauggcucucguacucugacuuuuccauuuccaggaagaccgcgcugcauggugcagccuucgugugcaggaaggccguagagagugcgggaggguuauuuuuccugacuuguuuuguuucuguucugguuuguauuuccuuccaucagcucuaauaagccagaaagaacuagaguugaacaaauagauguguggggacccauaagcucuuggggaugcuuccuuaaguguuuuguuuuaauucugagagaacaaccaauguagucgaacauagaucuuaauuuaagauuuugugugauaaaagucuguccaguuuucauuaaacgauuuucuuuuuuuugaauaauaaaauaccucccauguuacuuucuuaaauugauuuauuuucaaauguacuuaucaauauacugcuaucuuuguaccagcuuuggaugaaccuucacuuuaacuugcucuuggugagccuaugggucaauccaaagagauagaggaugcucuuuuggccugugagcuucacaucucugacucauuccacaucuuguuugguugauacuuugaacgagaaggcacugaauccaaauggccuuauuucagccgauaucagcuaugcguuuugauauuguuuucccuacccuagauuuacuggagacgagaaaagcuaugggaagagaguguccugauaccuaaggaggguguugguagggcgguggguagaaaaguggccaagggggaauuggagagagaauaacgagaaagcuagaugguggguucuugguacuggaagagagggaaggggcaguuaggcaggcagagacucuguuacugccacagcuggcauggaugguuaauauugauuuuuauuucauguguacgaguguuuugccugaauguaugucuguguaccauuugcagaccugguucuuuuagaggccaggcaaggguggcagauucccuggagcuggaguuacagauggccgugcgucucuguguggauucugcgaacagaaccuggugacucuggaaagcaucaagcacucuuaaccacugagccaucucuucagcuccaaguuugaaaaaaacauuuuuuuuuaacauuuuaagcguuauaugccacuaaguuaaauuccaggaaauuccuuacauuacaaaucuucagcuacaggauggaguuaaggaaggaaaggggaacaaguacuuagucaagggucaauugagaugcugaagaguuucugccguugccuuugggguuaaaccuuuuaaccccguggaagauggauugugacaggaaacugcagggcaggagcuuacaggggacuugcuggacuuacaggagacugucaccugggcaugguuggggucaccuugaagguauugauguugaaguauugggaacugaaggacugagacccacacucuaagccccccaaucuuucucuaaaaaauaacccaaaacaaaacaaaacacccccaaaccuccccacaggcaauacaaugaaucaaagacacuauggcagcucucauaggcccgccuccucucacccaugcuuuucuuugauuggauguuacucuugucagaucacaaaugguauaaaggaaagcaggaaauauagaaugggcaguaguguguucucuucaagaauaggugaugguugaacugugagcacugugaccacaggucacccacuguugggaaacuguggggaccauaauguagcugaggcuuuacacagaggaauuuucuggaauucaacuuggcgguauaugcuuacaguguuaaaugcugaauuuaacaugcuugaacauuuaacauacuacaguggugcaugcuugccacccuaacacaccagggagacugaagcaggaggauuguuacaaaguugagguugucuugggguuacacagugagugugaggcuaauuuggauacacagugagacuuuguuucaaaacaaaccucaaccaaacaagaguuaaacuuucuguucuaguaauggugcuucuaggaaccuacuuccuggaggugacuggaggcuagaacaaagguuuauguauuaggguguuuauagaaucagcuuuuacuauauaggucuugaaauaucuaacaagaaaagcauauguaaauuaugucauagcugaaagauagguagucuuuaaaauucauaauuuugaauggcauuuaaagaggagaaauauuuaacccaugcuaguuggcugggagaaaaggauauuagauuguaugccacacaauuuuaaaaaaccguauguauuuuguugauguaaugcuaaaacauggugaaagaaaagaguuugaugguaggauuauauuugauuuuuuuaggcaccccuugagacaccgcacuuuucuaaauuugaaucaaauuuggaucauagucacugucauaccuaacgaagaguucucaaggcaauacucagguguccccacugguucccucuagcaaauggggacaagaaaaaggaaauuggcccgggcaguggcgcacaucuuuaaucccagcacucuggaggcugagucaggcagaucuuugugggcucaaggcuagcuuggucuacagagcgaauuccaggacagcuggggauauaagaagaagccuugccucaaaccaaacucccacaauaaacaaacaaacaaacaaaaggagauugaacguugcugaggaugcuaccuguagacuaagcuuuucuucugcucacugugcucccuugugcagauuccaggucuagaacuguggccucuucuagccaaggcugaaagacaccauugccucacuaugcuaagaacuaguaauggucuaagauguuaccccauuugacaguucugccuuuuaugauuguaaauacgacagaaaugcacgacaucugagcaggagacaagagcuacugauauuugcaagcaagcaaacaagaggaucaugcagugaugguccacgcaccuagauccuggugggucaugguuggggcauuucacuguguggcggaacugucccucuccccuuccuauaggaucaggguucuucugacauacacaaccauuaacaucuucuguggacuguucccuauccugucugcaguagaaaugcuuggguagauagggcucuucuuagcuuuagcaaccugggacaauaaucaagcaagggauuuggacugggugguauuguuugacccuguugaggagacgaguuuuuuuuuuuccuaucagauaagagcaguuaauuuagacaaauggccacagaucuaauucucaggguguaugcaaaguaagaggccuggcgaagcaucccuuccccuuugcauccuauaccuuccccguugacuucauguccuuugucccaggagggcagauauuccccccauacccacuuugcagaucucuucauagacaaucacuuaggaagccgcagucacacugugaugucugauuuuuugcaguggaagacgacucuacgugccuauuuuuuuuuaaucuaaugaacuauuagaacaguuucacuccuauuaugaauacaaacuuauuuuaucauugugauaaaacuaagguuggguguaucaacuacuagcccagaggcagaaggaugaaaccagagagaggcaggauuaaugaagaggacagucuccaguacaaaauacagcaugagccacuugcuuauuucuuauuuucuuuuaguaucuauauuagaaaaguaaaaggaagaggugacauuaauaaugaacguuguuuaacccauuacuucccagauauuauuauuucaauauaaucagugcaaaaacaacguuauuuugcauuccccuuuaaagcccaguauguugcuuuuuaagcugcagcuugucuuaauucaaccuaucuacauucugcgggcucagcagauacaggugcuagcagcuaaccauuagaugguccagcagaugggagaugcacagcggggagcuggcgagaugcucgguugcuauaguaccuguugcacaagccugaggaccagaggcugauccccaggacccauguaaaagccaggccugguaauccacauuuguaaucccagcacucaggagguggagacaggaggaugccugucagugacaagccuuuuaucaaaacaaagguagucuguaccuaaggagagauauuguaguuauccccugauacccuaauacauacacaacacacacacacacacacacacacacacacacacacacacacacaaagagagagagagagaaacagagacagagacagagcgagggagcgcauaagugcccuggggacaguuuuaauacaaggaauggaguuuaaaaagaccgaagggaggcaggugaagucuuuuguuuucgucagaaccucauggcucuccuuugcccucucaucauaagcuuuacuugauuuuuuuuuccccagccaaaaucaauaaauaucccgagugcccacaaaagcagcgcauagcacguacuguucccauggccacgagcuguguguacaccugagugucugugggccucucggugugcugugaaaggcucugguuauuuggacuuuuuuuuuuauuucccucuccucugugauauguuauuugagagugucacguguuucuuugcauuccucaaggacacuugauacgcaguaagaacuagauaaauauuuguugcucugauuuucuguuuaaggcaaaaguuagcucagaaagcugagcuccaacuuggaagggaugguacaggucugcuuuguguuagaaaccuauugguacauguaucuugcgcauaggcauggagucucgucacuuagcaaggagacuugucacuaugcagacgaggugcaacacucagaaggugaaaaauuguucagcuuuucccuuucauaccaagacauuugaaagagccugauauuucauucccaacagugauauuuacaccuuuuuaugaauauaaaucuaguuggugauaaacuggagacaagcuuccgagaauuacuguuuucuguauggauuaaaguagugaugccuuuguuaaugcuaccaacacagacucccagcccuuaaccugugcaguggaacuccucugaaaucaaaugcaguguuuuauagcugccuccauuuguuccccuugacuuuaauugucgggcugaagcaccaggccuguucacagagcuaaggcaauuuauuuuuacugaagccaaccuaagaaaugcuuagguagcuugucgcugcaagauuaaaugugaccuucauggaaucguguuagcagggccagcagcuagaaaaauaaagacuaaaccaaacuguucagcaacagaauucccagcuguucagugggguagaacuuuccugguuaucccuuccaauaaaaacacagcagguuaguuuuaagugaagucuuuagggauuugcaaccgacagaagaacagaaaaauauaaucucguuuuaaaaugauaaucuggaaggcuagucuauauaaugagucuuucuuggggggaggggcuugguguuuuccucauaugggagaauuuaacucucaugcauaguuggucucaccuuucaaguuaaggacuucuuaauaaggaaagaaaagcuguaauggagaagucaggcuugaggcuguugucgcaacagcaggcgucuagggauguggggcacauugguaccuggcgccauauuugacacuccccuuucuucucuccacuauagaaggaaggcagacgcuugaaaacccauaagggaggcccaaggggacuguagauggacugguucuuaccaugagauaugucgcacugauggugcgugcauucagagucauuagaaaacauaggagagaaauugcuagggacagggggcuuuaggguauccaaaauauugauuacugauugauuguauauuucuugaguagcaguacagcuacaguuugguaggugagaucaaggaagguacucggcacaaaggauugacuguuuugaucaugucuugggucauuuacuuggggguuauguggugaaaacugaagagggggcagguuuucuuagcuagguauucuccacaccaaggagccucgguuauuuacagcgggaucaaacagcuaggcaacuaaagaaagagaaugguuuuagcagccacuagagguugucugugaguccaagggccaguucacaguucucucaucuugucuguuuggauguuacugguguuugcccgugacacuucacauauguaccugcagccuauagagcuccuguugggggccugauuccauugagggaaacugaugugacucaggcagauggcugucuccacuugauacuucccuuuccccagaugcagucacugguccugaauaagugcugccccacucucucccuggaggcuugggcugagagaaccugcaucauggagugauuuguagggcuuucuucucaccuggccugagaggacaucaccaugaaggaaaaauuggcuuucaguuaauagaaaaaaugucuacucucucccccucccccuucuccccaucccucucccacucucuccccucccacucccccucucccucucuccucuccccucuuuccuuuucucuucuucucucccucucucuuucucuuucucuguguaugucuauagugaauacuucaagucacauguguuaaaaauaguuacuauucaucagaaagacugaagaaaacagaggcaaagaguggcaaacuuauaaauaaaugcacuccuugucucucgcucuuucuuuucuguugcaaauuuuaagucauagaauuugccuuuccagucaucuuuaaguggagcccucaccacuuaaccauuuccugaauuaaaaaaaaagucucaccagaaacucgauucauauuuaaaagucacuucguuuuucucggucccuggaaaccaccguucucccuucucagggagcauggcucucggugucaguagaagcaucucacguuugccauucugucugacacaugucacccgguggcauguuuucuuuggucagccuugcuauggcaugugucagaaucuagcuccacuuucgaaugaaagauguucacgcguauuuuguuaauccguucaucugucgguggacacuggggcugcuauuaucuuugggcucucaugagcaaugcagcuuugaauacugcuguaaaaaaaauauaucgauuugagguauuuuuuccugggcuccucuccauuucucugcuccacuaagccccuguggguaucucucuacuaagaugcuugcuccucuuccuguguuagagccuuucaaaaggcucucccaggccaccucuucagcugguuccuccuguaccugcucuaacuacuuaucccccaucaccuacuggguaagcugcaugugaaaagggggugccucuccucuaccauuugggacaugucucucccucaagucucucagucugcuuggggaaggcccagauugaacuucuugucauuacaacuuuuacccccucugcuacuuccaggagccuucuuuacccccacccccgucacggagcuauggagcugaggggcuguggucccacaucuuccuuaagcccuucugggccucugugauauuggaguccucccucggauggagcuccugucuugacccugucccuugcgucucucagcucccuccucccgcugcuucugugugcccuccugggccuguagcuuucuuacaaccucccaggcccuguauggccauuucucuuuuccuccuuggacccagagauuuuguuaaaaccucccuaucuuaccccaaauggccuagccucaguacaguacaguucaaucaaugagcaaaaauuaacacucuugauuuucagagcaucuggugacaacuccugccacugcacaagcaaauggccccccaaaucucuuauaucuaaacuuguucuacauuuucaagucucuuaccucucaaguuuuccuauguuucugcuuuuaauaaucucuuaucucuaugauuucuuugaucucagguccccaaaucaucuuuuaggacuguccuguaaacugucuuaagauuuguaaguucauugcacaugauuuaaaaaucuguaacaaaauuuagcugaagauuuauaacaaaggguuuaaaagucuaugcaaaaggaaucuuaauuugcucuaacuuacucugucugagauucaacuuuuaggauauaucuuaggauauauugcauauaaaacuuggauucaacucuuguuuaaaaaauagaucuacuaggaaaauagauguuuuuaaauagcaaccauguggcucaccuccaucuuggucgaugaccucaucgggagggaagcuaccaugugccuggcaggaaucuuuacuaaauuuaagagagugugugcaauguaacuuuaccaccgccaccauuaagaugaccgugugguauaacccaacuaaggcaacacucauaaaacuucacugcccuaaugagauuucugcuuaucacugaaucuccuucagacuaaggaggcaccggcaggucuccaaaaaaaaaaaaaaaaaaucuuggaaugggauggauuucuguauuaugauaaauccccaagguuauaaagauuuucuuagagauaugugccuagccauucaugcuuuuaaucacuauucuauaccaggauucuauaaaacuuuagauaaggaaaagagguuuuguugaauaaaguaugcuuuauucuaagguuauaaagguauauucauguuagcagaaacugacuuagaggugucuguugaucuacaccagacuucuaaaacauguagguaaagaacaauccauguuugauaaauaagguuuaugaauucugaaagucuacucggaguaaugguaauugucuuaaaggucuaugucuagccucugucuuugcuaacucuguuaagcuuuagauauuuggauaaacugaauuauaccagaaacuaugguacuuuguaauggugugcuaugaaagagucaaguaaaguaaggugugcagucucuuugugaacuuuauuuuuggucuaagaaagcucccaguuucccugugaacugaagucauggacuuauuuugaugcuaaaggaucuucaauuaaaucuucaacucaaauuuuaaggcucagacuuaacagggauaaagcuuuaaaguacuaauuuuauaaaagcgacuaacuuguuguaaaagcuuaaagauaauuaagauaugcaagucggugcucaccuuauaaauguuccaguugacauucacaccugcagucaugcugaguccaaauggcauucauuuacagucacaagcuuucuuuagcuucuucuuuagguuugcaaggcuaagccuaaaacaaguaacuaaagaugaaguuuguuuaaaaucagcuagacuuaauagauaacagucuucaaacucuucagagaucucccgaaaauggcauuucaaauguuuaauguaaaaaacuucccaugauugauagacagaaaggccagcgcuuagugucaguucuagggucuccaaagaugauggggugcagucaacucuacuuggguuguggucacaucagccacugcuucaugucucacccgcugccaggguccugcccaaccuguggacccuguugcguugacugcucuguuuugccucaucaauauaggucacuguuuucaaguuccuuuuccacaggaaaaucucugaccuucuggguuuggcagcagcaggccugugcuguccuguguggcagcuguagaccaaccccugccacccuccuccacccucaaccccagaaaaaacaaaaaaagcaaaacaaaaaccaaacaaaccaaaaaaccaaaaccaaaaccaaaaccaucugggaggcuaggguagcuagcugguaagucucugucauuuuaauugauacauagaucauuuggauuauacuuccugcuacaguuuauccgucucagaucucugaugguguugacggcucacuagcuacaucaguuuaacagcaucaaagcaagacaacuccucccacuaaggcugcugcaguugcccggacuguucauuucauauuaccucaggucucacuuuccuagagggucuaggucuccugcugaaaaagacaggcaccgagacaguuuaccuugcuggaagccuucccacagauaaagguaaacucacaaagcagguuucaauguaacguuuuacuguuucuuuauuuaaaaaggcacuugcuuugccauggcugcuccugguaaucaaucgccggugccucaugguaaaucaaagucuuauugguguuacucaccacaguauucacucgcaggggcaugggguauucaaaggcaggcacugaagucccauccuagccugggaaugacucuugggaguggaaccucggaguucccagcaucuauacugcaguaccauacuguacccuauccuauagcugguguacuccaggcagaauucccucagcuguccuuacuguuguagggaggaaggggucuugugaauccguuacauuuccgggacuuccugagacccgggaguuguuuaauauccccagucuuuuggagcgucuccauagagcaggauguuucacuucagaugugcucuuuauacaguaggcccagcaucugcaugcugucucagagggaaguccgugagcucagccuuaggaccguccucuuuguaaugguucaguacuauacuauguggacagaaaaaauguauugcuguaauaacagaucucuuaaguaaaucgagacaauugaauguuugucaugaaucaucaauaggccguggaaccucuuguuucugagacaggguuuuaggaugaaguugagauccaucucaaaguugugaucuuacugccucggccuccuuguccaagugugugcugccgagcacagccccggaaugagggacaucuuacugauucuuacaagagcuauaguggaugaagacgugucacaguaaauucauuguuaguugagauuuaugcucaaauuuuuacuucauucuuuuuggaaaauugacuuuauucaacgacacagccuggcaaguuaaugcagaugauuuacaguggacuguaaauaugggaacgaugcauaagauugcaucuaauacaaggugggguaguagaagucucagaacuucugauuacuccauccccccccuuuuaaggacauuaauuuauuuuuauucaugagccugcauguaugucucuguguacuaagugcauugcaugcccaugcaggucagagugggcaucagaucuccaggaaguggaguuauagaugguugugggcuacagugugggcgcuaggaaccaaacuagggcccucugcaaaagcagccggugcucugaauagcuauuucuucagcccuggggaaaaaaccucuccucgccccccaagauccccuaaaauuaacuguaaguacugugcaaaugaacaugacagggaagaaauuaagcugaagauggcucugcaaacaaguuuaaagaaaacucucucucuggaguuaauuccuucagcagaugcuugcgagcagcugugugugaaacacuguacugggaagauguaaaacugaaaaaucccaagcggugcucuccaagaucuuaucguuuagugauggaggaagcaggcgacauaacugucugcggugacaaagaaaagaaugaagacguaugagcaucagagaagcauaacaaguaugaaacuacucaaauaaagaaaauaucuaauaaaauaaaauaaaaaucaauaaaaagaagagaaacuacucacgggacgagggaggaggugacaccauggagugggcuuuauucacagcuucuggaaggagagagagagacagugucaggcaauugugguuggaagaacagaagagaaaaggaagacagggaaggcuguaaauuccucaugaagcuggagccuggagagcugucccgaguagcugagcagaugagucggcaggggcuaucacagucucuaccugacagcacauacgugugagugaugccaugccagcacauacaugugagugaugccaugccagcacauaugugugagugaugccaugccagcacauacgugugugugaugccaugccagcacauaugugugugugaugccaugccagcacauacgugugagugaugccaugccagcacauacgugugagugaugccaugccagcacauacgugagagugaugccaugcuagcaauacaugugccagcacauaugugugagugaugccaugccagcacauacuugagaaugaugguaugcuuuccacuuccccaguuaggaaaggucuuaccuggguuagaacaaaguuuuucuuuucuccuccuccucccccucccccucccccucccccugccacucccccucccccuccucuuuucucucucccucucccucucccucucccucucccucucccucucccucucccucucccucucccucucccucucccucucccucucccucucccucucccucucccucucccuccccuucucccucucccucucccucucucucccccccuccucucucauauuaccaaggcuuuggaauauguuucucuuuuauguuucaggagauaaugacuguugcugagucaucagagcucugcaccugggaugugugagaaucgauaaaaggguguguuuguucauaggccauggacuugacaggcagugaaagaggacuagauccuggccguguuaauaacaaggcucauccuuuagacugacucccccucccuucuuccuuucuucccucccccucucccuccuucccauaauguuggggauaaaaccccagagguucuguauaugcauggcaaguaccuuuccugaagaacaccuuagcuugacugcuuuguuuguuucuaaggggggaguaauacaaagauggagaauauuucuugugcucucuuugguuuugaauggauucauuaugaagugaagugauucugagucgguuuauaauacuccacgugaagaacagguuaggguagucucucaaguuugaguaagauuaaggagggugaagaacggcagugaaggccuuagcagggugggacauguguagggauggggcuuucuucacuugggggagucacuuggccuuuccuccuagcaguugcucugccuccuccccaagacuacaccaugcuaggccauagaauggcaggcagcacaccucagguggaagacuggaggcagcuccuuguguuggcuguugugugguugagacuucuuccugugcacuacugcuguguucccuuggcugugguggucagagcacccagcuugaugggcugcaacgagggcauuuaucagguauuugcugaacucuucgcgguagccauaagaugugaagauccaacuuagagaccuuaccuguuuccggggcuuauuucaauuuauuucaugcagcacugaauuauaaauaacugccuuuugaaaccaguuaugcauucuggagggcagugaagugcuuuucacagggcagagugaaguggcuugccuagacacauuccauaaacgugggucgaguuuaaccguaugguugaucugucuuucucauuaccuguccauuauagguagggauaauagaggccauguccugugcuuccuggaaagagacagagcagacaguggcuaggacagcaugacagucacgucuguacaugcucuggcagaguuggcagucuccuucacccagcucacaaggaccccuagaaggcacaaggaucacaugcucucuugaguagccacgcccacccaaggcuugcagccauuuccccaacaucugucuguugcccaguggcaauacaucucuuauuaaggaugguucaaaugcacccguauggcuccuuacucuugucuuucucccuucuuaucuuuuuuucuggauuauuuuuuuuucuuuuccacccaaggaucaucuauuuuucaggcuuaguucaaaugacuccucuucuuugaaaucuucuuggggaccuucauuucuucugagcuuugauguaagaagguagagcucucucaacccaguuaccaggccauccaccuauggacaacacaggguggcagucuugggagaugccugugcaauguugggggugagugugacauggagguugaacuggacuguuguguuggaugcccacauugggaaugcgauauagcaggagaggucucagugcuacuccagcauccccaguaggcuucucuaguagugccuuuagcacaucaugacuugucuuugcuuagcucuuucacuguaccuccuuugggcaccacgucugagccaucuuggggucuuugcucuuccucaugcuugaacuuacucuucauggugcaugagucaaugaagguuguuuuguuguuguuguuguuuuuaaaugaaauggguucccuggguaaggugggaauaguagauugguucacuuuuuagccuuuauaguuuuuuuucaaucguuuuuuuccuuaucacccauccgugguaaacuuaucacagcacagaguuaauauguucaugcgccuuccccucccugcuccaucuguucuccaaaagggauucaucuacuuccuuauugauuacuaauuaauagauaucguuauacacagcguguuagggaagacacuugccacuaaggacuuugcacagugauaagcgugccuucaaguccaugguguggguguugguguuguuaggugggaggggucagaggaagaaaggguugggaagguggaauggagguggauuacaguggccggggugagacucuuaguccacauuguggaacuagucaaauguccugaccaaggagguguuggggacaucuaucuggccaucccuguucagggcaggggauagacuucuguuccacguaugccuccgggcucucuguggggagucugcauuugucuucucucauuagguagagcucacccuguccuuugaugucucuuuggagaaggagaucaaugcagucucagaggaguucugcaggauucgauugagauuuugguugaugggugaggacgguagacaugcuuacaggcucuacgugggcaacauucaaaucuaggugugcuugacacccaaccugagcuauuucuaccguguuagguuuuaguaagguaaaagaaggaaagugcuguggguuuaaagaccguugaagcuuuacuuacuuaucgugggcacgcuccacacugcaugugcagaggucaaaggacagcuugcgagagccaaaucucuccuuccgcuaucuggguuucagggacugaccuggggucgucaggcuuggcaccacaaagugccuuccaccgaggcaucuugcuggccucauugagguuuugaaaggaguuugcuucagaggagaauuuggcaacuaugcagugcacaccaguuucaacuuuuggcaacugucuggaaauugagaggcagugaguaucguuuaaaaguaugcuaaggcacuccuccugcuaacagggagagacguggcccuuugucaagagagauucuuguaccuagaagagggagccauguuacuucuuugcuguuggauuucauuggugauaaugaugguuucucucaagaauagacuaaaggcucugaaaacucagugccuaaguuuauaguucacauuuguaucuuggaaccaagcuuuaucugaauguaaggcacuguguuagagaugauggugaugacgaugaugacgaugaugaugaugacgacgaugaugaugaaauuaacaacacuaagcgggugcccuuuauugagugauuacuaggacaacuggauuuuggcaagaaggagguggucaugaacuugggugcaaauugaagaaggguaucauuuauucucacagagagggcagugcagcagccuuuccuacagcagguguuuuucugugucugagaagccauuuguuuucacugcauucugugagcaauaggcaugaaacaagagcagugaacaaauugaagcuuuuugcaaaguuuugguagguuucaauggcugcucuaaguauccuguuccuuggcuuuucucaccaauguacugaacauauuagugucgaagauugcuccccucaaaauauacccuccucccucuuuauuucuuucuaaugugggcagguguuuggccugccugcaugucucugcaccacaugcaagccuagugccagagaagguuagaaggguguguugcauccucuggcacuggaauuacaagugguggugaguagccaaguggguucugggaauugaaccugggcccuuugcaagagcagacagugcucuuaacagcugagccaucucucuagccccuguuagucuuguuuuaucuuuaugaucccaggaacugaaaccaaggccuuacgaugcuaagcaauuguucuacaccgagcuauagcuggaucccugaacagaccuuuuuuauaggucuguuaaaguaaagaaggacaugcauccaugaacgucucagaucaucuagauucugccuauauacugcuauccugccuuucucagcuucugagacaugucugcccauccuccuuguguagccccacccuuuucuuuaaaaccacaucucugaggacuagcacccccccuuccuuccuuauuucuauuuuauauguacagguguuuuguaugcaugugugucuuuguacaacgcgcaugccuaggaaagaaggccaaagaguguuccagaucuccuagagcugggguuacagauggcucugagcugcuaccuggaugucgagaacaggaccugggucuucuggaugagcagucauugcuuuugacuucugagccaucuguccaggcccguuauguuccaucuuaauuuauuuuucccauauauaaccugcccaugacuuauaaugguuugguuuuugguuuguugacuuaaaagugauauucaucaguauauuuucucaugguguuaggcagugcagcuagccucagcuccuauuuagcuagcuacaggaccacaagaaggucuaccagcaugcugcaguaugcuguguggcugaaacucuguuggggagguuagcauuacgcucuguggcugaacuguggugcauaaauuagguguaacaauagagcacuuuaaacuugaccagaacucuuuggggugcagccucccugagagcugaagagcaucuugcuauuuuucgggugugcaugaagacaaagcagucguaucugagcuggccgaugccagaacaccuucaucucagagaggacaagggauguguugagugguccuccgcucaacuccuagaacaagaagcugugguucagaccuuguuuucguucuccuguucugugagacucggaguguucagaggagaugcugauucugggaaaaaagggaucccguucgccucauuuuccacguagagagaagacucgagaaggcagcaugagcuggaauccauauguuuggaaaucuggcuguggcaauugcuuugcugaauugcccaaacuguugucaucuagugcuggcucuggggccaugcacauguaguucccccagcaugguuucaacuuuccucaaagccaggcuagaauuguucuagaaaacgauuauucuaaaaacugauggaauaaaauaaauauguuauaauuuaguuguaucuggacaauaauuuauuuguccaaccccacacaguuuuuaaaaaaaucuuuuuagguuugcaaaauuauuacauuuguagcugcaacaaauucaaugauaagcauaguuuuuuuuuuuuaaagaaaacagguuucacacaugacuaaaugacuugagaaacauuccuggaaucacaucgcugagauucauuuaaaaauuuugaugcuuauugcuaagcuucuaucaggaaaauuugaaccuauuuauaguccauagugcaugcgaaauauaaaguauucuaauauuuuucuuugugugugugugugugugugugugugugugugugugugugguguguagacuggaggacaaccuugaaugucauuguucaggugcccuucaacauaauuacaaagacuuguuuauuuuuauuuuaugucuaugaguguuuaacugugugcaugcgugugaaccaugugugcacagugcccauggagaucagagauggcaccagaugcccuagaauuagaguuauagacaguugugacuugccauguguguucuagggaacaaaucugaguucagagguguccuuaaucuuggagucauuaguccagaagagaggcuucccugguugggaaaggauuuggauuuugaaucagggucucuccuuggcuggcucuuucauuaggcuagacuggcuggccagcaagcccuaaguauccucuugugugccuucuaaugcacacaaauagugcacacgugcgcgcgcacacacacacacacacaauacacacacucauaaaaauacaucccaaacaaaacaaaguaagccaaagccaaagccaaaaccaaaaccaaaaaaaaaaaaaaaaaaaaaaaaagaaaguaauccaacaaaccucugguuguagggaaauuguaacuuggagagcaagucccuggucagugucucaaccuucccucuuuucugcuggccacuaggccacgaaaggcaagggacagugcuauggcuuccuuccaggucuugucuuccugccuguuuugccacaaaagcucaaguggacaggaugcguguugggucccgcugagcucaccucuuggcucccuguguucucuagauggacgaugcagagggcacagugggauuucaggcuuuaaagcccaacucccuuugcugcuggauuucuugugauggauugcaaaaaaacaaauuguuuuuaucugcccaauucuggaguuauguaagguuacaggacuuccucuuuuaggaaaagucccagacaguucgcuuaucuucuuguuccaucuguguuuguggguauuguagcuuucauuguccuuccuucaaucuaaacagaguuaaauguguuggacccaaugaguacuguggccuuaugcguuccugugugauccauaagcuugggaagaugacacauuucagguuccagacccugggagacucuugccagagcgagagcauggccagauagauacuccaucucccagccuuuguguucgaggguccaaaggcacauggagcgaaaacuugucccguggggauuuccuauuagcaacguuaccucugaggcugaagauccgcuuugguuacccagcgccugugcuuauggaacuugguguccaugcagugggugaaacauagacugagacacagucagaaccuucugggaagaaagguggcaaugguagcgaccucacagggugacaucagugagaagccaugaugaauugaauggcagauaugcagugccuggccauugcuguugugaucguccccuaccccagggucaccugaggaauauagaaagcauguuuuugaggaaagcuuuauauaauauaauauguaauauauaacauuauauaauauauaacauaauauauaauauauauacacacguauacauauauacgcauauauauauguauuuguguguauauauauacauauacauaaauauacacacauauauacauauauacacauauauguauguguguguguauauauacauauacauacauauauacacauacacacacacacacacacacacacacacacacauauauauauauauauauauauauauauauauaugcaguucaguucaggcauagcuagcuuaagcacuugagcccuuucaggagucuugagggcuuuccccuugacucucugguguuacuguucuucucccaccccgugcgguguguguucagggaggccacagaacguaagugcuugcaugggucccauucauuccacagugcugugauauccuucuuuccaucagaacugaaugauaaaagccauguguccagaaagcucuccaggcuucuaaagaaaugcuuuacggcuuacucauccugcuacccauguuuaguuuuagcgucacuccacggcacuugcaugguggugagacuuaccccaguagaagcaucgauuccaguuuccagacgugauauagaucuccuccaaauguauacagaaacaaauaauaaaccccaucuaguuugucacacauagcacccaacuauauuauagauugccuuuaugauaacuuuuggaauaaaacauuuacguuuacuuguuuguuugccuggugugugugugugugugugugaguguggcugugucuggugcuuugaguaaguauggccuccacagacucaugugugugaaugcuuggcccauggggaguggcacuauuaggagguguggauuuguuggaguauguguggccuuauuagaggaagugugucacugugggggcaggcuuugaagucucuuuuacuuuaagcuccgcccaauguggaauucagucuccuccuggcuuucuuugcaucaagauguagaacucucagcuccuccagugccaugucugccugaacacugccaugcuuccugccuugaggauaaugaacuaaacuucugaacuguaagccagcccccaauuaaaugcuaguuuuauaagaguugcuguggucacagugucucuucacagcaauaaaacccuaacuaacgcccugugcuauggugugaguguggagaucagagcaugacuuuccggaguuuauucuuucuuucacaauguggguuauaggaauuaaacuugggucguuagccuuggcagcaagugccuuugcuugcugagccaucuugcuggccccaaauaaguauuaaagcuccuaggagaaccaacaagggcacaacaaauggcacuauaaaaaagcguuagggcauuuugacucuuguugaauuauuuugcagaugaacauuucaugacguagacuagaagguacuuugaaucacauggcuagguaaaccugauucaaaggcagugaucauuuaggugaucacauacgauucaaauuuuguaaaaacauucaggaaacauauuuuccuacuuucuaauagggacagaguuugcauuaaguucuugcauauuagaacuagagauugcugcuacucacuaaauuaagccuaaucuauuuguacacacacacacacacacacacacacacacacacacauuuguaaugugaguacaguuuaacaaccaggaugcccauuugccugcacagcagggaaacaucaauauauuccaaggauggaaauaacuugagagauccacugaccuuauuuguaauucaaaggguacagaauccuggaaguuacuaucgcaagucuucuggcaguacagcuugccugaaucgauauaaagcuauccguagcuuucuuuggcccuagucaguucagacgucuaauuuugcugcagaauauuauuguacuggauugugaggacccuguccuagacacaguguguguguguguguguauguguguggggguguccauaugggaugugugccuuaucaucuuucuaaauccaaacuauggaauccugaaacauuccuagcccaaagaucuugaaugaaagcuuguuccagcgcagugguuuuuacagccagaggauccuccuauucuggcuuuccaagaacggccccacuuuuucuuuccuuagacaaaaucucaccuaugugacacaggcugaccucauuuuugauucucuugaggaaagucccucuuaauaucuguuuccaggauagccacugaccuguaccaucagagccugauccguacucaaaacugucccaucuuggccaauaaaucacacggucaccaugcugaccaucacaaacuguugguuauaggcaccgcuagagagaaugauuaaguucuuggugaauuccuauauauggaauuuaaaacaggcaauauccugauaucuuguaaguaauauaacauuauuuauaagaaguaauuaaaaaauauauucccuacugccuucuucagcagaauuuucuauagcacauauagguaauagagaaaagauauuuuauugccuaugaauuucucuuuguucaccauggugcuugauguucaagacacacccacuggggguacuuugcaauuguggauaguaauauauguguguguguguguguguguguguguauguauauuauguguauauauauauauauauauauauauauauauauauauaauauguauaauauaaauguaaguuuuuccuaugcaugcaucccucugaaguuuaauuaugaguuaggcauaguaggauacuagaggauauuaugagcuaauauuaagugccagagagaugacucagaaguuaagagugcuugcugaucuuccagaagacccuagcuugguuccaacaucuuauagccauccacagccccaauuucagaggaucugaugcccuuuucuggcuuuugcuaguuaccugcacauauccccccucccacaucccaacacacacacacacacacacacacacacacacacacacacacacacacaaauaaacaauaaaaaacccaacaucaauaauaaaauagaacaauucuaacaauauagcauaaguuacuuuacauguaugaauuguuugucucuggaacuuccauuuaauauuuucagacagugugugaccuucaguaauuaaaaccacggaaacaauggauaagggagaaaacuguaauaaguuacauguuauuuauuuaaaaaauauugauuaaccuuuggcuuuugccacaggcuaugaccguugaagcacauagauuugugggggcuuuccuuggggagacugagaaaucuugcugagggaguaauuuugaagcuaaaucagaaaacucaguaagccaauguauuagucacuuuuuuacuagacacuauguugcucuagcuggccuggaacuaauuuuguagaccaggcugaccuugaacucacaaagauccacuugccucugucugagggguuagaggcaugccccaccacaccuggucuuaguuacuuuuuuguguuguuguugugaccaaaucccuggcaagaaucaagggaagaaagauuuguuuugacagacauuuggauacaaugucguauggauacacugaauuuagauacaauggauucuucauugaggccaaagggcaucgugguggaaaugacuguggcaacaauaggaguaagaggcugcucauucacaucuggaugcaucagcaagcauugaggggucaggcggcaaggcuggccuagaaaccccaaggucugcagauagcugacuuccuccugcuaagugcucccuccuaagcauuccaaagagcaaucuucuaagccucccaaaacugcccagggaacugguaacuaagugcucacauacaggagcuaguagcggagggcggagggcgcuuucucagacaguagcagcaaguggaagagcacauacaugaggcugagcgacaacagcuauugaagccuuggcguagacacucccugcccccgcccaagcaguuuggggugcaaagacagcacaggggcuggaagucaguuacugugacaucaguggguuuucagcagacggacagaaucuuaacugguguuuuuagagagaguguucuggcugcucugcccgggcaggcuugugggagguggagggcagucgggauggcugcuugguccagucuuuguagaaggaagcaauuguucuugagccacuggcuucacuuuccaugggcacagagucuuagcuguuccucccuggacaaugguuauauguacucugcuugguucucugaggucagugcagugagugcaguuuccagccuggcuggaacaaguaggacugaagguucauucagacuuccuucugcaaaugaggaaaaguugcaaaugagaaacagagcgcagcccuuccucagggugggccaucguggagccaaguacccgaaaggcugugggagugaggauuucaaucaugcucuaaaugaacggauacugggaaggacaauuuuaggggcugguggaaaauagagagcuuuugggcaauuggcuacuggggcucagugugugugugcuucuaagauccacaaccugugaugccugcccagcaaaagauggccgagauguuuuucuuuguuaccagauuaaccuauaugaagccacccagugcuucugugaaaucaaugguguuuuaaaauguuaaaagccgcccuuuuucuuuauuuuaguauaggaagcuggcuggagguacgucuuggaugucuacauuugagagacuucucuaagcaagcaggccaccucuucagucaucuuuuuaauuucccuugcaccguaacaguuuuaagugacugaugaagggggacugcccaucuuucccaggcaaugaagcucagaggcucauggaccagaucguuguugggucaucccuuaagccaggcagaauagaugguaaugguguucagugccuggaauagaaagaaauagaaaguuaacugaggcaccacagaaagaguuuucuagaauuuguuguauuugcagaaauuuguuuucuuccuuccuuguaaauuauuuacauacuuugcaauugucuuucccgccagguccuccccuuuugaacuaauuucagacuuagacuggcguuauaagaauacuacaaagaaucccuuuuuucucuccaacugcuccccccauccccagaauccucagcaagucacuuguaacucugaugucucaucucuccugcauacuugagugugucuuuccuacaucaaagacacaucaccacagcaugaccaccagcaccaggaaacgcacuggugcacugguaccauuaaugcacaggcccauucaagucugccagaugucucaauaauggccuuuguguugcgucugauucagggccaggcacugcauucaggaacccuuccuuuuuaaucuguccucagcuugcaugaacuugacauuuuuuuuuuuuuugacaauuagaggccauuauccuauagaauaucugccaaucugggcuccuugggcauuuccucgugauguuauucaggucagguacuuucaaaucacauccucacaagugugaugccuucauccagcguucuugugggucacauacgacucugaugugacccuuucccgaugauguucauuuccucgccugauuaaggaguuguuagccuuuuguuguuguuguuaaguuauuccccccuuuguuguaaaaauauuuugugagagauacuuuuaggccuaugcagaggccccauuuaucagucuuuucccuuacagcuuaguauuuaccaaucuuucuccaccugcuccuccuauguuuuaaaauuuauuaggggguaugucuaggauggguguguggaaggcagagggcaacuugcugugauccguucuguuuuucuaccgugcauucugggaauugaacucaggccauugggcuuggcaguaggcaucucuaccuacugagccaucucaccagcccuaguuauuguuccuugagacaggaucuggugacauagcccaggccagcuucagacucaauauggagcccuuguaggccuuaaacuugugaugcugcuccugcaccagccuuccaggagcuggguaaacaggcugugccugccagcaugccccacuuuucaugggugcuccuuaccugaagaauuaucgcuuugcuagguaccaaauguuaauguccgguucccauuguucuguuuguugauugacauucuucuuuauggaaaagcuuacucucuauuuacuuauuccuggaucccuacauuuuuauuauuacuuauuuggugcucauauucugucugauuuggcuaccaugggccuuuuaagcugaaguuuggcacuauguucucuucucuucucuucucuucucuucucuucucuucucuucucuuuucuuuucuuuuuuuuuggauauauuuuguuauccuuugaagaccuuuuccuuuuuucccccaaauaaguaagcaaacacuuugguuaaggcuugucuuuuguguucccuggccugaccuuggagucagccauuguucuaagaaucucugguucugguuagugguguauucagaaacuaagcuuugaacagggcauuguucuugauguuucuguggcuugucccaggcucucugagaggacaaggauagagaacacauauacacauggacauacauguauauuuacaauauguauauacgcauggacauacauguauauuuacaauauguauauauacauacauacuuacacgcacaugcuuuuucacaucuacauuuacuucuguauuuuuaaaaaagauuuauuuauuuacuuuauguauaugaguacaccauugcucucuucagacacaccagaagaggcuaucagaucccauuacagaugguugugagccaccaugcgguugcugggaauuacaggaccucuggaagagcagcugugcucuuaacugcugagccaucucuccaucccuauuucuguauuuuaacaugugaaaaaccaugaauccaaaccaauucccucuccacugcuagcccagggcccuccaugaagcuagccuucugccgguauaacuuccuucccuguauucugacuguauuuauucuguacuugccuagcugugugcaugugcuacugucaaguccugugguugccauccuuguccccuggcuccuguuauugcgccugcaugaggcugcugucuucuguagaggcagccugucaucugucucccagcuuguuuccuuccuucaucuguccucccugcaccucccccccacaauggccuuccuccuuucauauacaaggaugccgcugccuucucuccccacugaagcucacucuaugccaguccccaugcucaccacguugaccuucucucuucauccacggcuauucuacuucacacucugaucaccacagacggugccguugaaagccacagagauggauccucuuaguucuggaagccagaagccugaaaucaagguguuggccaaguuacuuccuucuggaggccugagggagaagcugguggaaugcuuuccuuggguucuuucugguaguugcugguaggucuugauucuauggcuuauagauggacuguuuccucucucucucucucuuucucucucucucucucucucucucucucucucucucucucucugagugugucagugucuagauaucaucuacauagcaagacauugaucauaugggacuuaaagaauuauauaauuauauaauuauaagagccugaauagaccaccccagauagacuucuucgguauuuuuucaagcugauuacucugggaaacucaggcacaggaguaggucuggaagcucuguaaaagcaaccuaagacauacgugcaguaaagagagagacaauguauuagagagaguguuagcaucagagaggguugcuaugaccacucuuauuaccuaagaccguaucuggccaacagugcuuuaggccacauaugcacuucacaugcaugcaaccauaaccccacauaagccucaaaugcuucuguagcugaagauguugcuuauacuccaaucaccugccuccguuugggucuugcauucagugggaugccuguguguaugguuuagauaggguuucagauaggacuuuccucuuguuaaucugccuuaugccaucuuaauuuguauccccgccaaagaaucuagaaggguagaaggaaaccccauucauuuccuucccuacaggagguaggccuacuuuaauucaggauagccuccuuuuaauguggguacaucuucagagauaccauucucaacaaaggagcugcauucacaguuuuugguagaugagaaugucgugaggcugggguguuugggggaagaguuuucaagcucguaucuguuugcucuucucugcugaaugcucucuuggcuuaagucauuuagauaagaugagaagaaaggaagaaggcagggagauaggaccucuuuccaguggguucaggagggaauccucuauagauagauuagacccaucgucucaucuaaaguccaggccuucugcugacaucagaacagucuaggaaacucuggauucagagugagcacaggcuagcacccauuuugaagguauugggcuugugccuugaagauauuguagccuucacuuuguucaggaaacauuuccaccuucugugcuggcuacuuuaguguuagggugugacccccaucccaagcuguccauuuugaagccaaacaacuaugccauuguucaagaugccagccaagugugugucccaaggauauaaguaccauuuagcuggagcauuugggaggggucagccaugacugucacuaaugcagaaggagaagauggcuuuguugucccauaacaaaguuccuuuccacagugcccaagagaaagccugcuguguaaccuguggcacagggcauccaguaguuugugcgugagucuuaauuaccuugacagcugaaaaaccugcuucuucgcccugauuucuucucauuccaaugucuuaaacauucccaugcaaaucauacuuccaaauucugucuuagucaggguuuuacugcugugagcagacgccaugaccaaggcaacucuuauaaagacaacauuuaauuggggcuggcuuacagguucagagguucaguucaucaucaucaagucaggaacauggcagugugcaggcaggcguggugcaggcagagcuucuacaucuucaucugaaggcugcuagcagaauacuagcuuccaggcagcuaggaugggagucuuaaagcccccacacacggugacacaccuacuccaacaaggccacacccucuaaaagugccacucccugggccaaacauauucaaaccaguauacauucccaguaucucauuauucagcucugccacauuuuauuuaaacaucuuccaggagucuagauauuuuuuuuucaaucaacugaaaugcuuuaaaaguauaaacaguguuccuuaagcaucuuugguuuuucuuuuacagaguugagggcuggacccaaggccuuguacuuucuagacaagugcucuaugacuaagcuacauccccaaucuucccuuaaauaucuuuaaccauacauuuuguaucugcagaaauuaucgguuauuaacuaaaagcuauuuauuuauaugcucggaauuuaaucaucucaaacuccgaggaaguuucauuuuucuuuucaggagagaaaaauggaauuauaagaucuuggcuucugcuaccuucugcauuugguucuggaaguagugcccugggaaguggaugcaguugacaguggccaccuaacagcuuuuaaguuguggagagaguaguagcagagaguuuuauaauggcaggcugauuucucauuuauaaaaucccaauucuuaucucauauaagguguggcaauaaagagaugcccaggcuacagguucacccugcacacuuaaaagacacauaggaaccaaggagguuuccccuggugcccauuuugccuuuggguacuuagaauauccuggaggcauaguugcuaagacaccaaaaaaccaucuuacauccugcuuaaaggccucuaucuuauuccaugauaaggaaagacaaugcugggcccuauggagaucaugacucuuuaagacaucccauauuggggcaagagaaaugggucagugguuaagagugcuuguagaacaauuuugaggacaagaauuccuaucccagccccuacauaacaaaccugugcacccuuggaaccccagcuccaagugggaaggagacaagaggcucuugcgauccugcuggcuucuagccuagcaggaaggugugagccccgggucgaggagagacuuuauuuuaaaaugaauaggcaaaguuggaagacacccgacuauuuuuuccuggacucuguguguuacacauaagcacaugcaccugcauacuugcacacacauggguaacuuagauaauaauagucuuuuuaaaaaucucguuaaacauuagggcugaggaugcgggucagaagcuggucgugugcugcaucugcaaggcuacugggcaugguggcacacuuuuauaaucuuacuguucaaggaguaaaggcaggaggaucaauuuaaaguccguuuugacuacauaauaugaaacuuuucuucaacaucagugacaacacccaacaacauuccauguugcugaguguugagugauccccuggagacugaggcaggaggaucagguguuugggacuaaucugaguuguauggugacauauugagacccuauuucuaagcaaaaacacaaguugucaaauuaaucagcuaugaaccaggcaagaugacuuuccauuagcauccagauauuucauaguguuaucaaauuaguaaggcccaugguaacaguuggaacuccacaggccuuaaaucuccuucuuggaaggugugauggcuuauguaugcuuggcccagggaguggcaccauuagaagauauggcccuauuagaguaggugugaccuuguuggaguagguaugucacugugggcaugggcuuuaagacgcucauccuugcugucuggaagccacuauucugcuaguagccuucagaugaagauguagaacucucagcucuuccuguaccaugccugucuggaugcugccaaguucccgccuugaugauaauggacugaaccucugaaccuguaaggagccccaauuaaauguuguccuuauaagaguugccuuggucaacucacaaaauauguacucacugauaagugaauauuagcccaaaacuuaggauacccaagauauaagauacaauuugcuaaacgcaugaaacucaagaagaacgaagaccaaaguguggacacugugccccuucuuagaauugggaacaaaacacccauggaaggaauuacagagacaaaguuuggagcugugacgaaaggauggaccaucuagagacugcuauauccagggauccaccccauaaucagcuuccaaacgcugacaccauugcauacacuagcaagauuuugcugaaaggacccagauauagcugucucaagugagacuaugccuagcaaacacagagguggaugcucacagucagcuauuggauggaucacagggcccccaauggaggagcuagagaaaguaccuaaggagcuaaaggggucugcaacccaauagguggaacaacauuaugaacuaaccaguaccccggagcucuggacucuagcugcauauguaucaaaagauggccuagucggccaucacuggaaagagaggcccauuggacacacaaacuuuauaugccccaguacaggggaacgccagggccaaaaaaaugggaauggguggguagggaaguggggggggaggguaugggggacuuuugggaucgcacuggaaauguaaucgaggaaaauacguaauaaaauauuaaaaaaaggaaaauuaaagauauauaaauaaaaugcaagauuuucaccuaaaaaaaaaaaaagaguugccuuggucauggugucuguucacagcaguaaaacccuaacuaagacaggaggggaaguucaagucuuccucagaaagccuuaggaagucucuugguauugagaaauacaggucaaacaaagugcugagauauuuaaguggcugaaguaguucucuggcuugggaaucuggcacucuugugaaggagucggaagcaacauggccucuuagcuucuugugcuucucccagcaacuggcaggagguagagaugggcagauaggaagggcguguuaguggcuuccaauaccuucaguaaguguuaaugugaaauuagcaucaggguggugggacauuagcuuucuguaggacuuaggcuccugagauagcucuccagguuaaucagaaacagggccaggcagggcgccugcuucuccuccuuugcuuucgguuccuuugcaaaccuggaagcaugcgcacuggccaggcggcccugcuuuaggaaggaaguuacguugcugaagcaacuggagagaguacccaagugacguaauuggggaagucuccucugguucuuccucuuccaguuucuuaaggaaagggguggaaagagggaaggcgccugcuucuuagcacacagagaguggggaaauacuguuuuccuuggaaaacuacaaaagcgaagcuguggcuggacagggugugugguuauuuauguuaaucccuacuuuccgggaaggcaccagacgggggcuggaucaaggaaauugaaaaauggcuuccucuucaguacccucagucccuggagcugacacugaguuuguuguacuguauccuccugcccuaccuguggccucugcagcacaggcucccaguguggagaagggucagauggugacauccaggccuuguggauacuccauguuuggccugcaaguauguguguuucuuacccagaggggaaaugauuuggauuuaagauggcuguucaagucucagcuguaauggucaggagugauguagccuuggucacccuauuuaacaucaagggccugcuucagcuguagaguaggaaucacagcagcacuuucauacuggugaaugcacagagcuaaugcucuuuaugccuauaacuugcacaaugccauuaagcacuugggcaugguagcuguugauaauaguuuucgcugaguguggggagaugcuggacuugacagccugugcuguuugcaggagcuugcaggucuagaccuggauccuuuaguuauucacacucaagguccuccacuuagcaguagguuguguucuaagaggugacuaagcuugcagaauaugagcuaggcuguuuucaaaccaagcuucucaauauaguauccgcucaauggcuaguggcuagccuccucuggcaccuccacagggguguccagggaagauacuuuguuugcaccaggcaucugugggugacccugacuuggaaacugucuuuuacucuuaggugagguguuagguguauguaagugacuagcaaguagcuuauuggacucuguagauaaaggcgauuguugcaaaagucugccggguagaacugaucuauacuucuuagguguaauguguaauacuguggucauauguauuuacacauauagcaaccucaacgcaggcuuccggcuccagagaaccuuugucuugauggauuaaagcauagaaaaaugaagcagacacuggaaggcagugugauuauauguuaaauaauuguuagagguuguguuacgaguucacaaggggauuuuugaguccuauguuguaggguagacauuguagaagagauagcauuggaaaauaugcagaggguugguugacuauuucgugacuggaccuuucuuagugcuccagccucaugcaucuaauugacccuccaacauuguuuggacugucccaaggagaucucaaacaauaggucagaagucaaccuuggcauguccucagaccacauuggguugcagcagcugaacgccaauggcucccaccucaucggaaaacagaggaaaggaggucacauuagugcacagauguuugaagaguuugaaggagaguuagaaaguuagaaggaagagcccgucggugucuguauucuccacgaagccaccuucacgaucaucugcugccauuaaagauggggugaguccaugaagcucgaaggaggcaaaggccgaaagggcuuuugggagaacugagaggaggcacuggcaaggaaagcagcagagacccgaggaucgguggaggcggagucacggacccggccuaucaugacguuuugcagcaagagcgaaugaggcagguuggugagauccauucguagugaggaaauggagcuacuguguugggauguacauggggccaaagcacauuccagggagcggaagcaagagagccaggucgagacacagaaaagcaccuggggaagcuguacucagugggcagagcugcccaggaaacuaaaaugauucuggagaauuuuggagaccuaggaaggaccuuucuuuguaggucauggcaggaggucuggacuuuuuagaaagauaucagauggaaagcucugaacacgggcauggccacugcagacuuguuucugaaauugccaaguagaaucuggaaacagaccgaugucagaaucggccacugcaggacugaugaagaagguaguaccgcuaaucgggcugcccucaugaagauggagaggguguggucacagggcagcccgguggaagcagauggcuaagcguggcaguaggugggagggugagggaaguggcaaugagugacgucaaguacaacggggccaaucaaacuuuaagaggucuagcgguuuucugauuaguguacuuaaucuggacuccuuagcacuugucucggagcugcuccugaaacccaauggggccucugagcacaacacaggggcaagagcauugcaaguugcauacauuggcgaggcuuacccuggagcagaagaaccauucuugugaggcuguaaugagaaccgcuuucugggaugacugugucaccugucauaccccaaacuggcgauauguuagugucuuuugagcauacauauggagacccuaaggcaguuuugcuguguguuuaugguggucacacaacacuacacauuaugaucagaggcuaagucaaacugcguuagguaccacgguagucugugcccagagacaauuucguuuuuuuguaaaauugcuaugguaguauauaauaucucccaaaaggacccagaacucaccuaaucagaaaauucuguguagaaagcagguacacuaaacucuaauuugugugauucucggcgugggaagccugcuuugugauaaaggcauuuuggaauuuuaauuucaugugcauuuguuucgcauuagucaugaacuucauucaccaguagccuccuccugucccaugacucauucggagauguuugucagccaucagggaugcggaaggccauuagauuaaugggcacuaaguggcagugguuccccccacuuaguggcauaucgaaauuacucuaagauaaugaaagugaauccuguucccugcccuggagagucuuauuaggcugggguuagggaauuuuccuucaaaguucuccaggugauaacauugcacaauauuguuuuagagacugggagagauucaaaccagaaaagguggcuguggcuugugcugccucugccucugccucucugccucugccucugccucucugccucugccucucugccucucugccucucugccucucugccucugccucugccucugccucucugccucugccucucugccucugccucucugccucugccucucugccucugccucugccucugccucucugugaguguguguaugaguguacucgcaugcaagguguggguaagugugcaccaguguguaugugcauguggagaccagaguuugccccuggcuuucuuccuuaucugcuuuaucuuugagauagaaucuuucacugaacuuagagcugguucaccuagacuggcuggcccacuaauccuaggaauccuccugucucugucuccccggugugggggcuacagaggaguuauaaugucuggcuuuucacacagaugcuggggacuggguccucauacuguuuugguaagcacuguacuugaucaagcuugaaacauggucuuuguauuuauuuucugugcauuugugugugccggaggguauguauguacaccacgugugugcagugccugcagaggccaaagggggacauagaucuccuggaacuagaguuauagauggcuguuacacacugcucguugcggcucuucacuuccaagccauuucuccagccccccuggaguguauucuuugauggaacugacauauaucuuuaaaaaguuuuauaaaacagcaaaucagaaaacgaagaugaaguuuaacaaaacuuugaaaggaucagcacucuauugguuuagauagcaauagccauuuuuuucuauguccauccaaaugucaaaccaucuuucuguuuucaugacuggcaguguugacuuacuucgucaggcuuccaccagaauauguggagugauguguacaaaugccacagagacacaggaaacagccaaaugugaaaucuaacaccuccuccucaacacaucacggcguauugucuuagcucugaaggugauaucccugugcaugcaaaugucagcaagcucuuguacaucuaucucuuaguagcuuacagguuacuaaggaugcauauauuuauuuauuuuugucuucuuuuaucccuuauacuugccaauauccucuuucccuaccugccuacacacguacguacguacguacacacacacacacacacacacacacacacacacacacacacacuguuaaagggucaggucagccuaaaugcaauucucuuuaaaccuuaucagccacaguauuaguaucaacgaugcuacagcaccauauaugaugaggucugaaauaggaggaaguuccuugcaauuaugucgacucuauuuguagcaccuucuuauauuuucuauucuauacuccaguccauuaaaauuaaauuaaacuugcugaucauaaaccaagaaugccaaucuuuuuuucuucuucuucuucuuuugguuuuccaggacaggguuucucuguguagcccugacuguccuggaacucacuuuguagaccaggcuggccucgaacucagaaauuugccugucucugccucccgagugcugggauuaaaggcgugugccaccacugcccggcgagaauaccaaucuuaauuaaaaaaaaaaaaccaaacaaacaauaacaaaacccccaaacacauugcacagugccuuagcaagcuuuuaccagcgguuugagaaacacuggguuuugcuguggcccuuggaggcagaaagguuuggauuggaucuugagccuugccgcuccucugaggucaggcuaaguaaguggcuccauuucuuccaguacaagauggagaugagacgcucugcccggguggcuuguugggaggcuaaaugacgcuaugcacgggaagcucugagcuccucguaagcuccggaaugaaugugguauuggaaaccaugguggcugucguucucagcuccgcuucuccccgucucugugcuucugcauggacguccuuacacacaucagucagggugaggagucuagaauauucuauaagaagugaauguggauuagggggagaauuauugagugcuaaccaagaauuacuacuggaaguuucuguuacaguccuugaacuuuauaauaauuucccccuuucuguuuucagggggagcaucgccccucuuuccuagucuuccuuuccccucacccccauaccuccucccuuuuggcuuuuuauuuuuaacuuauuuaucucaucuuuugggauggguuuccuuuuuuccuuuuuuuuuuuuuagcuauuuuuacucaucucuaaaauggaaauaacaauaucugauggcuaaggcgguugugugugcuacuacugaagauugguguuaaauaccuaggauuuguuucugaaguggugggugacuccggagcaucaucugugaugcugccugaggcgguuccucuguccucaucagcaccacagcccugcuuugacccucuuuuaucucacccugcuugucuguugaacucucuuuggccaggcauuuccucugcuccaaucugcucuuccucugacauaaaugcuuuccuuggaaauccaauuaauagugauuuauggauuccuuaugaacuaguuaacuuaguuggcaauuaaguacagacugcucucuggucuccacugcaucauuuuauuaugauaauuacagaauuauuaguuagcguuauaugauuuaugucucacauccucagcgaacuuaugaguucccugaggguagcaaccauagcuuacauaucuccaaguacaccuacccccacuacagcaauuagcacaggcagaucccuguaauccuguguguuaagagcuaucuguugaggguaacuggggacccagacagcaugugccugaagacaagaguguccagugggcuggggacauggcugugugacaugguaaguggcaagaacacgcagaagcacucgaugaugaaggugcagaagagcccggguguggcaugaccacugucagcuucuaggacagagauucaaacccagcuuuguccugagugauuuaguuugcaucuuucuuucauugugucucacuugugcaccugucuaauaugacuccuacuaaacuguguauagaaaauucuggaagguuaauaguugagggacuucaauuuuuaucucucucugucucugucucugucucugccucucucaacucuccugccuuggcuuccugagugcugggguuauaggguaccccaccauguuuaggcuauggugggaaucuguaaguauuucuccaaguaaaaaaaugacuugauuucaucuuuacucuugaaugaaauauugucugaacauaaaaauccacaagguggucuuuuuccuuuaaugcuuuuucuuuaaaauuauuuuugacaucgugugcgugcaugcguguuugugcacauaugcagccacagugcagugugggggucagagaacaacuucuaggaguugguucuuuccuuccaucguaguguuguggggacugaacucaagucaucugguuugcuggcuugggccuuugucugcuaaauuaugcuggcccaggacuucuuucaaaggucuucuggcuuccauuguuucuguggaguacugaauuugagcuuaaagguuugggauauuuugcuguuggcuuuguuuuuucaaagguaacaugucuuuugcccucuguuuuuuuucuuucucuuucucuuuuuuuuuucuuuucuuuucuuuuuuuuuuuuuucuguuuugggcuuggguaugguuuuuaucuguguuuggccauuugugguuuucagugacuuuugaugugugauuagaaaaugucccguuguggucuucucaagaauuugccucacacuuugucuugucuuuguagacuuucaaauuagccacaguuuaaacccugcaguguuccccuauggaaucuaugcucgucuuacacugucucaucuuugugacuuucagccucacucuggaauuuccuuugaccuguuuucugguucacauaugccccccacccccauccagguaucaaagcuauuuuuaggcacaccccauaaguucuuaauuuuaaugauauccauuaauucuauaauuuaaaauuuuuaaugguuuaucugacaaaauuuuuccaccuuugccuuuuguuuuccuauagcugguuuuagaacuacccaagggcuagggggugguucuggcuuucagucagaauuugggaggcagagacagguggaucucugugaauuugagcccaguuugaucuacauagugagacccugucuaaaauaaaugccugaagauguuuggucugugugcauccauguacauaccauuauaucugcuuaaggccugugucuguggccugugggucuguuuccacugauguuugucgccauugaucuuuauguuccuaauuauaguuacugaauguagcgacugcaucagaagaacuccagacagagugguuaaccuuugagagugucaccgucuucaguguaagagugacauuggaagcucuaggcuaauuuaaucugaucagaggucaaggugauucaaaaucgagcuuccacauugcuugccguuagucuauuucugcuuugguuaucuugugugugcacgcaugugugcauacaggagugugucuguaugcauguggagaccucagucccacaccacgggccuuuaccaauugcucucccuuuugugguuugagacacagucccucauugaacccagagcuuuucaguuuugccagacuaaguggacaacaagcaagccccaaagauccuucugccuccauuuccccaaaacuguuuauggaugugugcugccaaaccaagcuccuuccuuccuuccuuccuuccuuccuuccuuccuuccuuccuuccuuccucccucccucccucccucccucccucccucccuuccucccucccuccccccucccucucucgcucccucacucccucgcuccuucccucccuuccccuuuccuuccuuccauuauuauuuuauuucagcuucagggauccaacugugcuccucauguuuacaacucaagcacucuacugaccaaaccaccuuccgaaccuauccauuuauuuuuacuuacucucauuuauuuuauuuuauuuuucaguuaugugugugugcaugugugugucugugugugugaguacaugugagcgcaggugcccuuggcagcuacaggcauugucuugcccucugagcuggaguuacaggugguuggcuggacagguguacccccaaccugggugccuacaaacaagcccuggucuucugaaaaagcagcaagggcucucaacugcucagcuacaucuccagccccacuuagguuauuacuuacaaugcuugggaaaguuccagggccuccuuuuccuggcucaguuuugauugccaguugucuccuuggucaccugaaugugccccaaauucuggucagcuucugagcccugcaaccuccucccagagguuggcacaugcacuugggauguuuagacaucucuagaaggacauaaagucaaaauguuugaaaugguauuuuaggaggaugcacgugcuggugguguguaagaaagagaaacgggugcaaaagggcccauagaacagcagagaggccaugcuaacugagggcgaucuggaguaacaaguagagccccuggcuucccccaucauauagacucuguagaaucucaguuucccaaccuuucugcuuuucucuaagcuaucucucuauaggggugcggguauguccuaaccaagccccugucuccuagggccgagauauuuaaauaacagaacucaacaaaacuucaguacuaauaguugcuucaucagaaaaucaauaucccuauuguaagaaauaugguaaaauuguauugcuaucccaauaaccaaaucucaguuauuuagccagagauuaaacauggcugccaauggcaccagucaggaccguggcguuguuaacuucguugggaaccacuuguaguauguugaucacaacaaguaccuugccuggcuuucugcaguggccuccgcaacacugauuaccgaacaguaguuucaccaucucauugguuuugcuuccugugguuucucuugcccugggucagcuguguucugaaaacauuaaguguaaaauucccuaaaauuccauaaauaaacacgaaguacugagugauguggugaguccucacacauuuggcccuaacucaccugggcaguaagucacccacuuguccuguguguccauguccuacaagguuguccucagcauccuaguuaucagaucagcugucacagucuuggaugguccgagcucaaguaacauuuaucuuaguuaagcagugcccacggggccaggguagugaagcuuguuaccagugagguggccaaaaagaaaucacaagguuucuucauauucaaagauaagagucggugccauggucugcaugugguggucagaggacaacucuaugguuguccugagucugaucuuucuacauuuuuguacuuuccuccacugaaccaaccccggauggaggaauuucacauuuuuuugguagauaauuauaaaggcaagaguaaggucaacacauuuuuaaagguaguuauuauagguaguagggaauuagaaauagagacuccuguuagaguguagagcuaacugaauccucagcagaaaaaucaagaggggcaaguugcucuccccuucaacuacagcacaugagagccuuaguguguauguuguaugcagcgggaaaaauagugaaaauaaauuucagaaaaucccuaauuguuuuuuuuuuuuuuuuuuuuuuuuuuuuuuacauuuuuauucacaugucuugguuuauuuuguguuccugaaaugaaacacuggagauuguguuuuuaugaaagaaagguuuuuagucuuagagguucaggaacaugaaaccucauauagcagacaugacagggacagagacuuuuggaauuagauuuuaggggaggugcaaggcuugcugaugaaaagucccccauuguuugcaagagugauuuucucuguguguguguguguguguguuugccugucugcaugccaugccucgagaggccagaaggaggcaucagcuuccuuggaguuggaauuacagaugguugugaguugccacgugggugcuaggaaccaagcucgggucuucugcaagaguaacugugcucuuaaccauugagauauuucuccagaacucuaacgaccauucauuccggaacaaauccagcccccugggaccuauccuuggaccuacucaugacaucagggcuccauagccuagcaguagaucuacuucuugaaguuccaccaggucaccuuguaccucacuagguaaaagguaccucacaaguuuccagcuuaugaaccuuugagggacaaaccaaacaaucagcuacaguauuguggcuaucgacgagauaaacguugagucuggguugcguugaauuccuguucgugaugggcuaacagacagauggagcaguagggccuggaaauuagaugaauggaaaagaucugucagcuggaaagaccagacguuguaggaugccauagaacacccaagcaauaaauauguaaaaauuaaaggguaucuggauccuggcuucucagagcauacaagcuuaguuuucucucuggcaauugagcaguugcacaauggccuuccaggacuuguagggucaggcuggucuuucgaguacuuccuguuguuaccuggugucugguugcuggucuuuucuucuucaaggucguuguguuuucuccuuccuguauuaguucuuguaggugccguaacaaaguaccagacuguguggcuuaucaccaugguucucuauuugccacaguucuaccacaaguagaaaaucagggugccugcuucaucugaaaacuauaggagagacuccaucuuguuugauuccagauacuggaagccuuagauauucuuugguuuggggggaagauucacccaggcucuguugcugccuuuguguagcuggcuucucuccauaucuauaucccuaguuccucuuugucuguauuuucaguucccucuuacaaugacaucagcuucuggugaaaugcugcucaggacauugccaucaguagauaaauacauagccuucauguuuuaagauaacuuguuuaacacacccuguugacuaacacugaauuuaugcugagcaaaggaauauuuaccuuuaaucucagccuccaggaggcagagcugugcagauuucugggaguucaaggcugguuugguguacauagcaaguuccagggaagccagagcuacauagaaagaaccuggcucaaaaauaaaccgcuacaauaaaaugaucuuacagccaaacacauaugacacugauaugacacaugccugagucucuugaguaagcuugucugauuacauauauuuucugcaugaggcgcaucacagccucuguguguaugugugugugugaucuugaauuguuuuguguuguuguaauagcacagacugaauaauuuguaaaagacagaaauccauucuuccguaagucucaccuggaaaguccaagaccaaagcugaagcaucuaguauauacuugguguaucuuucacaugacagaaggcagaagggcaaaggugacaaaaccugaauuuccacaugucaggagugcauaagaacaagagaacccaccuugaaaccacuuuuacugaaauuuaaaugugcuuauaugaagguauaacucccacuaaauaaauacauccucaaagaccucaauacccaacacugauauauuagggucugggucuuacuaugaaaguuugagggggcaaaaguaaucaaacuauagugggugggugagugugcauaugugcauguuugaguauguuggugugaauaacuguaagcauggaaguaugaauguguuugaugcauguguguacauuagagugugguauguguguguuugaauuguaugacuuuaaguauauagguggauggaugaaucuguagauguguuggagugugagcgugugggugcauuuuagcuuaucugaguguauaggugaggggcuggcagggaagccuccacuugcccaucagggauaagcccuaucaacugcuugauguacucacagcucgguaccuuauacuuuuuuuuuugcgggggggagguuuaaaugagaagaagaucaacaaaaaaacacagggaugugaaaaaugucaucccuaaguagaccacagaaaggacuuuaguuuaaagugggagagagguggugagaauauagagaauugcucuguuugaccucagcuggguguguuugccccaggcauccagcauuucccccuuuugugcgaguagguaaugacuauggaaacaauguaaggauguguuucgcaguuacaaauacaucuuuaguaagcuauugccuaugcacagaacuuggaaagaaugcacaccagcuguaucucuccuuaugaacuguugcuuaaaggagggaaagcuucgugaaauauuucaagugauuaucauuuuuuuuucuuaaauagguuaucaguggaaaaagcaugggggggggaauauauacugagaugaucucgcacuggaagcguggcuccucaccugcccccucaccugcccccucaccuaccccucauccugcccugccccugaguuuaggcaugccagcagcacuucuguuacgucaccucagaaguagcguccauugcuuucucuucaugacuccugaaacuguccccacuuucgcucuucuggccccauuccauguggugaggucuuccucuaagggaagauuggaggacauuguggucacuacucggcaaggcagaggcuuuaugguggcagcagugugucuagcuucucgcagaguucccagcaugcuuuggcaacuccuuacacccguacacaggacucuucauguuucuaauucccaucuuuaaagaguccuguaagaaucaagauguuuuauccuguccaauucucagaaccuccuuuucaguccaagaucuuugaauggauagaugaugaaugacuaagagauugaaugaaugugagaauggaacaaauuugagauucauaaaaaacagcugucuuggugacuguucaucaccuucccauguccuuuguaacgccuccaaggcuuuuccuacugccucaaaagauuggccaccuggagccugcagguguugcaugagaccacccuuccauggcggcuuugccuugcuagcucagaacuuaccugguccuuguguuggccauuuacuguguagaaggaggaacuuggguuuuuuuuuuuuuuuuuuuuuuuuuuuuuacaagauuacacauuguccucugagaggaugaaguucaugcucugagagagcucacaguuugcaugggaaagugaggcugcacacagcugaaaacuuuauaggcauaacaggagaugagaugaaagccgggacugaaauagcugcccuaaagcaaugucugcuucuugaggaagauaugugagugguguaggaguugggagaggaaggguugcuucaggcuggagugcucuggaaugaccuuugugagaaguggagaggcuaggucuuggagccugguggaagagugacaacgcccaggaggaaggaagagcugggugugaugaagacacaaaguggacuugagcuuugugugggggcaguguacggagaaaaggggggauggcucccaaguacaaaggugaggcccuuguugauucaugucauggugcuuguuuucuuggcaccagugggggacagaucauagaaacuagaguguagagcauagaggauugcuuggcaagauggaagagagaauuauguggcaugaaucaucucgauccacaucuauagaguuuuuuuuuucuuucaguuaagcuuggagcaaaagaguuaagguuguaaggucacauugccauggaugccugagucaacaucaccuugaauuccaggugucagacugaauguaaauguacaaacaugaguaggaagaugucaggcagagaguggguagcagcuuuauuaguuauuccacaggggccgaguuugggugggaagaaaagagccgacuguauagucugguagguaggaguguguguguguguguguguguguguguguguguguguaggcagugugugcccugguggagugacaauauuccagccaugcaaaugauugucaaaggaaaaaugagcaaaggugaaaggcaugcaagugaggccaaggcugggaggcuggacaggaagggaaaugcuggaugcagugacuaagagauuguacuaggggagaugaggaaguaaagaggaggacagggaagucacugcugagcucugaacauagaguacgucuagaaggaaugacuagacaguaacaaaccuuaaaccuuuaguggacuaaauuaauuagcauuuuagugccaguauugagaggucaaaguauugauacauccgagguccucaagggauauaucaguuaccauagcucuuugucucaggacuguuuacccggcauuugauuuccuuuuggaugguaaaauauugguccuugaauguuggauaugcugacaguuucuucuauaagcacagcacagagaggaaggauaaagguuuauucgagacaaagucacugagaggcaucugggccuacagcuaguugggugcauggcauaccaugcccauaaaaacuucuuucagcugagagucagcacggaaaaugucuggucugguccauuuugacauucacugggagaacaggauuguggaaagagcagauggcaggggaacugaauauacucaacuccugccuaggaagaggcugcugggaaaagguccgugccaggggguagaacuuuguggugcagauaagaccgucagucgcagaaauaccaaacgcuguccuucucuucugccacaggguaccaugccgguggaacggaugcgaaugcgcccguggcuggaggagcagauaaauuccaauacgauaccagggcuaaaguggcugaacaagguaggugcgcagugcgugugugugcaugugugugugcgugagugaaugaaugugugugugcauguaugugaauguaugugaaugugugcauguguguauaugugugcauauauguguaugugugaauguguguguauguguguguauguguauguauguguguguauauguguauguguggauguguguucggggacaugagagacagagagacagaagaagacagagagacagagagagacagggagggaggaggagagaagagaaaagagaagagaagguaggugucucuugaugaaagugggcccaguggaucaccaaauaaaguuguguucaaaaucuuaugcucauuccuauaggaaacagccagugauuauaaaaugcaaauucaucauaucaaaaaggguuuggccacauuucugaacgacaguggggcacagggcaaggguggauguuaagugaugaggaaggauggacucuggguaauggaccagugagucaugaaguggguauaaagcuaacugauuuucuaguuugaacugucauuguguugagggaaauauuaaaaaauggaacuggcauguuccagggcuuguguguguguguauguguguguuuauguguauaugugaauauguguuuguguguauguauguguguguauauguguguauguauauguguguauguauguguguguauauauguuuguauguguguguguauguguguguguauguguguguguauguguguguauauguguuuguauguguguauguguguguacauguguguuuaugugaauguguugauuaguccucagcaguuuggcuggccaugcacuggugggcaauggcugaccuguuuuuaucucauggagauucugacucagagcuccauaaucucuccacccagcuugcuagguucccacugguggucguuaccacgccagcuccaugcuucaaaucccccacagccuuuguggugcaaucuggcaaacucacgcuuugcugcaguaccuuucucucgggaacccaguggaaccacagugugaaggaaaaugccacgcagacuuaguucaggaacaauggugaaucagucucugggugcaacaacuaaaaccuuaucuuguaagcccuauuaagucugauuccuccugaggcaaauccugauggaucugccaugauacugggaaacucuagcagccacaucuugccccuacgcuguuccaaaaggaccuaacucucuccugcuuccucucuuccuccguccaacccggaagucccucccacucaccuagugaucagcuccuuuauucauuaggagauugguucacaagaauagcaccagguccaucaauaacagucauugauuuaucuuuuuucauguagugaucuuugccauggauaaguacauaaaaaauauaauguauagugaaguuaugaagucacuguagagcaccacagcuucagcuccgcuguuugcacuauacacauggucacugaaauguauagacuuugggucuggcuaaucuuacuugcaaguucuuuacaauaaagguuuuuuuuuuuuuaaguuuuuuuuuuuuucuuuuucaucauuuucucagacucucaccucaaccugaguaccuuugguuuccagaugacuuugugaggagacuccugugguguguucuucucugacccuccccucuguccucaaauccccucuuugcuucucuuacuacacaagcacuaaaggauacagggacaggauacaugguguuggguguuuguuugcuuguuguucguuugagugggggaccuuaauuuaaccuuuaaaagguucuguuuuguuguuguuuugagacaggguuucucuguguagccuuacuauucugaaacucgguagaggaaguuggucuugaacucacaaagauccuccugccucugucaccugaguucugugccaccacuaccccuguccuuuaaaagguucuuucacuccucucccuuagaaggaaaaaaagacugucaugcuggggguggccuuucuugacuuuaaucccagaacuugggaggcagaaguacucagauggggauuuuugccagucuaggucagucuguuugacagaaugaguuccaggccagcagugaugcaaaguaagacccuaucucagaaaaugaacuacaaacaaacaaacaaacaaacaaacaaauguauguauguacuuucuuuauaugaaacccuacuuguguaucuaccugcccuaacaaaguaguuguuaaucauuuacauuuccccaaaugcacgugugugugcauuucuaauguuuugauuuuuuaaauacaguuccucauguugucgugacccccaaccauaaaauuauuucauugcuacuucauaacuguauuuugcuacuguuaugaaccguaauguaaauaucugauaugcaggauaucugauaugugaugcucagaaaggucuugauauacagguuaggaacuacugguuuagaggaacagcuaaguaugccuucucugaggagacccaagggagauuuuuuuucuuucaccaagaacaccaagaauucugagcaaaucucuguuuccucuucuuuacucuacucucucucuucauuuuuuaaucuaaaggacacggugaauaauuuaauggggcaggcuuuauuuuugcaccaggugcaagagcuuaaaaccagaaagcagauuguggccagcuuuuagugagggaaaaagauauugucaagaaaacaaaacaaaaccaaccaaaacuucugguuucauuuuaucuucucagguuccucuuaaacuuuuuucuuucccuuaccuauuuauuuugaauuuaagaagacuguaauugaauaucucugcuugaguccuuucuuccagaaaggaugggacaccgaaaaauagaaauaaauaaacuacauacuugcuuuacauguccugucauguacuggaagguuuuguggcaagcuuggaagcugaggcucagguauaugcucagucucugcuaaaaacacaagcaagagcucaggucacccuugaucgcucagugagcaacaaucaaauaggggaauaaggagagagggaugguaguucagagacaguguagggagauauaggguaacagguaaaagcaauggcaguugguauuuguuaaguaguuuuugcuacuuacucaucuaagcaagggauuaauuacauacaucaagucacuuaauccccacucugggaaagggcuguuauuuuccauguugcagaccaggaaacugagguacagagagguaaggaaggcuccagugugagauugauuuucaagaaaagcaaaugguuuguuuccacuuuuucuuuuuuggacacuagcuuccuauucucucuuuugcuccuccugaaccauaucuguauguggcgaacacaaagugucauuguuccuuuugugucagcuaggcacuggcaaccuguaguugggugguuuuuacaggagguugaccaguagucucuagcucuaaagaccuaucccaaucuuuauaaucuuggaauguggcccuauauggggguuucagaugcaguuaaggacuucaagaugggagcaucuggauuaaucugucuggacuguaaguccaaggacaggugucuuuagaagagacugaagacugaagaagacacacacagagaagcuuugccaaggagguguggugcagccacagccuaugaacuccuggagcuaucagaggcugagagaaucucuucuagaagcuuuuaaaacaccgaaacccugccaacaccuugacuuuggauuuuugacuuucagaacugugauaggauguauuucaccuuuaagccacuuaggguauggucaucuuuuauaacugcuuuagggaauaaguguccccucuagguucuucucauucaugggggcuccuuguaugcuauccacuacucccaguguuggggauaaaaaggucuuguacauauugggcacauccuuugccacugagauacauucccagccuugucugaauuuuucuacuguagggucagaggcaacaauuucucuuuguauaacuaaauccuuagugugcucaggggggcauucccugcuggguuuuucugcucuggcuuuuggugccaccuuucucuuccaaaagaagacuggagaaagggacaaccuggucaucucuugaacacuucuacuaggcuggaccugaggccgucuaguugaaaggagcaugucguuggcucuaacuuccuccacuucucaggacaauguugacacaggaaugccuaggcugcucugugucugagggucccuguuaggcagguagcccacagggcuaagcuacaguaggugugugucugugcacauaaacaguaggggccucagaugggucaggguauuuucuauccauaccuaaacuucuacgggcaucuuuuuauagguuuccucuaacugaggcuuuuugacauucaucuguugacacaaauacuucaccaagggccuguugccuuuuccuuacuauucacaaguacucuaaagaaucccugucuauuuugaguggcugggugucuuuccaaaaccucauuucuuguugaagacuguugggauucuaguaaaacagaagacccaucccuaagacuuugugauucucuuacacgacaguugguuucucaguucaccuuguguuuucaugguugcagaauguguuaaucugcuuaccaugaauuuaucugaggacucacagugcagguggcaggagcuucuguacagcauggagcccaaguccuggugagggcugcuuuacaacauggcugacagcagaagacgcaagucuguaagcuaagagaaaauuuuugggcaggguccgaguugcugcuaaaaaaaaaauagcagcagauuccuuaaggaaugagagcacuccuaucagacucaauccacuucucuaaacagcaccuacccauucauaagggcagagucugugaucuaauuacucuacacuggacucucaucacuuaacccauccgugcugcagacaaaggaagccuugcaagacacacucaggcugcauccagacccuagcaguggaugcucaggauacacuuuuauccacgccuaugagcugucaguacaguacaguauagcuguccugaugguuacucuauguacagugccagaccuaguaucugaucagauaggaggcuuuucauauagcgugcuuaugaaucugugaauaaaggcaaggaacccaaauucauggcuauuuuuauuguuguuguuuuacacuaagauaaccaagcuuggugguauacaucuguaaccuucauacucagcauggcugaaaauuugagucuaaaugggcuaucuauggaaacccugccagcagcagcagaagaagaagaggaggaggaggaaagaaagagaagaaaaaagaaaggaaggaagucaggcagguaggcaaguaggcaggcaggaaggaaggaaggaagaaaaaaaagaaaggaaggaagaagagaaaucaaugcugggauaauggcuugaccacuaucaugucugucuccaaggaagaguccagucaguaauuauuuaagccuuaauuuguuuucauguccuacuucuaauaaaauugaaggagaccugucauguagcagggcccagccacaguggaagaguccagaugagcaucuaagaaguugccagagcagcauccguaccacuuguuugugaaagacaccguggaagggccaucuacucuuuacgacaguauuugcauguggcauaguacggcugagucauacauuuagaaugaguagaagacccaaucuacccacauccagguuucucacuaucuauagcuuuaccuuuucuguguggcuagaaggggguuuuaucuuaaagccauuggaugauguugcauaucuguaagguuuaacgguaucuccuuauuaucuccuauaucuuugucauuuggacaaagucaauaauuuuuuuuuuuuuaguaucacugucccacuuacauucagauguuuuguauauucccaagauaccuucuaaaaauaauuuauuuuugagauuauaaauauuaaccucacuuccuccuuuucuuuccaccuucugcacucuuccaugcauccccugccccccacacucuuguaaauucauggccucuuuuucuuccauugauauuuauucuuaaaccauaaauauaaccuguucagccuguauaauauuacuucuauguguguucucagguugaccauuuggucacaugguagauuuauuuuuagcuuccccacaaugauuuauagacuggucggacuaguuugcaagccugccagcagugagugagaguucugaucuuaccacauccccucuccagccuuggcugucuauuguuuauuaaucuuugacauucugacugcggugcaauuaaaucucagaguuguuuugagcuggguuuuccuaauugcuagggauugugaacaauuuuuuuuucugauauuucuuagacuccccccccccccccccuugagaacucuguguucagauucagguuugucuuuuaaaugggucuuuuguuucuuuguuugacucugguuuuuuaguucuuuauauauucuggauguuaauucucuaucugauacauagcuggcaaugauucucacccauucucugagcuuacgcuaauccuuguugacuguuucuucagcuguguggaagacacacuuuuuaguuucaugaaaucucccuugucaguuguugacuuuaaugugcaaaccaaugaaguccuacucagggagucuuuuccuacacauauauccuguaggcacugccuguguuuucuuauagacgugucaguuuuacaggucucacuuuaagaucuuugaucuacuuggaguuaguuuucaugaaaggcacuagguaucggucuuguuuucuuucuucuguauguggucaguuucccagcaccaaguuguugaaagaagauguguucuccauucuguauccugccacauggcugaauuuaucauuucuagaaguuguucgguaaaguuuugaggaucucuaauggacaguaucauguuauuugcaaauagagguagucugacuucuuucucuauuuguaucccuuuaguuuccaucuccuacccuguugcucuagcuggugcuuugagcacauacugaaagugaguagggauaguggacaucucugucuccuuccugauuucugucguaucgauucaagcguuucuucauuucggauaauauugucuugacuuucugacauacagccuuuacuauguuccagccuuuauuuuguugauuauuaugauugugagauuuuggucuuuauguccacuuaugugguuucuuauauuuauugacuuggauauauugcauuucagggauaaagcaaacuuggcugugguguauaaucuuuuugaugugugucuguguuugguuugcaaguuuccuuuuaacuaugagcaguaagugcccuguuuaccauucguucugucauugacugguuggagaauccagucuuguucugaauuuaucuguaugguugcuuguaauuuuugccaggccauuuguuuaggaaugcaggaggccucuacugcaugguucaucauuucucuuguagcucugugugauuuccauucugguuguugguauucacaguaaggauuuguuuagaccaaggcacugcagcugcuccuuggaccaaugaccuuucucuuuuucucacuuucaaacaggcuuguguuuuuguaaauaucagacuaucucugcagaggguaaaaaguccaaacagaaggaacaaacuaguuagaacaucuuaucaguguguugggggggggguggucgguggcuggagcagauagcagaauugguuuccauggucaccaaaguguguguguguguguguguguguguguguguguguggugugccuuucaccaugcucaagacagucucaguaguucucccucaguugggcaggucuguucauaugcacacaugggaggaaucagaugcauucuuuccauugggaguguguacagccacuaugugugcaggaccuugaaggauugggucacuggacucugaagaugucucagggucuauguagacauguugcaacacgguuccuaucccuuggaacauaagaaucuuugacaagaauccuuguuaaaaaucucaguuuaaaaaugaaucuuggaucuggagagauugguuuagcaguuaagggaauauacugaucuugaaggagacucuaguucaguucccaacacccaugucagagugccucacaaccaacuguaaccccagcuucuuggggacccagugcccccuguacaugcacacagagacacacauacauacauauaaguacaaaauaaagugcaggccuacaaugaaacuuacacuuuuccaugaaaguauuuccaagcucuggaauauauuuauucagcagugcuuuuuaugcaauaugaaaaacugguuaaaagcuaugugugguuuuuaaaagcuuaccacuuuaacuuuuuuaaaguguacauuucagacacauuaggcaccugcagggcauaccacagccaccuaccaacuccuuccagaacuuuucucaccccacccaaagaaaacaccucaccccuuaagcaggcacugccuuuuucuucuuuccucaguuccuggcaacugcugagccaccuuuagccucuaccaaagcuucuacaggaagcuuugggcuuccugggcauucgguauaaacggggccauuggauguuuguucccuuuguguuccuuugguugugucuggguuauuuuuguuagaaccaucuuuaaaaaguccauccauaugguuguaugugucaguaccucguuccugaucuguauaaacuaaauggaaugauauccaaugacaugcaagaaguuuaguagagugauaguccucuguaugcacgcaccacacuugguuucuggguccaucagcuggugggcguuuggacugcuuucaucaucgggcuguauaaguauguguauauccacguuaucaguuuuugcuaaguacuuauaauucuuugaguacacauccagacauuaagcaaaacuguggcauugccagcguugugugcucaccuuucugaggagaggccagauuguuucccacaguggcuuugcuaguccacguguccccccacccccacccccacccccccaccccccgcagugaagguguuguuuuaguuuacaacuccuuagugauugguaacaaccaacacauuuucauguauguauacuuuuuuaaauuuuauuuuauuuuuauuuuuucgguucuuuauucauguaugcgcacaccccccgcaaacaugcaaugcuugaaaagauguugccuggcgaauucagguuguguuccgucggaauuuguuucaucuagaaaaccuucuguacuuauucuuugaugguuucauacaugucaacaguauauuuugaucacauccaucccucauaucccucccacuccuccuggaccccacuucauguucuucauguucuucaugaucuucauguucacucuuuuuguuuaaaccauucacggaguuucauuaguaccacccaugaguacacagguauggggccgucagcuagagcaugagugauaucuuagcagccauaccuccaaagaaagauggcacuccuuccugagcagcagccaacugucaaauugcuccucagcccgggugagacuuugugagccugucuccccuccguucucaaugcugacuggcuugguuuugcauggcagacauagcuggggcuaguucacaggucuaacagucaugacgucucucgacacuucucuucacucucccagugucacagucuuucugccccuuuguccgugccacugccugaguuuugaggcacuugauguggauaacucauuugggaccaagcacuaaauagucacuuauucuuaguggcucugaauaguuacauuggaugcugcccacugcacaaaggaacuucucuagccaagacugggagcagcacuauucuguggcuauaaacaaaaauauuuagaaggcagucuggaaacacgucaauuuaggggaaaaaauguccuggguuuccagccagggcuugcaacuuuugcccagguuuacaauagcagacacaaaucugcaccuguggagcaggucucaaaugcaagcagagagaagcugguuacagacauugcugucacacugcaccaguggacacguucccuggcuggucugcauuauagcauacagaguccagugcuggaccacugacaguuuaagacacugauguguuuccucccuggcaucucuguagcaccuugcagcauucugaaaucuaggcaucagggaaaccuucccaucaggucauguccuuuucauucacauucauuuucacaucaaaauaagagaccucauuaaguaauuuugcucucggauuuuucaugcacauuaaaaauuuaaaauuccacucagcccccuucauuggcccaccugugggcaacacaugcugaacagugaagaauaugaaaauagcuguaacuuucaguucuucuuuauuaacugccuguuauaaauacagucaauuuccccucucuaauaacaguuauggaaacucuccagcauuuugaaauaucgucaguucagucucugugagugguuuuguguagaguucucaagucccuuggagacagcugggucccuuucuagacucacugugugagaucaggugguggaaauucccuccugaccuucguuuucuuccccacuggaugaugcuggcaucccugguauuuagaaauuaucuggaguccccaaaaacuugaaggaaggaaggaaggaaggaaggaaggaaggaaggaaggaaggaaggaaaagaaaaaaaaaacaccucucccccaaccuccaucacauuccugggcuuuaaucgccauagaaucccagucaacaggacagagaauccaaaucuaaaaagaugagagacugugugugggguaauagggggucacaugaccuuggcuuugguuuuagauacuucgacccccaagaauuccuugguaaaauaauugauuccuuucuucaguuccucacuuguaagauugaaaucauaaguuuaacuccuuaggcaauaacaagaaacaaaaaugagucucaugugcacgugcacagucagauguucggugugcaggcauguucggucugcaggcauggucagagggcaggcauggucagagggcaggcauggucagagggaaggcacggucagagggaaggcauggucagagggcaggcauggucagagggcaggcaugaucagugugcaggcauggucagaggccaggccuacccaccuuccuuucacacaugggauuucacaaugaguaggaccuuuuuccuggaacauuaguuucugcaugucuuugcuagauugaucgaagccauugugaguuguggucagaaagguagagucuaguauaaaguuuauauugaaauuauugccaagcuggauaucuuugcauuucuuucuacuauguccaagacaguaccuagaccugagagggauuagaacaguauaugcacgugugcacacacauacaugugcacacacacacacacacacacacacacacacacacacugcaaaacugaaguuacuuguuuccugaagcagugguuuccaauacacuagacauuccuuuagcagcaugacaagaagaaaugauaaaaugcuuacuagaaguuccagccagaggcucguugucagucgaaaggcaagggggacauagaagcauggaacaauacauuguagagaaaaucuucaccuuuggccuuauaauauacguuuuuguuuuguuuuguuuucugucaggccaugcaaaauucuaaauuuccuccuggucagaucauuagaauuagggacccaguggggcagugggauuguuaaauuuuauuuuacuugcauuuucuuuaaguugugugugcugcauauguacagcaugcucacgggguuccuagugugcauguauaauggccguccucaucaguagcucugcaccuuagauuuugagacagugucucucacugaaccuggagccuacugacggggcaagacugagcaugcgccaggagucuucuggucuuaacuuuagcaggacuaggauuacaggcugugcuggauagacuuaugucaacuugugagaagcuaaaaaucuucugagaagagggaaccucagauaagaaaaugccucuggcucucuggcuauagacaaggcuguaggaauuuuucucaauucgugauugauaugggaggauccaacccauuguggguggugucaugggugggcuuguggucuugggcucaauaagaaauuaggcugaacaaaccaugaggaguaagccucacuccuccauggccucuguaucagcucuugccuacagguucugcccuguuugaguuccuguccugacucucuucaaugauaaacauugauacggauguguaagccaaauaaacuuuuuuuuccuacuuuggucgugguguuuuaucacagcaauaguaacacuaagacauaggcacgcacugcaccuagcuuuuuauguggguguuuacacuuggguguucauguuugcauggugagcacuuagccaacugagccaacuucccagcccaggggcuugucugacagucgacuucccugcagacacucaacagacucaguuuugcuuagcugugaaguugagcacuagaacuuuagaugcagcccaugugucuucagucaaagcccaugucuugcuucaguguggaccuaacuuuuuuuuuccccuuucauuucaggagaagaagauuuuccagauccccuggaugcaugcggcucggcacggaugggacguggaaaaggaugcuccgcucuucagaaacugggcgauccauacagguguuaaaccuugccuuguuuauucacacaguugcuguuguguaguucuguuuucauuauacaauuauccuggcucaugaucuugugaggauagcucugaaaauccccguggucuaggagauguacgaguuguauagacuacaucccucagaagacgugauguuccagccaucccagaaguucccagucuuuaaauuucccauagacaugguacucugauaaguuccucacggugaccaggggaaguuagcacuauuaacauauaguaauacauuuauuuauuacaaaaauucugcaaggagauaucuuuagauguggaccuuuuauuucauauuggaagcucgucucugcuuguuggcauucuagucuuguguauaguuggcaucucaauucuaccauuuuauuuucccccucaaacuauaugguagagccagagugaccaucuugucacggcguggcuuccauugucuaggcuuuuaaaaauaaaaugccagcaccuuagaaaugucucagcaaaaugggauuguuccagcaaagcaccuagaacagaaaggcuuuuugcaccuccccuccuucccagcaggacugguagacauccccuccuugucuaaugucccucccccuuuuccuuaucuuuggcuauuuugcuaggaaagcaucaaccaggaauagauaaaccagauccaaaaacauggaaagcaaauuuucgaugugccaugaauucccugcccgacauugaggaagugaaggacagaagcauaaagaaaggaaacaacgccuucagagucuaccggaugcugcccuuauccgaacgaccuuccaagaaagguaaagauguuuaccgacuaaauaaacgaacccucaguguccguaacaguaccauuuugguuuucucauuucugccucugucaucacuuuccaggguagaauacuuguccacucuagaugagacaauccucucuuuacuggccuuggaaaaaugacuuucaaggcaccaaaggcagaaaagaggccuuugguauuuugaucucauaucaaugaggcagcggguuucagaaagaaugucauguaagaacguccauguuucucuguccuuccgugaauugauccagaacuaccuuucuguugccacaggaaagaaaccaaagacagaaaaagaagagagaguuaagcacaucaagguaaucuuugguugacuagaaagccccuguugugaccguauugucaugguaccuguucugucucaucaggaccuuggcggaggcuuuggccuuucuccugcuauugcguuuuacaugcuuuuaacaucuccucugcauggacccaccugcagacacaaguccacagauacuuugccuaguccagcgucccagagcaaaagguguagaugaugccacugauccgcagagcuuggcagucccaugucucagcuccagacaccagcuuguaucuaaggcugugaaauaugacuuuagaaacauguuugaaaaucagagaaaaaaauuuuuaucucuaauagagauguauuagcucuauaucugucacaagccauuagguugggaacacaguaguucguauacuccauuagcaagaguuucagugguucauucucugcuuugugagcgauaagucccaggaguuuuccauggagacaggucugugggcuuaagguuuucaguugacuagguuggucuaaccacaccccuauauuucaaugaucuuagugcauagaagguguaguagcccuuguuaaauacggaggaaggugucagauaaucccaugcccgacuggggagguccaucaguuguuaagcaaagagcacacagcacagcuagagacccaaagaccacccaagagaugauauaagugccuggcuucuguguacagaguaagggacugaagaaugaguugacuggccuuucuguaagaucccauggcuccuuagcacugaaauugaaguggauguaggacauucugauuuaucuuaaaaaaaaaaaaccacgaagggacauaauuuagguaucucauuagacuucagaagggacagcauccugugugugccaugaggguacuuggcugcucuccaggauucuccgccccugccagguaccuucauggaaaauguaguagugucuguguagaaccuauccacaucuuccaucuacuuuaaauuaccccuugguuacuuuuuauaccuaauaugauaugaaaguuguuguguuuuaucauuuagauaacaauaagaggaacaggucuauauauguuuuguacagaccagugauugguugaauaugugggaaauauguaggucuagaauugugaauacauauggcugucuguuguuagacuuuuuuuuuuuuaaugugucuaggcugccuacauguaugucugugcacuauguacuugccugguaccugcagaggccucagaucccuuggagcuggaguuaaggacaguugugagccuccagguagaugcugagaauugaacccggguccucucagagaguagcgagugcuaguaacucuaaagccauuucuccagcuccuguaguuagagucugagggaaaucuuagcuagcuguucaagguugagaggugcuuaucucugugauggaaaauaaauauuuuagguagacuagcagugacacuuuguuucauuuuugauguuuuaaaguuucugauuuauuuuaaaaauagcaccggacuggggacuggagaggcagcucagugguuaagacugugucuaggggaccugaguuugguccccagcaccuaugucagguggcucccaacuaccuuuaacuucagcuucaagagauccaaagcccucuucuggccucuacagacauacaccucucucucucucucuuucucucucaaucucucucucucuuucccccccccauaucccucucucucucacacacacaugcuuaaauaaauaauucaauaaauagcauaggacuaaugauuaauuuuguuguaauuuuuauuguggaaaauuuuuauacauguaggaaggaguaagauuuacuguagaucacccucuaauuuuaauaucaaucaauucuugaccagauuugcuucaucagugcuuccauccuuucccucacuuucaauaucaucauagauauuugacccauuuugacuacagaaacaauuugugauaguugucaaaauauuuucaggcaaaucucaaauaugauguuucuucuguaagcauuucacuauauauuuuuaaaaguacaugcccuuuaaaaauaccaugcugucauuauuuuagcugaugaauuugacaggaaucccucuguaucguuaaauaucuagccaaugcucaguuuuccuauuaucacagaaaugguacuacaguuuuauauacauauauaucuguaauauaguuauacauauauacguguaauauauauuuuauauaugucuauuuguaucuguaauauauauguauauauuaccuuaacuaauacccacaccaucagcugggugugguagagagcacauaucuguaaucccagcauccaagaggcuaaguuagggagaucuugagggugauuguccugcaccauauaauuugaagaaaacuuuguuucggaaaagaaagagaaauuuaccugagaaccccauaggaacuuuuugcuguaucucaagaauuuuucuuuuuuaaaaauaauaccuuuuaaugguuuauuuuuacuuccugugcguugguguuuggcguagguguuguccgugugaggcagucagaucuggaacuggaguugcugacaguugugagcugccgugugguugcugggaauugagcccagguccucuggaacccagaauuuucuuucuuccuuccuuccuuccuuucuuucuuccuuccuuccucucuuucuuucuuuguuucuuucuuuguuucuuucuuucuuucuuucuuucuuucuuucuuucuuucuuucuuucuuugcuugcuugguugguuuuucuuugagacacagugucacuguguagccuaggcuagccccagacuugcagcagcucucugcccucagccugucuaguacuggaucauggaccagagccaccacagccaccacgagugaccuugcuuucagucuagggacauuuucuaugucucuuuuuauaaaacaaaacaaaacacagcauuauuuucucccuaugauuauaaaaaaacuaauuauuagccauacuguuuuccauggugauauuuuuagaccugcauuuugagugucccaaauauaucucuacaucucaguaagagauguauaacuuuuuuuucccaccacaaauaccuaguuugaagaauucacuguacucuuaggugugauugucucauauuuaguauguucacagcauucagugacuagcauagagcaaacuauacauaucugauaacugagugggagcaugaacauuuauuaaaaacgcagauauauuuauucuguauggugggagucaggggcuuuacaguacagauuuaauuucauaauugcagcgaguagaaaaacaacagcagaauaacauuuacuuuucacuauauuuuccccacacguaaccacuauauuccauucaguaucaaauaccaaagguuauauggcuggccguuacguuaugucucuuuaagacagacacacuacuuccggugaagcagucaaggcugagacaugcagcaucccggggcuguaggaauguaaggaaaugugcuuccuaggguggguggcauguggggguccucguaagaaaaggguagcuuugguuacaucagccucguggggccacuaaaaugugguaggcacagcccuggugagacuuagccauguucauccaggaagugagcggccuuaaaugaagccacguggguggagcuccugcucaggagcaucuguuaugaaauccuuguguaacaaagcuaugauuaacacuguguuccucaagggacauuguuccuucagcggaaggcugaugaaucauacuuagugcagccuaaccuuuggauguagcuaucuuuugcauuugucuugcaugcaguguuauaguagaacguguaucaggccgguggguuuuucccaauucugggguuuauaguugcuaaaggcauugaucgaucugcagaaugauuccaaaguuaauuccacaauggcuuugggaucauuacaguuaaaagauugucuuuaauaaaggauuaauagucuacuuuuuuguuaaaagucuaaguauguaagcugugccagguuugauggcauaugcccuguaauccuagcaacugggaaguggagguagagggucaggaauuuuaagguaaaccuaggcuacauaggaaguuugaagucagccugugcuacaauaaauccugguucauaaaauaaaacaaccaccagccauacugggccauggacacauucacuguauguuccuugcuguuucagaaaauaguuucuccaaggauccguggagggaggacguugucagaguuaaaauggagucacugggcaugguaguguuuuccugucagucuggccuugacaaggcuggagcagggggauauuaaguuuaagggaagucugggcuucaugauaaacccuuaucucaaaccaagaugaaguugguugugccagcucuucccaaagucaagggguuugaagaaaaugcuuuuuaugcauggauagcugacaauaaauauguucuaacuuuccuucauuccaaccuguguucaucuaaacacagacaaauuccaccucaaacagaaacugggguguuguaacuggcuuggcagaaaugaagguauuuuugaagagaagugaacagacaauucaaacaguggaccccaaagaaaugggacguuuccccagaaaucucuugcagggagaaggaaaagcccccaaccaauggggaaacuugucucccagugagauuucacaccauccuaauaauuuguuagaccacgcuuucaucucgaagccuguucugcaagccauguuuggucgcccauccucaauagccacuuaaaagagccaaauuaauaguagaaaacugaaaauugagauuuuuuuucaauaugacaacauuguggagaagaacagaaagauccgguaaacccucagguccaucuuuaagaaccugaaaggccaccaucuucagggucccgaaaggcaauaaaaguuuaaauagaagacagagaacaugaacaucuaucuacacagugcuggucaaggugugguccugcccaccacugacccaucauguucugggcuucaguuacauuuuguaaggccaucuaauuggaagagcuacaccucuaaaauaucuucauuuuuaucacugucuaucugagaguauauucugugugcucagugggccacacaucacuaaaauaaacuaccucuguggcgcuaccugucugaccuaagaaaauuagaauaagagaaacguuaguaagcagucucagacugaacagugaauguaugcguuucagaaaauaccauggaacagauugcccugguacaacagauugcucuguuccauauaggcaagaccaaggacgauaaggcuaacaguaggcagggugguagguguugacaauuuuuaguuccucuaaaugauacuauucccuuauuuagcucuuccugggauggucagaguuuuccccuuuucccuaucuaggaaguacaggcauaggggaugagucauuuucccaagauggcauggcuuucuggaguuugagaacucuucugggagcugcagaacuugagccugacccuggggagggaaauguggcccagaucagauaaugcucacuccuuaggaagggaugcuucaugagugaaggccuagaggucagcguuauuugguuuccucugaaugaauauggaaacuggcuuaauuuaaucaggggcauuguguggagaacaauggaaaauaaagaugcccagguaagauggauaugaacgagugcuuccugcaucagggggaguggggggggguugguugcagaugaaaacacaagcauuuccaaaucaacgcaucaguguucccauggaaaccgaauagaaaggggcguaaugucauuugguggaagucacuggucuguguucguuccgagggcagccaugugguuagaaauuacagaauagcugguguccauucugcagaccuuucucacaagacuguuuccugcaacaguacauuccugauuagacaggacgauuggggcagcagcagcuccuuccuugcuugggaaaacucuucagguuuaagacuaugaugaccagggaaccuguaucggagggcgacuugaaaacacaucagagcugcuuuggauaaagccagcuaggaagaugaagcagguuaggagcuauccaucacuggccauucccaccccccuccccugcugguggacuaagucacuucucuggacacagaaagggauagcuuucaucuuagaggaaagaaaacauaguuuauucuagagcuaaauuugagugaccauggcucuggaacaccgauuuaggucacuccagauuccauguuccaccguggaaacagcuuugugagguuuuauaguuaugcagaaucaagaaaguccugucauggcaaauuuaaaccacaucggugggugccucagagaggcuuucucggugaucaggggaaccuuucccauaggccucauaucugauggcauucuuacuuugggaguuguuagaagcuaguguugugcugugaggcaacauaguucaaaaaguguuuauugacuagucccaccauguugguucugacacagugugggcaaggauagcuauuaaggaagcuaaagcuagcucaagaugagcuaauuaguccuacaccauuucagucuccuuaucuuacugaaguucuacucaguguaucagucucuuuagaugcagcuccuugccaggaagucuuguuaacacuucuuuaggaaaucaaguugagcuacuuggggcaaagguuuggagcccaguggaucaagguaaaaggaagaaaauggcagacugcacaguaacaaauauagacaaagauggugaccguugggauggagcccaggggacauugcuuccgaguauggagcgugaagacaggaguaguuaaaagaggaagauacagagaaggaauacuaggucuggagcuuguuugugagugaaaugacaucuggcaagcagaugucaugcugagugucugaggcccaaaggugugacccuuuacuccagaaugacauuggaagucuugaaaacaggcccuuuuccaagacagaaauucuccgagauguagggaaagaaaagggagugaggaauuagccaugggaagcuggucaguuagagaugaguaaagauggccuuccuucagggaaggaaagguggaggcaggcuggaggcugcuuggcagcauuuguucuccaugaugcuauggcugcugaggugaccucugcacccucuagaguucugucucugccuuucuucaugaagcucagccuggcccuuuucacagagaccuggaggcacucuuagaucugagguccucagauugacuuugagagaguaguuugagauaggaggucgauaggaaugggaaauauacuuagugcccugggcccugggaggauggaucuagacacaaugcuuuagcacagggaugaggcagaagagacuuagagcagagggguaagguguuccacucacugguuccucuguugcuuucucucacaagcccagcuagauggcaagcccaucuagcaagccaaggccagagaccaaccaaagugacccugugucggguguuaaggauagccaucagucacccuuaaaacucucugcaguacccauuuccuuuuacuuaaaaaaaaucuuuuaagcuacaccaggucuagauuuuguaauuacagaagaugccuuugagccuaaauauuuggcaggguuaauuuagcagugcagagggaaucuaccugagaguggguuacuuguuuguguuuguuuguuuguuucuuuguuuguuuuuguuggagugaggccagaggcuuagaaaccaauguagccccagguaagcugauuuagaagagaaccucuagcaugaugcucaggucucaaugggcuaggccccagugcagggguaaagugagggaguauugagccaggcagagguggguccccagagauaaccaggacaggccauccaucuuuuacacugccucugcauguucauagagaaccaucaccuuuucccacaguuuggaacccuuggguuuuuaauguuauuuaggguuuuuguaaagaugauuguauugccuuauuuaguaucuguuuguaugucugugcaugugcccaaacauguacaguguguagcgccauacacaguggaggucagagaaccccgugccucuuuuauucuuauuuuucaaccucuuagcuuuugauauccccauuucuaacuguuucaaaagucuuggcugaguucuugaggaagcuuccacacccuggaaggagacuugucagggagcuagcacggcacauaauguucuauaugucaccaucuuguccacuggagcacugcuucucagccuucauaaugcuuugacccuuuaguuccucguggucuggagacccccaacaguaagauuauuuucauggcuacuucauagcuucaaauuugcuacuuuugugaaucauaauguaaacaucugauaugcaggauaucugauauccaaugaugcgaagggaucauuaacuuccccaagcaggucaugacccacagguugagaacggauucucuggggugacagaaccaaugagagucuucccagagugguuguaggaggaguaagacauuaguugaguguucuaccucaggcaggacaccagguaggcagagagaagcagcagcccacuccauccauccuguucuccaucuggaugggugcagaagaugaggcuccugcaucacaccaggcuaaaaguaucaugaucuuggaaaaugaacuuagugaguccuaauuuugagaagugacaaaagugucguuugucaccaauagcuacacuauagaucaugugaaacacuuagaggucucuguugcaaagucggaauaguucuauuuucagauaaacgcaaaccuggcuguucuguuacuuugauaagaauucuagaaauagaaucacggguaagaaaggaaacaaaaggagaacgcacaaaagcaguucuuccagcccuuugucuagaguccuguacuuaguuuucuuggggaggaauugaggaaagggcgugccauaauggaacguggaccaugauugcggagggaaaaauggagcagggaccauugggagccccaaagaaaagauggcgcccacggugaggugcgcaugugcagggucugcaggugauucaggcugucaagagggaggcaaaguccucgcuguccuguggauggagcuuaggggaaggggcuugagaaaggacccuuggauaugggaagaacaguuuaacuggugaccuucgaugguagcgaguguucuuuaagaauaaaugucuugucuauauucgucuccuuuaagcuucuccucacccgguggcaugguacccauuaccauucucagccgccauguggcuaaaaugacucaagaggaauuaaaggguuaaauucagccugugagaagcagaggagccaggcuuggucaccuggucugauuccagagucaucuucugggggcuucauucugcagcuggaggcaggacaggacuauaggccuccccaagggugugcuugaggagguggagggagccgaggcaggcauuugucuagauguuugacaaucaaggaagggaaacugguaagaucccucccccucuuccugaaagaacaagccuucucuuggaacuuacuaacaagggggaaaugcaagacgcugagagaaaggggugaaauuucuguucaguggcucugcccuuggguguucuggguauuugaccuaugguauaguggguaaacccuccaguuagggcuuuuuguuuguuuguuuguuuuguuuuguuuuccuuaagcugagcugagcaucgaggugaugcccuucagauaaaaucaucaagggaguuugccagaggaucgugaggacuauacagaguuugaucucaauuccccagugugaccaauugauaagaaugcccuggaugccuuagaaugcccagcacuccugacuuuacugcuuuacccacaacgcuccucugcuuacagccccuaucuccacuuucuuccuccagcuauuucuuccauuuuggauuccucgggaguuguccgacuauguggcuuuugucuggcuuauugcugucucugaaacaaauguagucuuaccggaaggaaauacccucaucaaaguucugagucucaaucauacuuuagaacugguuuucuuugguugguuggucgguacucucaggagauggaggguucaaguacacuugaaugaagaacagauacagaguucaaacagggaaagaauguauucuccuuuguccucgucagugucauuauguaguagccucuugggcugggcgggaguuuuaggcacaggaaggauguugaugugacgguguggaggugggauuaccugucuggugauaggccagugagaggagacuucagcuaagguuguggcucauguuaccauccagccaccagugcaguguugcucaaguggccguagcacaugaugaagugugcucaaguucucacuuccauuuuccuuggagcuccggucacuggcucaucaccuaggcagaguucauuuuaaagaagugauugcaaaaguuagaagcaugccuucucugcaggaauccaggaguggguucuccugaguacugccucagagggggaggaggcucaggacccaggcaagggacgcacagaacagugcuacggcuccguccaaccacagaacagucuucuguguaucugcagcugcagguauuucccgagggcaagccagaugugcugagaacauuuccuuggaggaaaaaugaaagaaaccgaauagcuagcuucuuuaaugucaggcugauuuaaagagacaggggaugcauuugggacaugacacgaaugacuaaccccaggauucaaccaauuagacagggggagaauugaagcuaagaaaggggagaggaaggagguguucucaauucuuuuuucuuuucuucuuccuagcaagaaccaguugagucaucuuuggggcuuaguaauggaguaaguggcuuuucuccugaguaugcgguccugacuucagcuauaaaaaaugaaguggauaguacggugaacaucauagguaaacuguuuugacaucuucuuuuuauacucacgagcagccucugaggucuaaacucuguacaaaaaaaaaaaaaaaaaaaaaaaaaaaaaacccaguaaucucaaaauaacacagucaguaagaggaggucuuggaacguguccaaaucccagugcuagccccuagguuucagagcuuccacaaugagauaugaagguuuguagaggagugagaaccaagaaaagaaggccaggcauacaagcuuccucucugguggcuagcgguuagcagcacuucaucaaucauggccagccauguggacaaaaugucauuuguuuaacuugggagccaaggagaggaaagaccaucucuguggguccccuuagcauugaccuuaugcacaucugcccagagguggcacacauuucauaggccaagaaacugaggcacagaaacccucugucaaaggacugacuggcucaguagauuugcagagacuuuuccacccucgagaugcaguucugggaaugaaguaaacagggagcgaucugggcucuauuccuacuuuuguggggagcgaguaaacaggcaaagccacagguaagcaaaggauccucauuuguagucugugaugcaaaggaagaaaagggaggugacuaggaauuaccuagaaacuggauuugcauggguugggaggguguccucagaagagugaccuuccgccauagugccugugugaggaggagcaggugacaugcggaggcaggcaggaugcugacagaaacccuacaaaaaagcaucugaaggaacagaaagcagccagugucacauaguuucagaaguauggugacugcucaugacauccccucagagacagcgguucuuugauggcuguugucagcuugaccacaucuggaauuaacuaaaacccaagcagcuggguccaccugugagggauuuuuuuccuuaauuaaauccuuuaaaacaagaggacccacuuuuaaucccgauuguuugaggugggacaguccaccuuuaaucugggccacaccuucugcuggcagccuauaaaaaggacauggaagaaggaggaucuuuaguuuuuugccuccuugcccucacccucauuggcaauuccauuccuucacuggcauuagagccacuuuuucgggauucugguacacacugaagaacagcugagauauccaugcuuauggacugaacaaaugcuagauucuuggacuuuucauugguagacagaccuuaucgaacuagcuggaccacagucuauaagccacucuaaaauccuuuauauguguguauauacaaauauaugucugcauauauauauacauacacacacauauauauacauguauauguguguauauauauauaauuuuuuucuguugguucuguuauucuagagaacucugacuaauacagauuuuagaaucagaaaucgcucuagaacaacagaaguauaauaugcauuuuuaaaauaucuggaauaggcuuuucaauauggcaauaccuacaguuauugaggccucuccugggaauucaaagaauauuaaaaagaugugaacuguuuuauaaacugaaagagaugagugcauuuggguauccuaauucaccaguugugagaggcaacagaugugguggcccaggauagaaaacguuugacaguuuauggaaaaauaaggaacaugaugauuguugaguaccccuagucucucuagaucauuuaacaguggaaaauaaugagcuccgaaauaaaucuaaccaccgguuagugucucugaauagugugcagaacaacaguguaaagcugaccagcuccaaaugcacagaaacagccuaaagguuucuaagugugccccgguagagaaucgucucucuggcagccacagagcacaaguugcagaaaaccaaaccaaaggccucauuguaaggaugacugaguaacagugaaaauucaagucccagucuuggaggauguuggaguaaggacauuaauuggucaagaaccggauccuguaacuugggauggaaauauguggggagacucaauugaaguugagaacuuugagcccucagguucuugaggguuuauuuuuaccugaggucuuagucucucuacccucagcagauagacucacacuacccccucugaaauuuugcccuuuuuaccuuugaccaaggaaaugaaucccucauugucugcuaaaccagcaguaacuuucucugaaagagaugccagccaugacaauacuguugucccucagggcccaccaauacuuaccucuagaccuauaaucagacuuaaggcuaagcaggcuccuagaagggagccggaauguguggaucacaaggaagugcaccccauacacuacuaaagaguuuaacaaguuugcugaucguuuaugcagaacucuaggaaauaugugugggguuuuuugggugugggauaacgcaggaggaacauaagacugaguuuauugauacggucccucugaagggagguccuagguuuaauacggaaguuugcucaguuaaaaggacugugaaaauuuuguuugaaugguuggugaagcacuugucaaaagauggccuaucaaggaggaauuggagacggcugaucuuccuuggcuuaguguuaaugaagggcuuuuacgacucagggaaauugcagugcuagaguggacaugccguccuucacauaggaaggcccggaagaugcguucuucacuagucuuauguaagacaauuaaauuggugagagggcccuggcauagcugaagagcuuuguuucccuuuuucucgugucagaucuuaggguuggaaacacuacugcucaguuggaugaauuaaaugcaguagguuuaauuggggcacaaaggggcaccgaauagccagaggugaggugauuguaguuaucaccagcauagaccaagcaauauucauaguguccugagcuauaaugggcgaugcagauaaaguaaauuuuauaauuagaugacucauguggacuuuaggugcuggcuaaucaauaugguguucccaggcaugaaguagauaaaaagcccacugcauuuguaguuacuaugugucaguggaaaaauucucaaacaaaugaaggaaagguuacaauggauaguggcaaaaggcaauuccagccuauaaaccaguuuucaggcuucagcccguuugcagacccagaacccuuggaaugaagcgauggccccuaaggaaggaucuugauaaaaggaguuagucuuucuccacuccuuccccccagaaggauauauggccuuuuaccagggugacuguaacgaucagaaaggaaacagucagaauuuccagggucuauuggauacugguucugaauugacacugagucugggagauuucaagaaacaugguagcccucauguuaaagaaggggcuuauggaagucaggugauuaacagaguuuuggaugaaguacaacuaacagacccaaggggucccugaacucauccuguaguucauuucccagauccagaauguguaauugggauagacaucuaaauagacguugguaugauccuacacugguucccuguggagugagggauauuaugguugaaaaggcuaaauggaagccauuggaguugucucccccagggggaaauaaugaaucaaaggcaauuucccauuccagaaggaauugaagaaaugagugccacccuccaggacuugaaauacacagggacggugguucccaccgcaucucccuuuaacucuccuauauggcuagugcaaaagacacuguaucauggagcaugacuauugaaaacuuaaucaaguagugacucccaauuuguagcaucuguacuagaugcgguguccuuccuugagcagauuaaugcagcuucuuguacaugguaugcagcuguugaucuagcaaaugccuuuuucuugguaccuguccgugaggaccaucagaagcaguuugccuucaguuggcaaggccagcaguauaccuuuacgguuuuacucaaggacauaagaacucuacagcccugugucacaacuuuguucaaagagaucuggaucauauuucucuuccaaaaaaauaucacauuggugcacuauauugaugaugauaugcugacuggacucaaugagcaagaggcaacaaccacuuuggauuuuucuguaacacauucucaucaaaggaugagaaauaaauccaaccaaaacuucaaggaguccaauggugugugucauguaaagguauucuuucguaggugaggaauaaguuauugcacucggucccuguuaccaacaagaaagaagggcugaauguuaugacaguuagugggucuguuuggauucuuaagacagccuauuccucauguggguauguuauuccagccuguauuccaagugauuuggaaagcugcuagcuuugaaugaggucugaaacaggagggggcucuucaacagguccaggcugcuuuacccccuuggaccauaugauccagcaggcuuagugguacuugaggugucaauacuguuuggagccuuuggcaggccccuagaggugaaucacagaagagaccuuugggauuuuggagcaaggcucuaccaucaucggcagacaacucuucuuucucugagagacaguucuuugccugcuguugggccuugguggaaacugaaugcuugacaguuggccccaaaguuaccaugcagucugaacuucccgucaugagcugaguguucucugaugcaccaaguuauaaaacaggguguguacagcagaaaucugucgucaaauggaagugguauauaugugacuagaccuaggaaguccuaaaggcacaaauaauuuacaauaaggaauugcucaaacaccuaugguuucuacuccuguuacagugucaucucuucccaagcauccacauagagccucauggggugugcccuaugaucauccgagugaaggaaagaagacuagggccugauucuacacgcuaugcagacguugcccagaaauggacagcuguagcauuacaacucccuuucugagacaacccugaaugacaucagugaagguacaucuucacaguaggcagagauuaggguaguccccauggucauacaguuugcuuggaaggagaaaugaccagaugugaauugucacugauucaugggcuguagccaauggauuggcuggauggucagggacuuggaaaaggcaagguuggaaaauuggugagaaagacauuuggggaagauguggcuagaucucuccaaacggggaggcuaugugaagauacuugugccccauguaaaugaucuugaaaggugacuuuggcagaggaagcuuuuaguaaucgaguacauaggaugacccauucuguggacagucagccucuuucccuagcuaucccuaucauugcccagagaacccaugaauaaaguggcccugguggcagagauggagguuauacacgggcuugacaaggacuucuacucucuaaguuucaccugacuacagcugcuacugaguuucauaucuaucaucagaaaccaacacagagucccagauacuacaccauccccuggagugaccagcuaaugaccugguggcagguugacuacauugggccccuuccucuguggaaaagacaaugcucugcccuuacuagaguagcuacuuauuaugguaauggauuugccuuuccuucauguaaugcuucugucaaaacuaccauccauggauuuacagaauacaucacuuuucuaccaccacaguauuucacauaguauugcuacugaucaaggaauuuaacuuuacagccagagaaaugugauagugguaccacaauugugguccacuggucuuaccgugucucccaccauucugaagcagcuagccugauaguuaaaauggccuuuuuaaaaacacaguuguagcauuaauuagguggcagaagucugaaggucugggcaggauuccccaaaggugcuauaugcuuugaauuaaugucuaagauaugguacaauuuucccauagccaggauucagaaaucagaggguagacaagguaguuccacucacugucaacccuagugacccauaaggaaaaucuuuacuuucuguucccauggccuuaaagucugcuggcuuagaaauuuguguugcagaugggagagagcuccugccaggagccacaacaaacauuucacugagcuggacucucagacucccuucugccuacuuagggcuucugaugcccuuaaaccaaggcuaagaaaggaauaacauuguuaggaggggugauugauccagauuaccauggggaaauuggauugcuccuccacaauggaggcaagaaggauuaugucuggagugugggagauccuuuagggcaucucuuggugcaaccacauccuguuauuaaagucaauaggaagcuacaacaacuuaauccaggcaggaugacaaagggcacagacccuucagaaaugaaaguauggaucacuccuccaggaaaaaagccaagacuuggugcaggucuugccaaggguggaggaaauacagaauggguaguagaggaagguaguuauaaauaccagccaaggucaugugcccaguugcagacaugaggaugauaacugacaagaguauuucugucauauuuugguaagaaggcauuugugcauauaucugaguuuucuguccuugauuucuuuaucauguaauuuaacaccaauuaagagcauaucaguggucauaguauuuaaguucugagaucccaaaagaauguucguuaagacacauugccaccuacugcaaaauacuuuaauaaauuuuaguauguaaauacucacuuuucuaacaauacuuaacauuuuauuucuaaaacaaaguauuauuuaccuuuuguuuuagauaagauauaaauuuuuccuuagucggaauuauuuuacuauauuuuauuauuaaaauaaguuuuaaauuuaaauauauuuuaucauauuuaucucuuucccaagucuuuuuacaucccaaguuugugguuauauaagggauaauuauaucauaauuaugaccugguuaaauauauaauacauuugucauuauauguaugauagucauaucauguuauguauaauuaugagcugguuauuguuuucauuuggaaauuaagcacgacauaagauacgauuucaugucaaguuaacuaggggugaacuuuuggugguuauucauggcuuucaacuugacuauaucuguaaugaaccaaaacccaagugucuggguacacugugaggguuuuuuucuuaaucaaauaauuugaagugggaagauccauuuuuaaucugaaucucugauauggaaugaugcaccuaaucuagcucuuuugagguggguauguucaccuuuaaucugggccacaccuucugcuaccagccuauaucaaggauuggaaaaaggaagauucuuugcuuguugccugcuugcccucacucuugcuggcaaguccauuccuucacaggcauuagagccugcuucuucaguaucuguauauauagaauggaauauacuguagaucaguugagauauucagccucauggacuaagcaaauacuggacucuuggauuuucuguugguagacagcuauuguugggguagcugaaccauagccuguaagacacacacacacacacacacacacacacacacacacacacacacacuuucaguucuguugcucuagagaaccuugacuaauacaaguaggcagggaacuuaaguagaucaugguaaauaagaaaguuggauuuuauucaaauuauugggaagauguuucaaauugagauuugggggcugucagcaguuaggagugccagcugcucuuuaguggaucagaguuugguucccaguaugaaugcugggcagcucacagacacugccuguaacuccaguuccagcgaaucugagauccucuucuggccguuggggauaccugcaaacaaauaugugugcauauggauagacaagacagacagacagacacacauaaacaaacacacacaaacaaacaaaaauuuuuuuacauugaagcauaauauggacaauagaaugccccagagcaagcacugugccuuccgauuucagucaagugggugggaagcgcauugcaucccaguacuauccugcugagaggcuaugauaaacagacucuggcugggugcaccuuauaaagccagaggccuggcagggaacuuagcuugaaucuggacauagaauccagaguugaggcuguguggccaagggauacuuaguagucuauaaaacuuugcuucaaucuggccuucugauguuauugagaacuugaaagaaccaacaaagauacaccacgccucucguauagguaguuuucugucgaauucuuagcugcacacugacugacaggaggccacagccagaaacugucuguauccaucaucccccuagauuuuggagauucaccccacuuuuggagguauccccucuuuccugccuccugccccugugaaguagcauccauuucugucucuuccuaugggguaccagguagcuuucuuaguaggcaggccuggagaauuuacauaugccucuuggaguccuuagaaauacuucucccccaaacuccagacucgguuucuuaagacacaccucgcuuugaauguguuggaugguucuggaguuucccugcauuuaucgggugaaguaagccucagucugccaaaccacagcuagcguuguaccguggcuuucugugaucauuuguaaugcuaacuuaccugcuuuuaauuggcaagugaucacuaugaauuuauaaaggaugcaguaggaugcugugaucgaugcacacaccauagggacaauuaauucauuaugcuagugaaagcaucugccaccacaucgacauuuucuuuuugggaaguuaggaggguuuuuuggggggaggggcuuuuuuguuuuguuuaaaacaaaaaugaauucuuccagccauuugggagcccccagugcaguaucaccaaggcugggagcaugcaaugcugaagaccccgacgagucacuccucaaugcuaaccaugcucugcggccuuggggcagcagcuucccuugucccucccuccaugacuagccuccauugauuaccuuccucucuguuuccagugagaucagcuuuacuuugauucaugcugagaccaagcaguacuguuuuucuguacuugccucaguucacuaagcaacauguccuccagcucuaucuuccuuuuccuuccuuccuuccuuccuuccuuccuuccuuccuuccuuccuuccuuccucccucccucccucccucccucccucccuuucuuccuuacuuucuccuuuucuuucuccuuuuuuucuuuucuucuugucaucuugguggucuucaguauguaggauuucugaccauucuuugcccuuuugcauaagguugagucuggggggcaaagacaggguucccgagaccaucaccugcuagaugaaugcuucucuuccuggucuuaauagugaccaggaagucaauaguuaacagacuuaauaguacauuagcaaugaauagccgcaaaauuagucaaagacaucuuccuguuuagcugguugcuguuauaaaaugagucauugaaaugaaauagaaccaucauguagcucacuggauggcccaucagugccgauguuugucauguuauucauucagacuuuaaacuucaaacagacuuggccacauugccuauagcaaagucccacacaugccuuauuggccaccucggucuuugaggcuuguggauagaauggagaaacaagaaaucuggauccauggcuaugguggauucugaaaggcucugucucuugaccucaaaauucucuuuauuuaugaaugacaccauuucucacuucccacugacuugcuucaaaaccuggguugcauuucaguuuuguauuuuggccccaacacaaggugauugcgccauauguugaugaaaguaugagaacuggaagcugggaugggcuacuucauuuuauagccuuuagaguccaggaucuggacugaaaaaucacugaguucaguggagauuagccacugauacacuuucauucuggccagacuuggcugguuucauaagugaaaacuaugggguacuguuguccugacaaaggaacccuugguuagugucuacauacauauacgcaugcacgcacacacucauacaauguguuucccaguauccauguuggacagcugacaacugcccuugugacuacaauuccagaaagguuggcauccuuuucuggccuuuguggauaucuauuugcauuuuacacacugacaggcaggcagacaggcaguguaaacggugugauguauccuugcgaacugugucuucuaaaguucccuuaccucugaaugguuaagucacaggguuagcgcccagaaaaguguccccauuucucucaaagggcagagagccuuuuucuuuuccuuagcauugacuuuugcuuggguguugggugacuucuguguguaggacaugucaaauuguucugacgguguccugcugccauccugccugagguaccagagcugcugcugagccauauggaguggaucugcgggccagacuaggacgcuugcaggauccucacucugcccaacucgugaggcagugcuuucucugccccuuuguguuucuugugagaaaggagccccacccuuugauaaggcaaaggucacaagaaacaaggggcauuauucacucugacgggcauaaaucaaccuggaugcaggaaaauuaggaaauaauauagguuaucuuaauuuuagcuacucaaaacauaccuuaaaggccugucuuuucuggcagcuucuuccaauuugaucagcuuuauguaaagcaaagguuggguuucaggagccuuuuaaucuuucccuuuucuucuauuucugaguugcuggggagugaauccaggaccuuguguacgcuggacaaacacuccaguacugaauuacacaaccuuagcuuuaaguaguguuuuguuguuguuguuguucuguuuguuuuaagcugagucucaaaaucuagaaaaaaguuaaucaacaggaaacaaaaggaaaauacaguuuguucuguuuggcagcuugggcccccaggucugggucacacaggugggacagucgccaucugcuaaucaggacccauaagugguggggcuuggcugcuguuuuuccagaguuacgaagguuuuuuauuagaaggcuggcguuuuuccaugagguugucucuccuccucucauucccguucaccuccaccuguugauaauuaaccaucaggugcuccgcccucauccuugggcccucucugucuucuuccguuucugacacuguuuacagucagacuuugcuucccaccugacucugcuuccauucuccccaauuccugcuuguucucagucacauggcgaucuuuuuccuucuuuugaaacugccccuaguaccauguuaccauugccuccaaugcaaagcacacuggagucuccuucaugucugccaucaccuguccuggccuaucagguuggccuaucaugugcagaccuguguuugagcuugaacgggccugaauaguccaacaguguguggcaagcuguagagaaggagguuggugggagaacuuaggacuaagcaccacaccuagacucucccuuccugcuagccuagcaccccugagccgcugacuaacccugcagaguuuuacuaggaggcccgugugcucugcucuaugcaauagcaugugaugcucugugcccucugguugacgaguccccucuguaccagcuaaacuguugcuucuucuuacaccugccucaacuacuugagguaggaguagccuaaugcuaccauaagccagauaauagcccugaugcuagcuaccccagacagcugacccagguuagaacucagcccuggccuuauguuccuaaccacggugugacucuuucucucccaaccuaguaguggccacauuuuacaaagaaugauugcuguauuugauagagauggggcccuagauuaacacuucaacggcuuggauucuagaccuacuuuuacaguuuuugauucauacuccuuaaaaucugagacucagugugccuuaggggugcuaucgcugugaagagacaagaaacaaauggcaaauaguuggggcuggcuuacaguucagacauucaguccauugucgucauggcauaggaagcaugguggcaugcaggaaggcaugcugcuggagagggagcugagaguucuacaucuggaucagcaggcagcagaagucugugagccacuaggccugccuugagcuucugaaaagcccccagccccuagugacacguccuccaauaacuacaccugccucaagaaggccaugccuccuaagagugcccuaugagccuaugggguccaucguuauuuaaaccaccacacaguguauaugugagucggaagcagcgcauacuuuauuaucuguaaaauggaaagguacaguguucuagaaaaugaaggugaggcuagagauuccacuuacuccauggaguugugaggaucaaauaaaacaggcaguugaucacucucuguuuggaggggauauaggaugauugcauuuucaaaaucaaauuaacaugcaucugaguaggagaaguuucucccuguaggcugugucagagcagcggggccaguauuagcaguuuuagcccucaaacuuucuaauacaguuuuucuuauagugugauguggaucgucugguuuuugcaugcacagucaguaaguucaucgcguggcccuguagcuaccugguaacccuggcaauuuaccucaccccagccuuucagccuuuuacacuguaaaaugaugggagcaguuccccucaagggccuuucugguuccaauagucucugcuuuaaggcaguucaucugaagccugagagcugcuuucucagacggggccuuacaccaacucaacaauucuuaauaaagcaagaaugaccuuuuaagcaaucaaaccggucuggccaucgcuaacuggcuaugaauaauaauacuguugggauccuuagcaacuagacucugauaagguuacauucccggagggugaccuugcaugagggacugaccuuacucgguuggacaagcuugguggaugucuugcuugcugacccaguggacaauuucuggcaccaaacaggaagccauugagaagaaauuucacuguuggccaugaguccaagauucauuaaggugagauuugaaagguuuugucucaagagggcuuaguaagaagagcucaguuugaacuaucugggcugcuuuuauguagggaguccuugccacaaaagacuugaaauuuggagccaaaguaaggcuguucuuaaauccugucauguucuagccgauggccuuugcuugauaauauauauguauauauauauauauacacauacacacacacacacacacacacacacacacacugucuaaaguaagggucauaacugcuguguguuuuccuuauaggguuggguugggaggcuuuucagagguugugcuccaaaagucggauuuuauugcuguuuuucagucauuaucuagcacuaguuacucauuaucuagcaccuagaggugccauggaaagaagcagaugacugauagcaccuacacacacccacagagcuucucagauguggggguuccccuguuucuauggagggccugcaguugagaguugggacgucuccagagggcucucauccuugaguggauggaggaccucaccuuccucccaaaauagcacagaccuaugugggaaguuuggccuuagagaugauaauuguauagacuaucuaguucuuagccccagaaggcagacacuuagcagucuguccuaguagcaaguguucaggagccacuaauaauuuaagcagagcuacuugucugcguuuacucucaagucauguacauuaaaugaaacagaagacaaaauuaauuccuuuuagguguacaauucaacauuuuaccacugaguuagaugcccagccccacgauucucccaugaguuuacagaaaugcacuuggcugugucacuaguaccaagcaaaagcagcaacaagacagaauuuucucauccauuaagaauguuuuuaacccuaacucgucauagcaauauagccucuugggucuuuaucauuuuggacaauuuaagugagcccacucgcuguaagucuugacauuugcuagaaagcauugauuggcgugccccauauuugcaaguuguucugaacuccugaaagacuccuugcagcugccgagucuggagucuggaucccuucacuaaauaucugucgauaaagaagucgguugagcuucuuugcuggugccagccaugagcaugggccaugauggaguccaggaagggcuuagaguaucucucagcucucgagagaugcuguacauacaaaugaaaggucaagaaaagccacauagaguuaaccagaaaccgaggcagaaaaucgggaugugcuacaagcucaugcaguuuugggcugagcuccauuugcagggugugagaaaugcuuaggucaaaugaaucugugggucgggcucaggaagggcucuaggaaacagggccgucugagcagugcccagaacucacucagcuucaucucuucuaguccuaccuuauugaagccuuugguuuucuaguuggaaaagaguacuugucacccccagcuuggaugucccuuugauuuugucccuugcuuuuuccuuuuccguguucucugucuucuguucucacccaaggugguuauuugcuggccugccgcccucuagacuucuuacagaccugauccuugucuccauugcguccucccugccccugccagaaccagacagcagucugugcugagcaggcacuccaccugucugaguagcuuggauaacuaagccgggcuuugugaggaagagaacagagagaaagaauacuccugggagaacaaaaggacagaagcaauggauaccugagcugggccauuguuuauaguccuagccagcuuccugcugcuguucuguuaggggugacagcaaaaggaggaaggagcuuugguacacugcagugaaaggggcuuugauuuaaauaaaguuaauuguaggacccuaauuccauuguucuguaugcuucaugcaucuacuguacacacacauacaugcaugcacauacauuugcacacaugcaugaacacaugcaugaacacacacaugcacacaaacucaugcacuauauacacacacacacacacacacaaaagccuacauagacacacauacacacauacaugaaaacauacauacacgcacaaacacauguacacacauacauacaaaagacacaugcauaugcauauacgcaucacacauacacacaaauauacaauugcauacaaaacacaugcacacaugcauauaaacacaaguauauacauacaaaacacacacacacacaucccucugcuugguuuuucucgucaccuaccuacuuuguaggacuuucuauaggauaaauacugccauuuucuuuguuccuguuccucuuucauucccuuugcuugaggggcggggcagaggaaaccugugaguucaguguccgcacucagagaugagugaauuacauaacugcuccccaaacaccauacauuuaaguauaaaaugacuuuggucucugccuccuauauaugguuucucuuucaucucuuuaauuauuucacugccaacaaaaugcaagcaguauccaguuuccuuccauucugugugcucuggcauucagugcuuacauugucaccaugguuccuuuucccaaccucacuuuacuaaagauccuaugaguucccaccaucucuggagcuuuccaugaguagaaaccagacagcaauaucuuuacuguccuccgauagcaguuagaacagaaaguuccuuaagauuaaaucugccuggggcaggagagaugcucuuccagagaaccucaguucaagucucugcauccuugcuaggaggcucacaaaggucagggcaucugaugccuucuucuggcccguacagaaacuuacacacacacacacacacacacacacacacacacacacacacacacacacacacacaagugcucacaugugagcauauguaucuaugacagugucuuacuauguagcccugaucgaccuggaacucaucuuauagaccagcuggcuuagaacucagaucuuccugugucuaccucucaagugcugggauuaaagauauacaccaccaaucccagaaaauguaaauguuuuaaaaaugcuggggcugaagagauggcucugugguuaagaggguguucuucucuugcagaggaccuuaguucaguucccaguaccuauguuguacagcucacaacugucugugccucacucuccaagggaauaugaagccuguagcuacugacgguacuuacacucacaugcacacauacacuuaguaaucaaauaaaucuauuuaguguucuaaaauuuacaaauaauccgucagccagagagaugauuugaguggcagaaaccagagcugcugacaguugauaauguuuuuagggagacuggauggaguguggccucuuuuggcaaaaagugagcauuucgcaguuggagaaggaugggaaacagagaggaacagagcgcugugcagaaccacacugugagggcucaguguggggaagucuuucugccccucugugacccaguuccuuuguugggaccaggauauugaugcuucauucugaugacagaaauguucaaacaaccucaacugcuuaagaacaauguugauuauggcugccucaugcuuugaugaccucuggaaaacucguuaacacccagcuuacuucucuuuuacuaauugcagccaauuuccaggagcauuuuauucagucugccgucaacaagaguaugcgcucgcucaguuuuguucuucuucuucuuuuuuuuuaaauuagaacauagcaccagagucauugaaauuaaagauguaguggauuuucauuauuuaccuagaagaaugggcaaaauaaaaaugcuagcaacaccaaaugcuggcaaggaugcagacacauuagcucaugcugacacugcuggggagaaugugaaacaugcagccgcccugggaaauccuuuggcugguucuuguguagcuaaacauggaauuuccauaagagccagcaauuacacucuccgauguuuaucccagugaaguggaaacauguuuguggaaaacuugaacacaaauguucacaggaaccuugccuguacuaggcaaagacugguaugcacccgggcauccuucgaaggaugcccggcuaguuaaaacagauggaauauguucuccaacagucugcaguacuuaaacagcagacuauauacaccagcaauagagagccagcuauggcugcacacagccugguggcucacuggggaauuauacuaagugcaaaagccaagcugaguggaucgcuguauggaucuauuguauaacaucuuugaaaugacggaagugacagaaaaguggacuagauugaugacugccagggacgagagacaggagguggucaggaggggacugaagaagaauaguuaagguuacagagcuacaaaggcaccugcggccaugacgucaguuugacagcugugguggucgguacaugaaacaucauuguaugugauaaaaugacaaggagacacaugcacucaccauacaccaaggaauccagguagugauguggcaaucugacaagaugguggauugucauucuugugguggauauauuagauucacaagguguugccugaaggaaacugggugaaggauccagacaggaucuuucuguaucguuucuuacaaccauauauaaauugauuauuguccccaaauaaaaauuuuauuucuaguuuguuuaccucuuguucuuuaauuauauuugcauaaagaggcaguuucagaccgagcuuaauuagauucaucuuaucaguguuugggcaguuaaugcuauuaugauucguuagaaucagggaaccacuucaucuuucugauguuuuggacagucagcuguauucagaucaggagaaaguaugagcggggcuuccccuuuccaauccgccagaaauggcucagugaguguauuguugugucuuugccuuccugugaagguuugaccgugucugucuagaccccagaauccugaaaacaaguguagcaucuuccugcagaacaacagcagagaacagaaguacauugugugucaggcacuaggauagcuggccugagauugggucaagaugcagccugaggucuuggcuaugaccagguugaguuugagacuccggacacuguccccaggauguaccauccacaagcacgcuggggacacaccugggccaacccguugcagauuauuaacagagaacucaaguuugguugucagcuuccuggcagguggcacggggaggugugaaaucugaaccccaguugucagccugccugagcugaggaagguuuucuguuuugggagugugguguaaucgugaugucaagagacucugagggaugauggucuccuguccuuugaaguuguaggacagucccaucuggacagcaacauugaagaucaagagaucgucacuaacccgccagacaucugccagguuguagaagugaccacugagagugaugaccagccagucagcaugagugagcucuacccucuacagauuucuccugugucuuccuacgcagguaaggggaguggggugugugugugugugugugugugugugugugugugugugacuuggagacugaauggggaacaaacuacaagucuagcaucacccuguuuuaccacaccacaggagaucucugguccguacgagaauuacuacuguggaauuagucuuacucuuauguuuuugucagugucuugggacacuuugguuaaaagaugcacucgugguauuccuuuacuugauugcccacgauaaugguucaucuaggucuacaauagcauuuccugagauaaaugcuucguugucaucauaaacauacaacaaaggauauacugagaacuggcagggacccagaaagagcuggcacguaggaguuaaaaauccacucuacugaucuauuuguccaaguuaacagaauuuggcaggcagagugguuugauggaacauugauuuuauuuaggcagauaggacuucagaaaucuuuucuagaguuuccauuugugcaaguaaaagaauuuuuuucaaggucaccgggccaacaaaguguccuggccaggacuagaacucagucuucagcuuugaggucauugcuaaauccaacccguuuuucuggcuuuucuugccacuucuacauauuuuccccuccuucccucucucccucccucccucccucccucccucccucccucccucccucccuuccucccucccuuccucuuccccucccucccucuucuuucccuuucuauauagggcugcuucuaguugaacugaacucauuucuacuucuccuggguacagguccuaucacugcaaucuaaguccugacagagucgcaggacuagaaacgaacugagaaaauggcggcuccuuuugccaugggcauuccgucaucuuacacuuccugaccaucuccguuuaagcuuuuggaacucagucacaauuagaaaaucuaacucccgagucacuguuauugcuugcagcuauuaaaacauaaaaagcagaggccagggcaugggaaaggccagucagcuccagcaaauggauugccuucucccuaugcuuauuugccaucucuggagcccacgugaugguagcacagacucacauggcagaguucaucccaacaucagguauuuguaaauuaccagcagauagauuaaccucguauucccuaacuguagucauccaguggccauggacaaacuggguuuaccugaaaggggggcuggaaaugaagaagagauggguggggggaggugauagaagaaugaaaccgagacaagguuccgaucaaggcuucaaguuuaauauucagcacugcguuuauauagggcaagcccacagaccccauccauuguuucaguuggacuauguugcaaagcaaggucagugggcagucuauucuucuaaguuucugugggaacuugcaugugcaaccaaggcaggugacuccaccaaggucaguaaggucuauuucggcaagcguucaaggucuguucagccugcucaaggcugggagaggcacaccuagcugccagguuucuuuuuuauuuguuuccugaauugugguaaaauacauauaacacagguuuaccauuguuaacaaguugcugccagucauuuauuuaucagacauaguuugaacucuuauaugcguccaucucuuuauggucuuugcuagggucuagucacucucuccuuuguuguauguuuacggugcucugggaauugugcuaaaugccuguaagaacuggcacugguuggcuggcuuaauuaucaaaggaauaaaugucguuuucuccuuucaaaaaugaggccuucaaggcuaaugugagucuaggaaugaaaaacuagugacguagugucugauguucuuaaccacacagcccagugcuacagggaucacaagcuguagucucauuugacugucaaaggacccaccagagaggguagacccaaauguucaugcuaaggcuaaauccauggcuuucuucuaagucaccugcuguugucgugguuaagcaggaguuggggcuugacagggagggagccuucauguagccgguuuaccugucguaugagguuuccuuggugauuuuugaaaagaccugcuugcuguucugagggcaguggcauuccaccuuagcagaggcguucugagaacagcugauguguguagagagaaauaaaaauuccaucaugcauucugggacauuugcauagauuuccaaggaaggguuuuggcuccggagugagagguaacaugaauuucugggagagcccagcuuccuagccuccucuuugguucaucucuuguuuccauugcuggaggucuccagagucuuguagaggaagcuuuauuggaaagggccaaaaaucuuuaccuucaguucuucccuagacucggaaacgugauggaaaguucucugcuaguucaaguguugcagcgagaaaguuuauaacauucuguagcugucucuucucauccuuucauuguauggccaucaguagcaucggcugucugcugguugcucacggaagaguuccuuugugcggacuguucauccaaacaucaaccaccucccucugccuguucagggaacagugguuugcauuuggaaccuguuucugacuauucguccucuagggaaucacugaaauacaauccguggaucacuaggaguaucucaaagccacguucaacuuugcagcucugucuucugaugucugauuuaaccguuggggugacaaggaguugagacagugucuuuggguggaaggaaguauuugcaucagauaguuuaagauaauagaaaaauucuuuaacugcuaaauuuucauagugcagaaguauguuucaaagcccagccuugaagaagcauaaggcauaaggcauagucacuuuguuuguuuguuuacuuacuugguuuugcugugcuggagaucaaaaccaaggcuuugaugugcuagagaaagggcuccaccacuggucuacccagcccucauuauauuuugaugcggccguaugccucaucuuuuuaggaucuaacuagauuguugguggcuuaguaaaagaaagccaucauggugauucagcagcgaggagguggaaaacggguuugaguagggagcauaagaauuaauugguuguauaaucaagagaaaauaggcugugugggcaaccagccaccauccuuccgggaaccguaugaaugucguaauugaggcaaagguguagcggcguggagacuaaaaacacacugauuugaguaacugagcgaucaguuacaucuuccaugucaacauaacugaggaaauuauauggaaagaaaucaauggugauuggauuugguggaaauagagccuuccagaaaauauauaucagauauaacauaauacaauaauguguuccaugaaauacauccucuccucucagggauguucuugagguaacuauggcaauauggauucuaaggcggauguuaagaguuggccugaaguggcagauuucuggaauuguugcucugggagagcccgugaggucaucuguuccaaguccugaucacuuuccccccuuuuagcugcuuguugaaaaacgggccggaaagguuaaaucaguuauuugugugucugcuacuacuguguaaauauuucagcuuauucugaccacucuugcaaagugacuuccaucaucuuuaucccauuguauuggaagucaguuagaaaaguauccgaacuaauaaaagagggaagugacauaaugcacacugacauuuuggcagucgcaucgaucuggaagccucggcuacagcgagcucauuugucauguaaaaagucauucuggaaaugguggacaaaaauccagagaacggaaaggagggcuuggagcagacuauucagugauaguuauuaaaaagugccauucaucugaaaucgagccugaggaaacccugcaccucugaggccgaaggccccucaaggccaccuucucaaaaagaaucggcguuagagacugguaucuuagcacgcuucacgcugcuguaacaaaacaugcgaggcaaucuguuuuaaaagagauaaagacgguggcauggcucacaguuucaagagauuucagcuuguagcuacuuagccccauugcuuugggacugugguggaacagaacagcguggcuagaaccaugugguguggagcaaagcuggucagaccaugguggaugggaaggggaagaaagacaggaaggagcugggggccccaugauccccugcauaggugugagugagauggucucaccucuuacaaguuuccaacucaucccaaugucacugucaccuaaggaccagaucuucaacgcaccagucuuugggagucaguuaagaugcaaacccuuaugcccagcuccugauguggcgagagguuccauaagcacaccagagaccguugaacuuaauuuagaaaugauucucuccagucagugucuguguccacggggcagacagaguaugcgugucuuuacuuagccgaaacuuuauuccuccaguugaaugcugguacucacaggacauuaagguucuuauccccuuccagguauauucaaagucuuaccaaggaguuuaaccuagcaucuaacuuccaaagcuuccaacaauuauggacugggcucaugggauccuagaacccugccgaccacagcuucuuucuuucgauccccugccuucccaagugugccugaugucucuguguauccgcuuuuauuugaaggggaaaggcacaggagacuuuaggauuuacagagaggcauuaggaggagagugugucugguccuuguggaaggaagggaaacuuaggcuucagagcacaaacaaagccaagccugaaacuaggaaggagcucuugaagguuugccagcagcgagauagucucugugcuguuugcgacucugggauccgaaguucaguuuuguuuucuccccucugcugacucaguccgccacuugccaagguucucaacaucucuguuccccauuuuuuucuuccucuugggaguggcuguccuguguccucuggaggcugagcuaauguggcuuuuguguuuggagagaaguuuccuuuucuggucuugguuuacuucugccuggaaacauuucuugugccuauugucaauuugucucuuuagcucagaucacugucagccaagaccuaggagauuuguaacucccccccccuacauggggauguuuugggcugggcagaacacugugagguggaggggcaaagauuugaguuuagucagccgguggcaaucucccaggccugucugaagucucuggagaacaguggcugagaguaacgcaaacacacucauuccuggaggagacuuuuggaucucgaaugcuuguugucuguuucaggaaugcacugggguaagggaggguggggacaguuugucuacuaguucuuuaauuugcuauauguggagagccuggacucugggcuaugcucugaaugauggaaaggguucuaguuugccuagaaccauugacaccagggcagaagauuguagaaggagcuagagaacauauugccagaugauaacagcuguucucugguuuaggaucuugguaggggaugaacaagaccuggauaaaagacuccagcagaacugagccauagaucuuuacaaguacuguguacuuuagauguucuacucucuaugcauuaacuuuggaguguugucaaacacugaaaaaaaacuguucaguauucuuuuauuaacuuauaaaacuuaacauacagaugauaugaaauugccaguuacucuauguaacucuguugaauccagcccaaugugaaaacucagagcuaaauaguaauuauacuacagguacugugugucagcucugugcagggccuucccaaaugcccaaacacccucucccucaucauuuaauccucucuggaagguagcagguaacuuuagcucacucugguuaagaacuguucucugugucacauagcuggcagguccaaucggguuuauauuaucuauugcuauguagcuguacagcccuaaacaugauggcuuaccacaguacaaaacucacagccucuggguugggaauccagggauggcuuagcuggguccuuugcagcagagccuugcuaaccugucauuaggcauuaacuaguacugcaacucgucugagacucagcuguugagccagugccucacgaagcauuggccagaacuggauuccuugcaaguggggaagaacagagauuccuaauuucuugcuagcuuuuaucuggaagcagcccuuagcuuaaauuugccaugugggccucccuaacacugccagcaggcaagagaguauccaugaaagacagguugaaucuuacacgaugacaugaauuugcucauauaauaguuacgucguugauguguucuguuggcuaaaagcaagucacagcuccuauccaaacugaggaggacaggucccaaagacaguaaaggcucagcgaagggcuuggggcaucuacaacauggucaccugcuuuaacuccaguggaagcuggaucucuauaaaucuaagaggaggaugauacaggagagauacaggaaggcuucuuggacuuccugugacaagagaacauggacuagaagaaaagauggugugcuuuuguggacagaacuucaguggggaggaggugccuugggcacagcacuccacccugggaagcugggacucuggcagcauagccuuggaaagugagccuccuccucagccccaaagcccacuccucuuagaggaucaagcagagaauugaaauucacuccagcuuguuucauguggaagugcuugaccuuacaaaguggagggagaggguacauguaguuuuguauuucugaagugcuggcauagguuuuaaagacacuuccugcagccucaaaauagcuugagcaacaagacuguuuuucuuucuauacagaaagcgaaacuaccgacaguguggccagugaugaagagaacgcagagguaagccaguuugugugugugugugugugugugugugugugugugugugugugagagagacagacagacagacagacagacagacagauagacacagacagacagaaaaacugagagagacagagaacauccauauccuacaauucacccuagcuuuuuagucuaaucuuaaaaugaagugcugggcgggguugagggagcacagugugacccucagaagagagaucaauauaacauggcaggaagaggaacucgaagucagggccaggaaauguugauauucuucuggcuguaaacauccugauuugccaacagaaauagaauggccuacccagcccaagcagugaacagaaagaaguaagcaagugaacagaaagagcugaguaaaacgaucuccucacaguucggucccuuccucaguggccccgcagagaggguguguguccagucucugcuccccacccaccugcuuccggcuucccucuuaggccagccaggcucacacaauggcaggaaguggcucuaaagcugauggggagaacagggauugguuguaggagaagcugauguuuguuagaauuccuaauauuccaaguuugggaauucugagaggacaguaggcagccaugcugacugauuucaugaucugguuucuucaaggaccuuuaaucccuuuucugcuuggcaaccaguaaggccaacuguggcucaaaaaaaaaaaaaaaaacccgugucucagcuccacccauuuaaaaagcaaucaaaaggcauuugcuguuuguaagcuccuuacucuauuccucugaaaaggcaggguaacucauuagguugggccauccauuaugucuggacacuacccaguaccaagccuggacaggcugagcauaggagccaagcugccaucauguuccgugucuuuguagaacagucuugaccagggacagcucaugggcauucacuugaaaaguaagagaaggcauuguuuugccuaugccauucagcggaagggaaagaacgcaauguaucuugauuguuuucucugaaaggggagaccacacuggaggaagaggagcaucgaaggcaagcaguaccucagcaacauggggacacggaacaccuaucugcugcccagcauggcgaccuuugucaccuccaacaagccagaucugcaggucaccaucaaagaggauagcuguccgaugccuuacaacagcuccuggcccccauuuacagaccuuccccuuccugccccagugacccccacgcccagcagcagucggccagaccgggagacccgggccagugucaucaagaagacaucugauaucacccaggcccgugucaagagcuguuaagccuuugacucucccuggugguuguugggauuucuuagcuuuguguuguucuuuguuuguauuauauuauuuuuuuucucuaugauaccuaucuuagacacaucuaagggagaaagccuugacgauagauuauugauugcuguguccaacuccagagcuggagcuucuucuuaacucaggacuccagcccccccccccccucgguagaugcguaucucuagaaccugcuggaucugccagggcuacucccucaaguucaaggaccaacagccacacgggcaguggaggugcugcguugccuacggucaaggccagcaugguggaguggaugccucagaacggaggagaaaaugugaacuagcuggaauuuuuuuauucuugugaauauguacauagggcaguacgagcaaugucgcgggcugcuucugcaccuuaucuugaagcacuuacaauaggccuucuuguaaucuugcucuccuucacagcacacucggcgaccccuucuguguccacuaccccacuacccaccccucccuccucaaccccuccaucccgguccucuaugcgccccuuccccccaaccaaucccaucacaaccucuuaccuauccuuucccucccaaccccuucuaucccagcccaccaccuaccccacuccuccccaacuccuccauucuagcccauuacccacgccucucuccucagcccagccuaccccaucccacccuguuccuuuccuccaguuuccucuccucaaaggcaaggcucuacaucuuggaggaggaggaggagaagaaaaugaguuucuucaccgcugucccauuuuaagacugcuugaauaauaaaaaaaaaaucuuucuaaucugcuaugcuugaauggcacgcgguacaaaggaaaacugucauggaaauauuaugcaaauucccagaucugaagacggaaaauacucuaauucuaaccagagcaagcuuuuuuauuuuuuuauacaaggggaauauuuuauucaagguaaaaaaauucuaaauaaaauauaauuguuuuuuaucuuuucuacagcaaauuuauaauuuuaagauuccuuuuccuguucaucagcaguuguuauuacaucccuuguggcacauuuuuuuuuuaauuuuguaaaggugaaaaaaaaacuuuuaugagcucauguagcaaucaaauuauccuguggauugauaauaaaugaauaugguauauaguuaaagauuuuaauggguauca

SEQ ID NO: 4431 - RNA, 4686 nt, Mus musculus
cauccugggaggacgcgcucgcgccggaaggucgcgugugcgcgcggcggcagcggcggcggcgagguuauaaaagggagcgaggcgguggccggcggaagugggcgguucgucggcgccuuguucuguuguuugggguuugggcuccuggaggggcguucucgggagggccgccggugcaggccgcgcugacacagggccgcuucgcccccggggcuccgugcgcuugcgcucuccccgucccgcaggguccccaacauggcgcaggagguguccgaguaccugagccaaaacccgcggguagccgccuggguggagacgcugcgcugcgagggcgagacggacaaacacuggcgccaccgccgggaguuucugcuucgcaaugccggggaccugguccccgccaccgacgagacugcggacgcggagagcggagcccgcacucggcagcuccagcagcuggucuccuucuccauggccugggcgaaccaugucuuccuagggugccggugaguggagggagcgucgcucuccagccagccuuccgggcuuugcuccacgcccccugccgcuggccggggagcgcuuucgcggggaccggcgacgcuggggagggccgcuugggaagcgcgggaaucggugugacacuguggguccucggagggagagcaggaagggcguccggggcuguccccgaccucacaguugccgggcguccgggugguaugcgcccggcagauggaguuguuggugcuuagcugacaguaucugcccgggagaccccgaguuuaaagguucccuggcacagacccgccucccgagcccuuagggcauucgucugggccaucuucgauugucgcgcgguucguacacuuugaucacgaccaggaaaugcagucugcgcacuccugcauuccucacgcugccaguacuuucggaaaaaaaaaaauaaagcauaacaacaacaaaaacaaaccacuucuugagagcgacuuuugcuucuuuuucagguacccucaaaaaguuauggauaaaauucuuaguauggcugaaggcaucaaagugacagaugcuccaauccauaccacacgagacgaacugguugccaaggugaagaaaagagggauaucaaguagcaaugguuagcagaucauagaugugaacauacauaggaguuuagaaaauaugcuuuauaaaauuaggaaucgcugucauuacuaauuuuuuuuaacaauccagaauguguaugcuguauuaaucuaguuaaaauguuaaagcuacacuguguguguaugugugucugucugagucugucugucuguuuuggugcugaauuugauuaacuuuuagauuuucaaguccaaugucugaugcuguuaauuuaauauuaaaaacuaaucauauuaauugauacuguuuuaacauacuaaugaaguuguuccauauuuuaaaagaaacuacugguucugaaaaaagaauuuuuuugugcuuuuguuugucuuguuuuguuuuguuuugauaggguuucucuguguagcccagccuauccuggaacuugcucuauagaccaggcugaccucaaccucaggggucaugccugccucugcuuccugaaugcugggaugaaaggcacuuugcugccaccccacucucugugauuuuuaaaugaauguuuuguugauugucaugucuuuaggacucuuaguaaaauaccuguguuuuucuucuuucuagaagggguagaggagccauccaaaaaacgagccguagaaggaaaaaacaauucuucaguugagcgagaucaugggaaaaaaucugccaaaacggaucguucagcagcucagcaagaaaacaguucgccguccagggggucguccaccaaauccgagaguggugggaccucagcucggagcagcuccaguggcucccaucaggauagcgccacaagugaaggagacagaucugugugcagccagagcagcagcaauuccucucagguaaccgcagggucuggaaaggcuuuggagucagaagcuccacauaaacgugguucagcgucauuuguuucuucccuguugaaguccaguaugaauagucauaugacccaguccacugauaacagacaacagagugggucaccuaaaaagggugcucuggaagguucuucaggcucagccucucagagcagcucagagauugaggugcccuuguugggcuccucuggaagugcagaaguagaguugccauuacugucuuguaagucuaguucagagacagcuuccaguggguuaacaucuaaaucuaguucagaggcaaacauuucaucaucaguuucaaaaaacaguucaucgucaggcagcucuuuacuaaccccccagagcaguuccacaaauccaucgcugcugacauccaaaagcacggcucagguagcugcuucacugcuagcgaccaaaaguggcgcuuccuuaggaagcgugucucagcuagcugccaagagugguucucagaguagcacuucacaguugccuucgaaaaguaccucccaggccagugagaguucugucaaguuugcuugucggaaguuaaccaaugaagacauaaaacagaagcaaccuuucuucaauagacuguauaagacgguggcguggaaguuaguagcaguugguggcuucagccccacugugaaucacggagagcugcugaacgcggcuauugaggcucugaaagcaacacuggauguguuuuuugucccacugaaagaacuggcagaucugccucaaaauaagagcucucaagaaaguauugucugugaauugagguguaagucgguauauuugggcacuggcuguggaaaaagcaaagaaaacgcaaaagccgucgcaucgagagaagcacugaaguuauuucucaagaagaaggugguggugaagaucuguaagaggaaguaccgaggcagcgagaucgaggaucuaguacuccuggaugaagaagcaagacccguaaacuuaccuccagcacugaaacauccucaagaauuacuguaacuucuccaaguaggcacugaauccaguaucugguguuugaagagaaaaacuggcuuuuauauaagacacuggcuuucacagauuuuauauugcuuuuuuccaguuuugcagaaaauuuaaauucucguucucuucacuaaaguagagcuguaaauaauuuaugacagugcauauuaaaggguguacauugacagcauaccagcgugcuguuuuauuugcugaagaaaauacuaucuucuauuuuuaaugauauauuagguacgauguguaguucuguagaaucuuaaaauuuuuguacuacuacuaccaauuugguagaaauguauuaaguugucuaccaugccuuuuuuuuuuuuuuuuccuaacuugauugaaucacauaaaagaagggggaccacaguauuugaaugugugaaacuauacaaccuaagguuuaaaaauguugcucaugaugcugaacagcucuuaaagaacaagaagaguugucucaaacuauuuucaugaaaagcuguaaacuuuuuuuuagauauaaagcaguauaaaguacuuauuguuauuuuauucuaaaguuguuuaaaauucaccaugauuuugacggcugcagauucuuaagcagguuaauuuauguuuugagguaaauuucaauuuacacuuuauuaagacauaauguugguuucuauaggaagcauauuuugugacuacuaugaacagacugauuuguuuagauauuaaaugcuuuaagcuauuuuaccuuuucaagaaguuguguuuuuuuuucuccuacccuggucauaacuaaggcuccucacuacuauucaaacuacaaccaaguaguuuucauaguauaaaacauauucuuauaaauagggaaguuuauaucuagaaccgggugguuuuuguauuuguagauuucagaagaauauggagaagacuagagagcuauggucaguucuuuaaugacuguguauucauguggauugcaucuguuaguaauauaguagaaucuuguuucugugucuuagguaauucuauuaaucugacaugguuuauuuuaaaagucuugucuaagguauaugacuuuuggccuucuggcuuucuaggaacugcacacuggacaauaauggagauaauauauguagaaaaagaccuuucauauuuacuaguuauauugguauuggaagguugaacauaagcacaauuuaaguguguaaaaauuaguuuguaguuuaggaauaauaaagacacuuaauguacugaguuuaaacugaaauaaucagggauguuuguauuuugccagauaacauuuuuaaauuauuuguuuuuuuuuuuguuuuuuuuuuuuuuuugagaauagcucauuggauaccagagcaaaaucuauauucuguaaauggucugacugcccuuauauaguguggaaaacacuaacauaagugaguuguaaaaaacacugucaaguuucuucuguuguguauuuuguaaacuaaugcuuaccagaaaagugagccaaaaauuauaauaaauacauuuuugaaauacaucuuauuagaugauuggguaauuuucuaaagugauuuguuuuaaacaaauuuauaaaggcauuuuauauugaaaauccuuuaaauaauaaucuuuugaugug

SEQ ID NO: 4432 - RNA, 5425 nt, Mus musculus
uguuguuguuguuuguuacuuuguauuuguuugagacaggugcucccacuacaucucccuggguggucuggagcucucacugucgguuagguuggccuugaauucuuucuucuccugccucagcuuccucacuacugggucugcaaaugugccaccucacacgaguugggaaguuugaacagggaucugguacgugggagauccguaacuguucccgagagaccaucuucggcagcugcacuggagcaccaagaccugcuucacgaugagucacucauacggccagagaagugcaauuagcugccgacuaagagcucagucaggggaagggccccugauucuucuccaugugacuuuuuaugaucugccugggcuuccuuacuaggagauagggcccaagaaagacucugaagagacaagaaagauaaauuaucaggcuuuuguuguuauuguuguuguucguggugguggugguggugaugguaguauuggugauggagguaauggguuuuuguugguguugguguuguuggugguguguguuagacagcgcagaauguggucgggggagcuggaacuguccauguguggagacuggcauuacauacugucuauguagaccaggcuagucuugaacucaccugccucugcuuuccaagugcugggaauaaagguguaaauauuauugugccaggcuuugagcaugucuaacugggaauuugauuuguuuuuaauuugcucuacaaauugguuggcucaguaacaauucuuuauuauuauuauuauuauuauuauuauuacuauuauuauuauuuaaagauuuauugucuucagacacaccagaagaaggcaucagaucucauugcggauaguugugagccaccaugugauugcugggauuugaacucaggaucuucagaaggcagucagugcucuuaaccgcugagccaucucuccagcccucaguaacacguucuaaguuguuuaaucaagaaaggaggccauguguggugucauacacauuuaauaucaguguucaggaggcagaggcagggggaucucugugagcugaaguucagccugaucuacaaagcgaguuccaggccauccaggguuauagugagacccuaucucaauuaaaagaaaauuguagguuauguuucaaacagugcccucacuuucuucauuacuauuggcccuugucuuuuuaagcugggacucaggggguggggauagcaguccccaaaguggagcacacaagguuaugaccauggccuuauguucuuuauuauucuaccccagucuuaagacuuuuccucuuuagccaaagccaagcucgcaggaaaaagaauggcugucaguaauuugauucaucgcccuuuccaggagguuggaaacagccaaugcuggcguuuuaaagcaaccugacacuccccuuugagggacaaacgaacgguugaguuaagggacaacaaugaucagaaaugcuggagcccauaguugcaugcacgugugagcccccccaccccccacccccaccccccggggcccacagcagcugaccuuucaaggccuaggaugcauucuugccucuucaguuacuguugcagguggguuguuauuauuaucgucauuggaaugguuugguuguuuugauuuguuucaaaggcagcacauucauggucacgagguccuggcaggcauuucucucugaggcuggugaucaagaagcgagaugagaugcuaacuaggguaggacgccaguacagcagaacuuccguggaaguggcuaauuugcuggcucaacccugcuaagcaaccaaacgagguaaugacucccgucucuuugcggacuccgaccaauuugagcuugugaccuugagugacaccauacuuuucauagcuauguacuaaaggagagaguauugugcagucagugaagcgauucuuuccaacgauauaggcgacaaaggacagaaguguaccaaggacugagaccaggggagaccaaguaacucagucacuguggcaauuacacccauuagguaugucucccagauauaaucuuucuuuugcaagcauugcauuaauuuuccuaaagcacacacacacuccuucacucuccucaacccuggaguuccacaugacuuucuccugcagggaguuugucaauugcagugaauaaaguggacgcccagguccaagcacuuucccuuggagugacaaaagacuccagaaugucaacccaccuugggaaacaggaaucaucccuucaggauuucgcuucuuuuuuuuuuguuguugcuguuguuguggguuuuuuuuuuguuuuuuuguuuuuuugcuuuuuguuuuuuguuguuuuuguuuuucgagacaggguucuucuguguagcccuggcuguccuggaacucacucuguagaccaggcuggccucgaacucagaaauccgccugccucugccuccuaaauucugggguuaaaggcaugcgccaccaccgcccggcaggauuucacuuuuuucaagaacuuaccacacgccuuuguaaagggucuggccaguuuguacaucagucuucuuggaacaucuccgcuggauauuuuaucagucuccacagacuuugggguuccauugaccaggguucucuugucugcugcaguuuuuuaaaagaugauauuucuuuuuaaauuuaaauuauuauuuuuuuuuccaagacaggguuuuucuguguagccgugguuguccuggaacucacucuguagaccaggcuggccuugaacucagagaucugccugcuucugacucccaagugcugggauuaaaggcaugcgccaccacugccgggcaauuuaaacuauuuuuauuccauuuuuaccuguauugguauuuuaccuguguguauuuucucuaccuuuuguguaccugguuccuauggaggccagaagagggcaucagcccuccagaacucaaguuacagauguuugugagccaccauguagguuccaggaaucaaaccagguccucuggaagugccagacucuucugucaaaaccuuuugaaagucacuccuuaguuucauugucaaaaccuaaaugggauggccuagucagucaucaauggaaggagaggcccuugguccugugaaggcucuaugccccaauguaggggauugccagggccaggaagcaggaguggaaggguuggugagcagggggaggggagagggaauaggggguuuuuggaggggaaaccaggaaaggggauaacauuugaaauguaaauaaagaaaauaaauacuaaucauuauuauuaauauuauuaauaaaugguagggguuaggggcugaagagauggcucagcagugcucauuacucccucagaggccccgaauuccauucuuaccacugagguugagcaacucacaacuaucuauaacuccagcuccagagggauccaacacccucuucuguccuccucggauacccucauauaugugugaugaauucauauagauguacauacauacacauaaacaaaucuuuaaaagguagagauggauuaaaauaccuauacauauagcucaucaauuaauuagaccaagacuuugccucaaaucauuuuguugcaggaguccaagauaggugaggcagguagaccaaauggcucuuuuguccuugucucacuuggccauaccuaauagagaaagguucaaaacagaagguaaauugaaaaggcgaguaagacccauuauuucacaugugauuuuugaaaaaugcuacuuuauaaauuugcauggauuuuuuuuuuuuuuuuuuuaggagagccaguuagcaacuuguauuccaagaucaaugguuuuugggcaaauuauuucacaggaguggauuuguucuuagcauuugaauuaaaguuggagcacagcaggguuggggcaucagaaaguuggggacuggaaggggacauuguauccacaaguggggagggaggaaagguauuguaggaugcuggagcccaagugggcugagggagcauuaucuacaggggccagagaaagauguuguggggggggggggggacaacaacggaagaccagauauggggagauuuguacucagguuccugugucaagguugaaggaacacagguuugucacaguggagaauuccagaaauggggaaguugagacuggcaguugaaguguggagugagaaauggggcuacagauagaaauugaugguuauaaaauuuacuggggaaaagaacccccauucuuugucucaauuucaucuuuuuuuuuuuuuuuuugguuuugguuuugauuuuucaagacaggguuuuucucuguguagcccugguuguccuggaacucacucuguagaccaggcuggccucgaacucagaaauucgccugccucugccucccaagugcugggaguaaaggcgugcaccaccacugcccagcucaauuucaucuuuuaaagaucagugggugccagcagcuuuuguguuuacugaugguuuuugcccagguccucucugacagugcuccucucugacagugcuccucucugacagugcuccucgcugacagugcuccucucugacagugcuccucucugacaguguuccucucugacagugcuccuuucugacagugcuccucugacagugcuccuucccauccugaaccuuggucagcuuccccauguguucccagccaggagcuaacccccuauucgucaaucuuaggcuauuucuuagccagauuuugugacacauguuguucucagucugucaaguuucaaucuuacaaacauuuuuuugaaaguuagaaacuuccaaauuguaauugauacccuucaaccccguuuuugucacaggucgugaugguuuuaagcuugauugacuucggaaguaccugagagaugaagacaguccgugucuggguguggcaguaaaggugaacucagagccuauuaacggccggggggcggggcuugccuuaugugugugugcagcguucacaagucaaugggaaaacuggguggaagaaaagaaggaacaaauaccuccauuuuaacaugguucaugucugaagugguugcucaaauauggagaaaguugaagauguuuggggagagaguauuugcucccucucucacuuucccuuuccuucccucucccucuucuuccuucucccucuucccucucucuccuucccucccuccucucccccucucucuuccuuuccucccucucucuccccucuccuugcuuuccuccuccuucuuaccucucccucucccccucacuuccucccucucccucucccccucccucucccccucccuuccccugucucucugcuucguggauaccuccaggugagcaguccccgucuuacucuuccaaccaucaugccg

SEQ ID NO: 4433 - RNA, 665 nt, Mus musculus
gauggcuuucaucuucagaacggccaugcaaucaguagggcuuucucugucauugcugggauggguucuagccauuauuaccacauaucuaccacacuggaagaaccuuaacuuggagcugaacgagauggagaacuggaccauggggcucuggaaauccugcgucauccaggaggaagucgggaggcaaugcaaggacuuugacuccuuccuggccuugccagcugaacugcaggucuccagggucuugaugucccugugcaacgggcuggggcugcugggcuugcuggccucuggcuguggccuggacugcuugaggcuuggagagacacaggagggucugaagaagcggcugcucacccugggagggacccugcucuggaccucgggagucauggugcuaguuccugucuccuggguggcccacaagacggugcgggaguucugggaugagaccaugccugagauugugcccaggugggaguuuggggaggcccuguuccugggcugguuugcuggcuucugccuggugcuaggagggugugugcuucacugugcagccugcucgagcccagcuccugcagccucgagucacuaugcaggggcgggaccucgagaucaugguucauaccuagaaaauggaacuguacagccuaaaguguaag

SEQ ID NO: 4434 - RNA, 665 nt, Mus musculus
cuuacacuuuaggcuguacaguuccauuuucuagguaugaaccaugaucucgaggucccgccccugcauagugacucgaggcugcaggagcugggcucgagcaggcugcacagugaagcacacacccuccuagcaccaggcagaagccagcaaaccagcccaggaacagggccuccccaaacucccaccugggcacaaucucaggcauggucucaucccagaacucccgcaccgucuugugggccacccaggagacaggaacuagcaccaugacucccgagguccagagcagggucccucccagggugagcagccgcuucuucagacccuccugugucucuccaagccucaagcaguccaggccacagccagaggccagcaagcccagcagccccagcccguugcacagggacaucaagacccuggagaccugcaguucagcuggcaaggccaggaaggagucaaaguccuugcauugccucccgacuuccuccuggaugacgcaggauuuccagagccccaugguccaguucuccaucucguucagcuccaaguuaagguucuuccagugugguagauaugugguaauaauggcuagaacccaucccagcaaugacagagaaagcccuacugauugcauggccguucugaagaugaaagccauc

SEQ ID NO: 4435 - RNA, 6706 nt, Mus musculus
cacagaucuuuggggacuuuauucacucauuuccuagacauuccuugaauauccuucucucucucucucucgucucccaccuugcacugugcugaucccuacaguacagcaagagaacgcacacuuccugcucccacagagggccuccaaucugagaguuccacagccacuggagcuccauauggagccuuuaugggcaaggcaggaauuccaagagcauauaauauaggaagaaucuagucugugugggccucugugcaggcuccaggucagcucaaaggaaggcaucauuggaggucuccaggcugaggugggugugagccacccagccgggcuguguguagccgaagcugccccaggcaagcuugucagguaaagcaggacuuagagcccacacugaaggauuucagggguggcucugguccugaaggagcccugccuccaaguagagagccugugggagcaggcguucagggcacagugugaggggagacacauccuaccuggguuaaccaugccgggagacagcaccggcaacucgccaguggacagucagaaaucaaaccauaaagcaggguuaaagugggacguuaucauggagauaaaaagaggagccugcagaugcaguguggcgguucccacguggaacaaggguugcucaagagagucagcggugugguugguccuggagcugaggaucggcagggacagacuguuggacacuggaacauaacagaaaagagaauuaacauguucccagauugugacacagaggccucagagaucaugucagaugauggccaaagaguaggaggggugaucucaggaaaagggucaccuuccucuggcuuagguuuuuauagagaaguccuuagagagcuucuaagcuuagcccagcagaugguucugugacaaagguccucacaaccaagcuugaugaccugaaagcaaaaccuggaacccacacaggggaaaagaaaaguccuucccauaggcugugucugcucugaucuccacacacgcacuguucacuuguacacauaaacacacacacucuucccccacaugcacaugugugugcacauacaacuaaauacaaauaaauguaaagggaaauguagaaaaagcuuuuagguuguggagagaaaugagaagaaaggcuauguggaagcaggaaagaggggacucaugugggggggggggcggggacgacacaggggcagugcugaagaugggaugaguaccgaagcuucaguacgggcacgggaaaggccuguugugaaggcuuggguuucccugcccacugagcuacacagccuuuauaaggccauauauauauccauggaguggugggcgggccccuuccugcucaggaugcuucuacaggagacaguguugucagcuguggaaaaccuuacaauuuccuguuaaaauggaaagaauguagaagcacucccguuccccguaagaaacccaccuauccugacgugguggcaagugccucuuaccccagcaggauaaaaaaggaaaaagacagagaaagaaaccaagccauugguaucacaaggcaggugaugagcaagcuugguggagugagauaaggcacaccacgugggggcaguaugacacccaugacagccagguggagcccaggcacagcuccacacagccucuggugucucugggugucauguugcuaaggugaggccaaccaacaaggauucccugcgacucuaaggcaggugcugccgcuggccaugagguuaaauccuagcaggcgucagcggggcuugugggcgcccugacaucaugaccacacuggccacugguguuucuaacacccuagcucauccuuaagggaacggagccaaccgccaaucguaaaggaugcagugucacaaagugauucugugcgguguccugcuucuacuuggccucucucuccuugcacuucagaauagucacccgaguuguugguuuucucccucugcacugauucuuguguguugagggggugugcacgcacaugcacacacaccauaugcaaauuaaugaacaaauuagaaaagaaaucagcaacugaggaaagcggggcagugccuuuccccauccaucacacgaacaugaccuuucccauccaucacacauggacaucaucacgucugcccuuggugccugccuuugccuucaugugaguuacacgccuccuguucacauggauuccacagggucucugggaauuucaggucaggaucugggcccuucuaaaucuucuccuacccugacuuagaaauuccaaccauagccuaagaucuacccccaguagaugacaaacacuuuuccguuggaaccucugagugaaacuuagacuuuuucuggagaggauuuacagccagaggagcuguaaugugcuuuaaaccaaggaagccucagccuggggagaucucgguccagagagaaagaaccuuugcuaccacaccuggugauccgaguccacuccaacaccuccuacacauauguuaaagaaaaaacagcuauaaaaagaaaaaauauuaaaaccaaaggcucuugugauuucaaguguaguguuugggguugugaagacagccuuuaggccucucggaauucgcagaaucauauauaagccgucuucucccucucucccuucagggagaagauugccuacuucacaagagcgaagauuagcaucccaucacugcccgcugacgacgugugacccugccuguggcuuagcaccgccucucagcugcucacuugccaagggaggggcaaagacugaauauuuacuuuuuuuguuguuuucauuuuuguuucauuuugggggcggggcuuguguuuccuguaauauaacucaacucuugaagagcuuccguuucauaccaguuucaucagguuuauuuguaaaguacuuugaauguaacucuuacaugcuuugagaagaaaaaaaaaaucacauaacaaaacugggguaaucugguccaaaucugguccacaaguguuguacaguaugcauguguuaccgcugggcuucgcugcaggcuggacucagguaacaugugcccggugucugcccgcugagccgacugcagcaggcagcugucuagcugcccgggagacuggugccacagcauaccuuugaacuagagagccacacucuccauccaagugagcaucucugagcccaccuggaacaccugcccgguuccuuccaucacccacgucugaccaccuuuucucugcaaaacccuuucuuucugcccucuuaaacuugucuggagaaaacaagagugugaaagccgagggcagaaauagagaagcagagguguacuccugcuguagaaagcugcggucgggggcagaaagaaaacuguggggaggggaggcagcuuucaaaaccccugagaagacugcagaugcuugccuggccacugcuucuaucacagucugcaucugcagggcaagguggccccggccucugaugacgcugcaggcagugcagagggggcacgccucuauccauuagaggagagcugaggucggggcgcaucauaaugagaucaaacuugccaaacagaagagaguuuguuaccagguuucuacacucacuaggaaguauuuuguagcugucaucuuccuagagauucuguccgggagauucugucagggaugcauaaaagguaguugaaugcagaagcaaaggguguggacuggaucauuuuauaucuaucuucuggaugaacaagcaagcuugaccuagaaauuggucaaagagccguguucuucaagcuggguuuuaacuuaccagaccccgggcacuuccuuaaaaaaaaaaaaaaaaagacucgguuuagccuagccagcauaaacauguuaaaauaaauacuuuuucagguaauuuaaaccacacucacguacucugucauacuggaagaagccguguuuuggugagccaucuuauauagcaagcuaaauuauuuuuauuuuuuuaaugcaaaauaauuuuauaggaauuaauagaagaaaggcgaaggggaaaaucuguuuuaaaaaaguuacauucugcuggaauccccauuaguaaggauuuuuauuuucuugaaucuauguauauuuuagaaaguucauuuuuaucagaaucaaaguucguacucagccagaauuuuaauuaucaagugacugcaccuaaaauguaaucauuucccccuaaacauuccacaacguguaccccgcuucucacaagguguaacuggauaggacacuacuuggaacuacaagaagccugguggugggcugagcacagaccucccacgcugcccagcgcccuguagguaacuggaggaaggccaugcuguccacccuuccuggccaggauccaguugagcagcagagguugacuaaaugaaggugccgucuucagcaucauaguuugaccagugaaaauguucauagaauuuuguguaguuguaccguacgauuuuaucuucuucauuuauuuauuuacggucuuauuuauguucuguuuaauauauaguuugguucuggccaucuuaaauguugggcuuacaagaggcuauauugaaguauuuacagcuauaugaucuucaucagauuuaucgcuaacuuuuuguaauacaaaaagugucagacuacgaguauuaaagaauaaagugugucucaggcugguagcucagagcugugacugagggacuucgguuuuauuuuauaaaacaugcucauuucuaacaugagagaaacuauucugguagaauccuuucuccacucugaaagucagcagucauguugugcuuauacaggccgcuuucuguaggucugucugucacauuuguauugacccaaaugauuuuuaaaaaaaguuuuuuuuuuacuaacuugaucacaaaaccauauggaugaauaaaaaauuuaauauuauuaaaaauauuuuuaaacuuagaauuuauucugcauaggguaaaaagaguuuaaucuuuagcucucaaguuuggauuaucaguauauuacauuuuugucuaucagacucaaguguuacagguacaaggaggauauuaacuugccaaauaacaaaguuuagcugagucucuguagcauacaaauuacauacauuuaaaaucuuuuugcuauguauuuauauuguauuaaauaugagaagcucaggacucaaacauuuaaucagguuacauucuggaaauguuucuguuuucauuuguccuguuuguaaugguguguaaauacaucgcccauauuaacuccuguugcugcacuugccccgugucuguggaugaaaaaauucagugauuuuuuuuuaaacaauacauauuuccuaauacugcauuuuaauguugcuuauucaguuaauuucccugauuggcacaaauacaagaaucuacuugaaccauguaucgagcaauuccacaaagaauuccucaagccagaaauuuguugugaauaauucuuguuaagacuguaucccuaaaugagauaggauguuuucauugcucaaggaaaacaaggacuggcgguacgugguccccugcuaaaccaccggagcugacagugucuccuucaagaggagacagccagcccaggaggcacugcccacagacaccaguccugccccugccaccgagccaaggcaggcuggacauuccacugugugacacgguacagacacagaagggcuuuuaugugacagaauucuuccccugagauugcccugcucagccccaggcauggaugagugugucugauguagaaaggauucuuuuugaaagagaggugccccucucucacugaugagucuguaaggaauuuucuuuuuaacucucaucaguuguuacaguugucucacuauccacugagaccuuagcuuccuaagucaucuuagacaccgaaaagcaugugaucuguuucccaaaugauugcucucaauacagaagugcucagaugacguuuuauuuacaggugcccugugugugcacagucgcagccuaguuuaugcacaguaaagacagauuccaucaauagguccucacccacuuggccuccauauagaaagcaaaagugcuuuacucagugguagaaagaacuugugucugaggcggauaacagccacaggagggaaguaugcauuucagaaagucagaagcaggcaguaggggugauuaaagugggagccuaccaaguccgacugagugagauuagagacgccaaugagcccgggcuuagauuucuggauuggcuugcuucagcuccagaugcugcugguggucucgaggucccgccacugcauagugacucgaggcugcaggagccgggcuccagcaggcugcacagugaagcacacacccuccuagcaccaggcagaagccagcaaaccagcccaggaacagggccuccccaaacucccaccugggcacaaucucaggcauggucucaucccagaacucccgcaccgucuugugggccacccaggagacaggaacuagcaccaugacucccgagguccagagcagggucccucccagggugagcagccgcuucuucagacccuccugugucucuccaagccucaagcaguccaggccacagccagaggccagcaagcccagcagccccagcccguugcacagggacaucaagacccuggagaccugcaguucagcug

SEQ ID NO: 4436 - RNA, 1010 nt, Mus musculus
guccacauguugguaaauaacuaauuguacaugauucuugcccaauaguauuugauuauauuaaaauauauuuuaaaccaaaacuuuccuuauuuuacauuauguguuuacuuauucuucaugagagauauaaaaagaugaauauuaacaaaaacaguauuuaucaguaaguuacggggcuagacagaaggcucagaaguuaagagcaguugcuggucuugcagagagagguuccugcuuggauucucacuucccacauuggcaagcagggaaagcacuuaagaaauuugucuaguaaagaugguaagagugauugcacuggcugguuuugugugucaacuugacacaagcuggaguuuucacagagaaagaagacucccuuggggaaaugcuuccaugagacccaccuguaaggaauuuucucaauuggugaucaaggagggagggcccagcccauuguggauggugccaucccugggcugguauucuuggguucuauaagaaaggaagcugagcaagccaggggaagcaauccaguaagcagcaccccacggugcccucugcauuggcuucugccuccagguuccuguccugugugugaguuccuguucugacuuccuuugguaaugaacagcaaaguggcaguguaagcugaauaaacccuuugcuucucaacugacuuuuuggucgugauauuuuguguaggaauagaaacccuaagacaguaauuuuguuguuucuucuaauguuuaacagggggauuuaauaauuuaugaauaaacaggaguaugaaguuagauauuuaauaggaaauaagaaauaaauaugcuuauuucacccuacaugcuuuauuuuucacuccucgaaguuauggcauacagaucagaaaucacaauuauggauaaaugaaagaggcuucaaagaguucuagcaacuuaugaacucaguuauuaguaauuugggguuguugauuguaguagcugauguucacauugcuuucauuuauaaaa

SEQ ID NO: 4437 - RNA, 7164 nt, Mus musculus
gauuuuguucucuuuuuuuguccauauaagugauuuuuuaggaucaugaccacagugacuuaucuuuuuaaacuuuuauuauuuuuauugagacaaaagucacuauuucacccauuuuaaagcacuacccaacuagcauucacuaguucuuccuagacucagaguguucagauggugucuccauugugaauuccagaaccucucaaucauuugccaaagcaauccuacaaauauccagauuccuuuccccuacagccugguaaguaugaugcuacuuucuauuucuguucauuuguccauuuuguacauuucaugaaaauggaaucaaacaugcuacagucuuagguguuuuguuuuguuuguuaacuuaguauauuuucaugcuuuuuuuuuuucuuuuuugguuugguuugaugaacuuuuuuucccuauaugcuauuuuucccuuuuuuccccuucaguuuucaacauuaccaucaucaucaucaucaucauuauuuauuuuuucuuuucuuucuuuuuuuuuuuuuacauuacagauuuuauuccccuccccucccaguccacccuaggacuauuccacaucacauaccuccuucccucuccucugccucaacaagaaugucccuaccacaugcccuaccucaccagaccucuaaacucccuagggccuccaaucucuugaggguuaggugcaucuuuucugaauaaacuuugaccugucaguccucugugguauauguguugggggccucauaugagcugguguaugcugccugguuggugguccagugucugagagaucucuggguugagauuaauugagacuucugguccuccucagcuucuuccagcuuuucucuaauuuacccacagguguuagcagcuucuguccauugguugggugcaaauaucugcaucugacucuuucagaugcuuguugggucuuucagagggaauucaugauagguccauuuuugucagugcuccauagccucaguaauaguuucaggucuuagugccuacccuugagcucccacguugggccugucacuggaccuucuuuuccucaggcucuucuccauuuccauccuugcaguucuugcaaagaggaacaaguaugucagacuguaggauagcaaccccaucccgcacuugaucccugucuuucugcuggaggugggaucuacaagugcccucuccccacuguaggguauuuuaucugagauccugcccuuugaguccugagagucucucacauaccaguucucuggugcauucugcauggucuccucaaccuccuacaucccuaggcugccuguuuucauucauucugcugacccucagggcuucaguccuuuuuucccacccaauacaagaucauguucccuuccccucccccaaaccuuuucccucuccaucccucccacccuccaaccuugugcuuucuucucccucccaaguaggacugacacauccacacuugggcccuucagcuuguugacccuuuagaguucuguggacuguaucuuggguauucugugauuuuuuuuuucuggcuaauauccacuuauuagugaguauauaccaugcauguccuuuuggucugaguuaccucacucaggauauuuucuaguuucauccauuuaccugcaaaacucaggaucucuucauucauaauagcuaagugguauuccauuguguaaaugaaccacauuuucuguauccauucuucugucuugggacaccuguguuguuuucagcuucuggcuaucaggaguaauuccauuaugaacacaguugaacacaugccucuguggcauggugggauaucuuuuggauauauucacaagagugguaccacugagucuucagguacauauauuuccaauuuucuguggaaccucuagauugauuuccagagugguuguaccaguuugcaaucccaccagcaauggaagacaguuguucuuucucuacauucuugccaacaugugcugucaccuuagguuuugaucuuagccauucugauugguauaagguagaaucucaggguuguuuugauuuguauuucucugaucacuaaggacuuugaacauuucuuuaggugcuucucagccauucgagauuccucuguugugaauucuugguuuaguucuauaccccacacuuugauuggguuguuugguucuuuuacugguuagcuucuuaaguucuuuauauauuuuggauaugggauuagugaagauuguuucucaaucuguagacugcugauuugucuuauugacuauguccuuuccucaugaguucccauuuaucauuucuugaucuuacaaugugcguuagccauuccaguucugauuaggaaauuuccccaugcuaauggguucaagguucuuucccauuuucuccucuauuagauugaguguaucugguuuuauguugagguccuugauccacuuggacuugaguuuuuuuucuuuuuuuuaaauguuuuugaauauuuuugacaguugugucaaccuuuucucucuuaucuucuacaacugagaugaucucuagcucuuguauucuguugguuagacauacaucuuuaaaucuugaccucuuucuuagguuuuccauuuccagguuugccuccauuuauauuuucuuuauugcuuuuacuuccacuuuuaggucuuagagagcuuuaugcaauuccuucacuaauuugauuguguuuucauguauuucuuuaagggauuuauuuguuuccucuuuaacagcuucugccgauuuaccuauguuuuccuguauuucuuucaguuuauauccucuauaaaggaaccuauuauguucaugagauaggauuuuaggucagcuucugugguguguguguguguguguguguguguguguguguguguguguguguugguguauccagggcuugcuguaguggaugaaauguguucugaagaugcccauauaucuugguuucuguuccuuauggucuugugcuagacugauacuaucugucuaucccugaugcuugcugguuugggugacacucucuggagucuaccuagcaguuugucacagaagaaaggacagggcagaaaggaagaauauucagcaggugagaguuuuguggggugaugggucccugaguccacugaguucccagcagcagcuuugaaacaucaggaggguucuuaccaaauguuuugaguacagcagaucuucugggaucccucagacuauacugucuuacagggagcagccuaacuagcagucugucaugguuuguuuaaacuuuuaaaaaucuguuuuauucacuuaaauuccaaauguuucccccauaucugguccccccuccaagaguucuucaccaaugcccuuuccucuuugucugauauauacucacugauaacugaauauuagacaaaaaauacagaauacccaugauacagccccaagaccauaaaaaguuuaacacgaaggaaggccaaagugaguaugccucaauccuacuuaaaagggggaacaacauaaucacaggagggagagaaggaccuagagggaagaugggaguaugaggggaaaagggaggcaucagguauggugguggggagaagauacgagagaagaccagugggccaggaaaaugaguggaaaaaugcaguuccagggaauggugaauggagagaacuucuagaacucaaugggucauuggcugaaaugcccaacaguggagagacauaaccugaagagaccacuuccagaugauagacaggcuccccaguggaaaauggggucaccaaccuaccuucaaaauuuuugacccagauuuguucuugucuaaaagaaauccagggacaaaaauauggagcagauauugaaggaaaagucauucaguggccagaccaacuugggacccaucccauaggugagcaccaaacacugacccuacuacugcugccaucuugugcuuguagacagguaacuagcaugguuguucucugagagucucuaccagcagaugacugagacagaugcaaacacucacagccaaccauuggauuaaggauggggaucacuaugggagagcuaggagaaagaaaaaggagcugaagggauugggaaccccauaggaaaacuaagaguaucaaguaauccagaugccuacgaguucccagagacuagaccaccaaccaaagagcauaaauacauagguugauccauggacccuggcacauauuuagcaaaggacuacauugucuagccucaaggugagaggaugugccuaauguuguaaagacuugaugccccagggaagggagauagguguuaaggugggagugaagggguugggugguuugggugucucaaugacuuaucuauuuauuuuuuaaccuuaaagcuuuuugauauucugaauuaauuuacuaaaugcuauauaauuuacucucacauucuggaauguagguguuaaagccacaugcuuaauuaucauuuccauuguggaaauuguguggugggaggagugaaugugcaagugcauauacccauguguauucaugcugaugucaaagaagaauaugaguuuccuugaaugucuccugaucauauuaccuuuugaccagacuguuugacuggagaguuaauugguccacuuaucuuuggcuaccagugcuaagauacugugaaaauggagccaaacuuggcauuauauguugguacuauguauuguaacuuaugaucucauucaucuauagaaagcacuauuaaauauuugagccauuacucugauuuuuaucuuucaacuucaaguuuauucuuuggaucuuauuuauuuauuaaccauuacagggaaguaacacauacuauugcacauauuuagaagccagaggacaaacuucuugaaucuguucuuuuuauuucucuauauggaucucagaaacaaaacacaugccagcaugcuuucuuggcagcaggcacacuaucuuguaaccaucucauuggcuuuucuggguugaauugaauaaauuucuuaauucuaaauuauuuagaaauuuuaaaauauuugcuugcuauuuauuuucuaguuuuucuucuuuuauaauucagugagugugcugauugguuuugagugucaacuuuacacagcuggaguuaucacagagaaaggagucuccuugaggaaauaccuccaugagauccagcuguaaggcauuuucucaauuagagaacaagagggaagggcucaguccauugugauuugugccaucccuguccuggguucuuuaagaaauaaaucugagcaagccagggaaagcuagccaauaagcagcaccccuccauggcgucugcaucagcuccugccucuagguuccugcccugugugaguuccugugcugacuucuuuuggugaugaacagcaauguggaaguguaaccugaauaaacucuuuccuccccaguuugcuucuuggucaugauguuuuguacagaaauacaaaucuugacuaagacagugaaguagauaauauuuuuuuauuaauugaaaacauuuagaguuuucaucuuaaguuacuuguaauucauuauaaauuaacauauugaauauaauguuuuauauguucaauuuugaauauauacauuauuucaaauauucaauguaccuugacauaaacacauuuaguuuuucgaauuauagagaacauuccauaagcauuauuuaggaaaauucuguggauaagucaacucaguugugucaauaucuauucuaauuuugcccuuaauucuauauaauuuaaugauugaguagaaauuuaugauucucccacauuuccugcucucuagcaccaaauuuugauaagcagugcuuucuugacauucuuuccagucucuacaauaaugccagugagcaauuaucauaaaugcuucuuuuauuuccucaaaugaaaggauguaaugagagucaaauccaaguuguauaaauauaugacuugacuugaacugaacucagacucucucucucucucucucucucucucucucucucucucucucucucuuucucucucucucucucucuccacuaucccuaggccuagacaagcuuagcucuuucugaacucugguucaacucagcuauucugacccaaaauccucuccaagcugacucauuaacacuggccuuuugguuucuaaguaaauugcucugcuuggccucagccuagcuuuagguaucucuucuaaucuucugacucuaucucauucuccugcucagucugccuuagccuggaacuuuucucuguaaaacuguaccaguguaauugucucucuuuccuucuuucucuuuuucacccuucuucccucucucccucucucgcuguccgucccugucucucucccucccuuuccaccuguauguguguguguacuugugugugaugcuaucuuaaauugucucuuuucugucuuuuuaugagaguugagcauauccuauuugugacucauucuguuaaaucucucucuaauucaucacuuugucuaccuuucaaauaugacuguuucccucuauaaauuaacccuaacucaauuuuuaaguauuaaagauguauauugagaauguaucuguauuccagccauauucuauugucauccagggaauaucugcauucuggagaauuuucccuguccaauuacauuaaaauauuaaugcaucaggaggccugugauuagacagggaaaaggaagacagagcuaggaguugcagggacagaaaguuauaaaggaaaggggaaagaaaguuagauggaggacagacaggaagaagauccugaaccaacaugguuuuaaauagccacaguuagauaugauaucauaaaggauagaguaauugggauaacuugucuaaucuagaugagcagcuuguaccaauaucaaauggcccugaaauuauugugugggcaucuugugaauugauaauuuauugaucuauaaaucugacuugcuaauuauaaacuucuagaauuuuguuucuuucagguugcuguguguuguggcaccugcccacuggguggauggucuccacguaggagcuccggccccgccagagaguuggcaggcagagaguagcuggauaaagugcaguaccuuggcaguucuuuuuaaa

SEQ ID NO: 4438 - RNA, 12100 nt, Mus musculus
cgagucugccugagucugagcugguggagaccuuucucgcgcuggccggcugggcgcgcggccggcggggacuuuuuucacgcugcucggcgggucacucagcuauggagcggaagucgaaucugucucugcuucuccuacugcugguccugggcaugccccuggugcggggcuccagcccucugccccuggucgucaacacuuggccuuuuaagaaugccacugaagcagguggggagcggcagcccggggcggguggcugcacugugugagcuccucugcaggaagcugcacucagucccuaagguugcaggagggaacccgcugcagaaggccgagccuccucuccuuccugcaucucugacuuuacaccagacccucuccaucuucccugccccugcugcauuuuaggaucugguguauuguucugcuuccugcaccaccuugucugaccucuaacauugggccucuuagcuauacuuguacagggucaccugccucacuuuuuguggcagucuuuugccacaaaguuuuuccuccacucuacacuucuugugauagccuccuuccuguuucuccauuaucuucuggauuccaguuuaggaaacaauugauaauuuccuacggaugcauauguauuugaucaauguuugugacgcugcccuuaucacuuauacauucaaauuaucuucaguguuucuugggauuguaccuuauugcccccaaccuugacacccuugagacugcuaucacauuaaauguucguggacacuguuggauccagaauccagugcagaaaaaaucuguauguuaucggggaugugugggaagcagaguuagugagaaaucagaccaagaaagagaccuccuaacaauaaccaaacaaagaaauuccaccuuuauaugcaugguaugauucugugaaaguuacuaguauugaaguuggggaggggagacuucuuaaaaccaacauccauggaauuauaaguaaaacgucuuuccuuucaauaccuacccacucgauacucaaagaacaccacaaaacacaaacaagaaacguggacaccuuagagaaaugccuuuuugaaacugggcaacuucugaaauauacuguguggccuugaaugaauuacuucauccaugucugugcuuuucuucugaaaaugagaauuauaauuauaaaauauuaucucagaagcugcaugaaggugagauuaauucacccacaugaagucauuugccacuguaauacucugcugaggcuugcugggauacuuguucucauugagagugugaaauaugcauauuuuaguaaucuaaugagugacauaugccuguaauuucagcucucagguagcugugguaggaagacccagacuuguagacaugccuagacuuguacauggauuuucauuugggcuuagggcuagauggcaagacccuagcucacaagaugagaaaaacagaaaugaagaaauguuaagcuguaauucaaaauacuuuaaaguucaacugucuccaaauaguuucaguuaucucucuuaaagauggcauauuuuuuacacagagaaaaauaguuacugauaaguuuuuuaaauaguuuccacuaagagccaaccucuuugaauucuuuauaguaaggagucauauacuuuggucuguaucauucuaauuucccuguuguaauguucccauuugguaaaaugacuuguuaaaauuucagcuuaacaguauaaauguuaagaaaaaaaaaacuuagacaucucaaacuguucuuggcuuguugcauuucacauugaaaauauauaugacuauacauaagcucuguuggaauuuaacagcgugguggacauugcuaucuggagguucugcccuggaugcaguggagaacggcugugcugugugugagaaggagcagugugaugggacuguaggcuuuggaggaaguccugaugaagguggcgaaaccacccuggaugccaugauaauggauggguaaggaugcuuuucaggacuugucugugcgcucuccugucaggugggcucauauucagagcaggcuggaaggaugcaugaaugugagcaucagccagaagucccggcuuauggggcuucucccuuccaacacaaagagugaacagaaaaaagaaaagaaaagccgaaaggucacccggauacucaggaucacagaaaaguaggugguuaaguagcuuuggcugaggagaacccugagaugcagagcuguaccugugccacaguuauuugcuaccaucugcaaaugcuguggucucagugaccucacccagaggccucuguaaaagccauguuuaaaauaauguguugggauauauacuaaaucgacuguucguucuugaauuuugucugcgggaauccaugaacuuuacgggcgguuuucccuucuguguugagaugcaguuuagccuuccacguauugcugcuccgagaaaugcgauuuuuuauguucaaauaccaacagaaaaugccuucguaaaucuuccacguccuugccuuccagcacugccauggaugugggagcagugggaggccuuagaagaauuaaaaacgcgauuggcguggcgcggagaguccuggagcauaccacacacacgcuuuuagugggggacucagguauauguaaaaccauaccgaaauuuuguuccagucuuuuugucuauugucacugagaaagagagagggagagggaggaagggauguggggaggaacaaaggaaggaaggagggagggagggagggagggagggagggagggagggagggagggagggaagaaggaaggaaggaaggaaggaaggaaggaaggaaggagggaaggaaggaaggaaggaaggaaggaaggaaggaaggaaggaaggaaggaaggaaggaaauaacuagcuuacugugauguagagagcaaaggagaccuaaguugaaauuccugcucuuucaguucagaaacaguaacuggucacuucugaaucuugcuuugucuuuaagacaagugcauuguaagcaauguuaucaucugucccugcgugauugcugccaccaaagcaggguuucuaucaguucccauccgguguggcauuucuacagaucuaagaccgguacagaucuaagacccagggggggaggggagacuguuuauaugagacaguggugccagagauugcagugacagugucacuuaaguccuuuccagguuccaugacagaggguucuaauguagccuaugauagagaaaacuauauuaaugguauauuuauguagcacucuuaauaggcuugccauagaauugcagacucccugaaaaggauggccuuugguguuugaaauccauuugugugucagagagcggugugcgcucugaaaggcuguagcuguucaaagucgaagggaaacauucgaaagugaagcaguaaaggaaauguguacacaaccauugguuggucuccagugguucggucaugggagauacagaguuauacacaauccagaggucugcaccagaucagugaugggaaagacacagauacacaacccaaaggucuccaguggagcagucaugggaaugacacagggaagcugaacauccaaaaacuuccccuuuaaaacuguuuacauacacaaaugcuuuugcaagccuguguacagcccuccucugaugucuuuccaugccccaugcgagugacagcugacccacagugccucuaggacauggauucugcuuagaaaacaacaaaugcacuagcaauauuuugcugaaaggacccagauauagcugucuccugugagacuaugccggggccuagcaaacacagaaguggaugcucacagucagcuauuggaugggucacacggcccccaauggaggagcuagagaaauuacccaaggagcuauagggaacugcaacccuauagguggaacaacaauaugaacuaaccaguaaccccuggagcucgugucucuagcugcauauguaucagaagauggccuaguuguccaucaguggaaagaaaggcccauuggucaugcaaacuuuauaugucccaguacaggggaacgccagggccaagaagugggagugggugggugagggagugggugggggaguaggaggggggcuuuugugauagcauuggaaauguaaaugaaauaaauaccuaagaaaaaaaaaaagaaaacaacgcaugggcuuacacuuuccucuuucuucuccagccaccaaguuugcugaaaguaugggguuuacuaaugaggacuugucuaccaaaaccucaagagaucuucauucagauuggcuuucucgaaauugccagccaaauuauuggagaguauguaugcaaauucaacuauaaaaagucaacuuuaagugaucccuuugacccucuuuugccuguguugaugaaugcccuggucacauguuagaaucagugguauacguugacucuggguaugcccauuuuucaggaaucccucucagguuaauaacucuugcucucuggcaguaauauguaaauucaagguuugcuaggaagaguugaacugacuccaucaacacuguuuuacuuggauuuucuuggaagaaaauccgccgucuagaauauuucuuagauguuaucuaugugaaauauaucuaauauguugcccaugcuuuggcuagaagauuuacaguucaggaucuaguuugucacuaaugagaccauuuugucuugaguaggaauuuuagcauaaaucaguuuggcuuugccacacuuccaucgauuaucuuagccucuaaucucuuucucccuuuaauccuacuuaccagggcuuaguucagucuucaaaaaccaacuggcuguaaacgcuguacacagucuuacgagguaugaguagaaugagcaucccuaaaggaaaagucugaaauucaaaaugcuuccagcaccaacuugaugucacaggagugcaaggccuugcuacuuuaugcaguacauugcagucaaaggacaaaugccacuaaaagccuguauagcugucuccagaguaauuauagagacaaacugaaaacaugggugaauugugugcuuacacuuggacccaucugugagcuaucucauuauacacauguaaaaaauggcuuaauagccaaaguauuccaaaaaggggugcucagcuuguauuaaguuuuugucuuggccuggugguggcaaugguggcgcacuccuuuaaucccagcaucugggaggcagaggcaggcagaucucugaguuucaguccagacuggucuacagagcuaguuccaggacagccaggucuacauagagaaacuucaccucaucucaaaaaauuaagaaaugaacaaauuccuaucuuaauaccaauccauccaaacaaccuaaauguauugguauauuccuauacuuuuaauauuuagcagagucuuauacugccaccuagaaaggcugcggccggagggguccagcucauggcccacgggcuccaggaagcugagaucagugguguccaacacaaacuuacacagugacuuagaaccugacgcucugugcagugcccuguuguuugauuuuaacuugagugagcaguucgcaaguauaaagguugcagcugacaaugccaugucucuguguccaaguuggauacuuuaugaaccauaauuaaaaguaagcuugcuuucaaacagauuuuacuugaaaucucacaauuugucuccugcgaaccauauucugacaggucaggcugggucuuccuuugagaugaacauagaauuucuagaaacguuauacccgccauuguucugaggcuguaccuauguaaaggcagcauccagcaguguaguguuugcaccugcuguucugauccacaacguguaauuugagaaccaucuauugucacauaagauuaagcuaacuuuugaguucugaguuacugaugucuuucugguuucuucuagugguuagcagucauacacaauuauuugcccauuucuaaaacacccuuuuuaaccaaacaucuggaaucuuguuuacagaauguuauuccagaucccucaaaauacuguggacccuacaaaccaucugguuucuuaaagcagaguauuucuccccacaaagaagaaguggauauccacagccaugauacuauugguaagucacuuguucugcaguguuauugauuauuuuacuugaugaccuuccacagcucuuagucauuuuuccucaugugccaggaguuagucugcuuucguuauuuuaacugccaaguaaauaccacauugauaugugugucuugcucucacuauauguacaugcacauauauacauauauaacaaaccuuaaaaauaaauucauauaugugguauguauauauauauauguauaaucuuagcaucugaauacagauuuguaauuacacaaaacaucaaauauccagugacuauuaaaauauugauuaucaaaucauuaauauuuaaugcuuugguaauuuuauguaauuugcuauauaaaauaaucucuaaucauuuuucuaagcaguaauguugacaguuucucuuaaucaaaaugaaugauuuuauuggaaauugcccuugaaaacauacugaaaguaacugguagauuugaauauuaagaauauaaggaaauaaaaaagaaugugagaggguuuuuuucuuuuuuuuggauuuuggguuuucguccaauaauacuaugaaaucaggucauuaauauuuauaauauuauaccacugauacaguuuuuagucuucuuacuuuuuccuguucuucuacauauaauuaauaagagaacauacuuuguuuucuuaauggagucaguauguaaaagcucacuaccauagacuagaugauuuauaaacaacagaaauuuauuucucacaguuuuagauguggaaaauuccaagaugcagacaguggcagauucauugccuguugcagucccauuuucuggcucauugguggugcgucuaguuuuuuuauuaaucccacuaauuagggcauugccccuaguaaccauccaccugcuacaguucccucuaaauccauuacuuuauggagauauaacucugaggggacacaaacccucacacaguagcaguccucaaccgauucauuguguggauauauuuaagggauauucuggguacucacauuguuuuuguuuuguuuucuuaucccuaggcaugguuguaauccauaagacgggacauacugcugcuggcacauccacaaaugguauaaaauucaaaauaccuggguuaguguuuccccaagaacagauuucucaaauauguaucaaauguaaaacagugcaugccaacgcuugugcagggcgccaaggauaaaaugaaauccuaaccucacagauaaauguggaagaaaacaucaaagcaucacagccgaaaacgccagaguuuagaaauguuagggguuaaucugugucaccuguguaguuaguaaugcugguaaaguaauaaauugagacugggaccugacuacacaggaucgaagggggacaugcagcaugcagccagcgguccucguguauacaaguaguccauauuccaggcugauggagugguggcuggaagaaaagcuggaguguggugugugugugugugcgugugugugugugugugcgugugugagugagugcgcgcaugcacacgaaugugugcacacucaugugacagagauuacagaauagcaauaccuugggauagucguggagauuaagaggaaugcaagccagauaugcuugagacauuguaggucucuuuuguucuugcuuuguucuuaaguagaggaaaggaauuaaguaggcuuauuaacagaggaaacugguauaagucgggcacguugcauaggaagccguguaaggaaauagagcuuuccaggaacaccagagauugagaaauguguaagcagagaggagucgcuguaaaucucugugagcugacacaaugaacugacgacaguguuugcuaaaaauuuuaauugcuaagaacaaguauuuauggaguauaacaugauacuaucauacauaaaaacacaugugaaauaguuaaaccaagcuauuuagcuuaugcauugucucaugugcuuuuuaaaaucucuccucuugcagguuuuccauccauauguacuauuauuaaauguaguuucaugcaggucucuagaacucauauuucggguuuuaaguaauuucuuuuuuucugucagccacccucucuccacucucagaaaagcgguguuuucaucaguuucuaagaauucaguuuuguuacagugaaaaucugccugaaaacaaagucauaaauuagcauugcucuuugaaaaccuuaauugaaaaacaaacagaaaaugaauucuggugaagcacugacuuaaaacaguagccagcggcugggcaggaacagcccccaguuaugaaacaguuuacaacaugauuuaguuacaucugguuuccuguccuaaauuuuuacauugucuguucacaaagucguguaggggauucaccaaucccuggagccggagccuaugcugaugacacggcuggagcagcugcagccacuggcgauggugacacacuccugcgcuuucugccgaggugagacuuguuaccuuuguaaauccccaaaguccuuggaagagacagcaaugccaggacagguaggauuucuguaguguguugucugacuucaugugcaagagagauuuucaugaagcugggggcagguauuuuuuguuguugguuuuguuuauuuauuuuugauuuuugugguuguuguuugguuugcuuuacuguugccaguuggcuugugauccuucgcuugugucaucuuuacccuguggugugaaaugugucucaccuugucucaggagaaugcuuaugaucuguuuaaggagacaaggccacagugagaugacugcgaagaguagagugagccacugugugcagcuaauaacuacaugugugccauuugaacacagacagugauuauagcuuuuccuuaugcaaauauaaccacuauuugugauuuuuggcuguuauuacuaaagugacaguuucucagccaaagccaaaaauaauauagucuucaucugaaaauaaugguggauaacuugaauagacagggguugacugccuugguaauaaggcuggauaggaauuacugacuuguauucacucauagguauuaugcucgguguaaaaauaugguuguuucugauuuucugaugucaaccuagccaaauguggaguuaguguuuauucuguacucuaauauuaagcugucuccucuguuuauauuagcuaccaagcuguagaauauaugagaggaggagaugacccagccauagcuugccaaaaagugauuuuaagaauucagaaauacuauccaaacuucuuuggagcggucauaugugccagugugaacggaaguuaugguaaguuagauguguuuuuauuugagugaauuuacaagugaccuuaaaagaugcacgccucuauccaagcacgcucuacacuauauucuguguacaaagugaguguguaaagguuaggcagcuucugagugcauggcaggggcuaaucugucaguuccaguguagcacugaacuauagaccuaaagugacugcugagagucacggucuacuauucugcugcaguucuuaucuuuugcaucuguccuaaaaguuuaguuugggcuggagggcuuuuugauagucgaauuuaaucaaaagcuuucacugguuagagauaguggggcuaaauuaaucucccuuacuucucucucaugcauuaaaacaucucggucaugucagucuucuuggugcucugaagaacagacccuugcuggagagucagccagaugggcccgcagaauugaucugacaccgcuugugccaugucuucuguuugcuuccucaugagccaagcccagccgcaaaguguagaaggucaggcacuguggcuucccaucucggagucuucagauggagaauaugcagagccuacugaucaauagagcuuauuaggcuagacugcucgcugcucuucuuugaucuuuuacuucccacacuuuuguauuuggagagcuuguuugaagaaagccuaauucuuuuuuaaguucuaagacauaaaagucaaacaaaguuauggggggggggguugcuuuauguaucaaagaaggcacuuuaaugauucccucuuaacagauaagccacagaaggcucaaauuuacauuuagcagggugggaagauacuaauuaucuaacuauaugaauuaaaaguugacuacgucuaauaaagucgugacaggaagaccucucccccugcagguaugaagagaaacugaacucagacagaaagcaacuugaccaauagcucuucccgcuuuucccauccccgugaacaggggugggaagagggggaggaagcagugaugugggaagguuuucuagggaagagaacauuguaguagcuaggaaaauacaaaauuugaccuuuuuuuuuuuccuaaggaagggauugaaagagcaaaauaauagcagugagagcaagugcaugggggcaggcauuggcucuuugauguucaaggggaucaauuaggucuggagaaauggcucagaaguuaagagcacuugcucucuuuuuuuccauuaauugguuaauuuauuaacacugcauccugaucgaagcuaccccugccuccucuccucccagucccucccucucacuucuucccccacccccucauuuucucccauggggaucaaccugccuuggcauacauaucaagcggcaguaggccuagcugcaucuucuucuauugaggcuagacaaggcagcccaguuagggaaagggauucaaaggcaggcaacaauguucuagacagccccuacuccugcuguuauggaucccauaugaagaacaaauaacacauuuguguguguguguguguguguguguguguguguguguguguguguguguguguauauaggagguagggacuaggucugucccacucauggagagcacuuguucuuguauaggaccuacacacgcacauuagguucccaguacccacaaaguaucucacaaccaucuguacuccaguuucagagugucugccuccuucuaaccucuuugauaccaugcacacaugagauauacauacauauaugcagacgagcacuuagucacauaaaauaacuuuuaaaaagcuauaauuacuuuauccuccucuucuuccaugauuuuucauuacucucuaccaugaagacaggaagggcaaaauauauacacacauacacacacaaaaauauauauauacacagugccauaugccucaacaauaucuaugccaauguuaucguuauugguucugaauacaugccuccuauaacccaugucugucucuuuugucucaaggugcugcuugcaacaaacuuccaacauuuacacaauuuaguuucaugguuucuaauucuuuacacaaugagccaaccgaaaaaaaaguagacugcaucuaaucuauucuguuugucaacguguguauuugaagaaggaaagucaugaagguuuggaaaguugcuuacugacauuauggaaugucuucauuuauuuuaaguucuuguguaaauuaaguaaaaaaaaaauaaauuaugcucuaauguuauuucuuugucuacuuccuuauuuauuuuuauuuaagucaguuuaccacuugagaaugaauaugcauacauauaugauguauauuuuuaaacuuaaagugauauuuggauuucugaucaaugccacgagaaacuucuacucugggguuuuauuuuuauaaugccauagaaaauaaaguaucuguaccagaggacucagaggacagaagcuggccagguccccuagaagcaggaccauuaucgcagcagaguaaaccuaacuuaauuucagaaguuccagugguaugucucuuaccaccauagccuuaucauuagcuuugaccggauucucuguaagaccucaaagcaggaaugaugguauuaaaaucuauacaguuuga

SEQ ID NO: 4439 - RNA, 9567 nt, Mus musculus
agucuuuaaaaugcauauuuuuacucagaaaaaaaaucuuuauuagaaaaauguugaacauuuauuguagcuaagaaaaauuuugcacauauauauucaguauuuuuaugaauuauuuucuugugcauuuguuuaaguaaacaacuucccaaauuucauaaaaacuaugaaagaacuuuuucaaacauacaucuuugaagcauuggcagucucgcaguaagguacgcaggcuugugacugaaagcaaaagaagcuuuugaaaucgauguuugcuacaaucaaaggucacagcuccgagguuaaaguaucugaaagcagacucuccacucccaggccccugcaccagcccccauucaaagcuuuagcuccucaaaguccaauucuucacaggaauaacuggcuagaaagaccacugaagagcuguaaaacaauucccagcaaaggaauucaacccagccuguuuuccuauuuuauuuucaacaguuucuaaagcuguuacuuuccuuucagcaugagcacaguaaaugcaauagggccagacacaaaagcacacaguugucuaguuaagacugagagggauacgcugggugcuacauguucaaguucauuucuaacugcaaccucuuuacuaacacucuugcaaucaucuucuuuucauagaaucaccucugggcucagccacugaagcacugagucuucucuaaaacacugagaccagagaugcuuaucacacauacgaacuuagcaaguuacagcaucaucacagacugauaaagccgugcacgcacgcaauggaguuccugagagacagggcuaguggcaugccggagcagcugcucccucagcugcuaaaaacaaaggccauuugccauauugggcuuuccuuaccaaacaccugaacugggcuuuucagauacauaaaugucaguguuagauagucugugcucaaccaacauagccacucaucacaaagguacagugaacuguuaacugaacugagguguggcuuuaaugcccuaggcuugggagggcuuccuuagcuaggacacacccagacccucuaacucugacgcuugcagacuuuacacaucuacuaucucaucgauguauaaagcucacuuuuguagguguaaaauguagcagaagcucagauccuuaugaacucuguuaaucuuuccaucacuuuucugacuucagaucacuaaggugguuuccuguucgaaaucugcugaacagaaaacauaucacaacuuucuauccuaguaaaggauccuuuuauagacaaagaaacagagaccccgaaauguuuaaggaacgugcuggugccaaucucaaggugcgccucugaccuuucugcugguaagaaaaccucaaacacaugcauuuguaagaacuguaccaccacauacaagagcuguuugaugaaugucacuaagcacaugagguaaacagaacaaaugcuaauuuaugcuauugcuaguaaacagcccuuuuagguuacuuuagaaugugcguagugucuacucuugcauuuaagaguagccaagaugcagaugcuaauucugagaguauuuaucaaugaggaaaauaaauuucaugucaaauacaauuacauauucaaucauauacaacauauuuaaucucuaaauuauuuuacaaaucuauauaguuauuuuaauauggguaaaaaugaauauacacaaagauaucacuguguaaguuguuggcugcuagaaaauuaguuucaaacucucauucccagaaggaaaaugagaguaaugaacuacaauaaaauuauaugaaugugaccaauguguaaacugagguauaaaacaagaccacugcuugcuuuuuaauuugggugcaagucaguaaguuucuggguuucaguuucuucaccugcaaagagcuaacauuuguacucucuaccucauuaggaucacucaagacaacacucaacacaggagagaaaccuguggguggaaaagcacugacagcugucccuacuguuccaacuguaaaaguauggagcuaugcaaacuguacuuaaccacagaggcaagcucagugggaccaauucaguucaggaggaaauccaugcaaacauuuucaacuuugcauggcaaagguaaaauuuuaaagaaauacacaaagaaacacucugaaaagacugaaagauacacauuuggcuggguugaaacuuuaaaaugagccugcuagauuuuucagcauacaaacagguucuuccucuucauuuggagaaagcugcuacucaccuaaggaaagcaagcaugauugggcuuuguaaaagaaaugggauacaauuauaccacucugcucguuuguaaaccagacuucaaagaaccacauucaucuaguuuccagucaucuacacuuaggaucucuaaguguauacacuuagagauauaagagaaugcccaugaguaagucacaacugccuugcaugaacacaaaggauacaauucagaauucuuaugacaccugaaugucuaacagcccuuuaugaucauuuuguauuccguaagauaauauaaauacguguuucaacccuacacugcugauagauucuuccuaugcaguugccucguucuucauaacuacucuccucugggaggcuuuuucugucuguuuacaaagcuaagcuuaagcagcucagaaccuuucacuucaacugcgucuucugacgugaguuuuucuuacauccaaacaaaaaaggaaaaaaaaaaagaaaaaaaaaaucaaugaagaaaccgggaagagaugagaugcaauucaacauguauaaaaauaugcuucaaauucagaauaauuuaguaacucuugguuauuucguauguaucuggaaauggcacagacacaugucccgauccugucacaagagguagaauuccagcguuugguacaacguuccaggagagcgucagagugacauuccuguuuccccuacaaaaggauggaauaagcaaagguuagcagaacuugucauuuaaggaaaauuucaaucaagugcuauugggccauacacuucaucuguaacuagcuguuucuaauagacaaaacauaacaauuuuuuuaugaaauccacagauagcacuagaagacaucaacaugaaauucacagguagccuagaugaccagcauaaauucacaccugcagcuauuuaccaauaaaaaaagcuuacaugaauagaacacaacaaggagaaaacgagacucaggcuaggaaucaaaaggcaauagugugaaaucuaauuuugccauuauuuagaggugcaaacugaagcagaucaaaaucuaucaaaauccauguuauuugcacauccaaaggugugauuaguucaaaucuuauaaagcaaaggucaaaauggccugagaucccaaucaucagucauucugauuuccucuucuucuaaagaguaaacugaauuuuuggaggggaggggagaggggaauaaguuaaagaagcaacauuagaaucccaggucuccacccaccacacugacuccucaugcaggcuccugacucgaguucagaaagcagagcuauaagguaacaguggcgccccucccacacaugagaaagcacccucccccugagugucccuguauauucaauaguaacagcuauugcacggguuaauugucugucaaugacacaggauauagugaucucaggagagggaacugcaagugaggagccccauuagacuggcaggcaggcaagcuuacggggcauuaauaacugaugacugaugugaaggauuuauccugcuguguguggugccauccuuggacagguagucugggguguagacgaaagcaaacugaggaaguuaacgagaggcauuucuccagugucugccucaguucucgccuuggcuuccccuaaugauaaacuguaaccuguaagccuuguuuccuggugcuuuauuauagcaauagaaagcaaacuguaacagcgguggacuuuuauugugauuacagcauuuagcauuauuagagaauugauuacuaugaccaaugccaauuuuucucuuuccucggucuuccucuuccuccuccuccuccuccuccucuucuucuucuuuuaagauuuauuuauuucauuuauauaaauacacuguagcugucuucaagcacaccaggagagggcaucagaucccauuauagaugguuaucagccaccaugugguugcaugaccucuggaagagcagucagugcucuuaaccgcugagccaucucuccagcccccucagucuuucaguugaguucaaaauacacaaacacuuuucucccaaacuguuguacuaacauuuuuauccccuucccuucuuaacucuccuggaaguugaacaagauccugugcaugccaggucaaugcuacuauuuccccaggaacaguauuuuuuucuuuaaaauaaaaacacauuucaucagucucuuaccaauauuacuuuaaaauguuaaaaacaacaaggaagcacucacuugaggccauuuccaucgucaaagaagaaauacuuugucuucauaucuuucaaaguagcuucggauuaucaccucucaaaacaauuuugucccaaaggacaacuugguucagagccuguaucaauugaaaguaauuagauaacucaucagggacacucucacuucaaaaccaaagccuaaguaauaagcaaagagcugaacaacugcauggaaguguacugauuacucaccaaagcaauaauuuaaucccaaacuaguguuaucuuacuggcuuuacugagguaaagcagaauuauaaaaacgauuugauauacccaccacaaaaguaacauugaugcucauaaauuuuggauacacucaauaguauuuauauacagcagauacucuuauuauaaaauuuucuauuuuuaaaauauuuugaugauuuuuaaaggcagagaucaaaacucuuauuuugaaggagagcuuuuucugcugucuuuaaaauguuuuguugauuuuuaaguuuauucacccuaguaugcccgaugucuaaugaaauaucucgcauaaaauauaugauucaaaaauuaguauaugaaguuguuuaacaugcugccuagaggucauauaaaauauagacccaccuguaauuacaaauuaccuacugccuuaggguuuccauugcuguaaagaaacaccaugaccaaggcaacucuuaucggaaaaacauuucacugggguugccuuauaguuucagaggcuagucagcuugaaggcagacacaguucuagaggagcugagaguucuacacauuaaucuaaaggcagcaggaggagacaggauuccacacuggguggagucugagcauaggagaccucaaagccccaccuccauagggacacacuuccuguaaccaggccacaccuacuccaucaggaccacaccuccuaacagugcuacucccuauagccaagcauucaaacacaggaggcugugggggacauacuuauccaaaucgucacaccuaccuacaaugaugaaaaacagaauugcuuuuggcagcaacauagaagugaugucuuacuuguguguaucucaacuugauauauuaaguaagccacuccauacuuuucauuaucagcacuauaagagaagcuaagggagucaagaaauagccugcugucacagcgugcacaccuuucugggcccuuaaugcuagagagcuacaaggcacacagagcuuaaacaggcuacugcaggacagaaagcuuccucacuacagccuucucucugguagcuugaguuuuuuguuuuuuguuuuuaaacuaagcuaugaaggucagauguucugaauacauaaaaauguaucuucuugggucagugacaaccucagcgggugggguacaauccguggaacccuugaggagaggacuaauuguccaacaaguaauuucuugaaauuacauucuuuccuaagaaauaauguuuaaaaggaaacuauuguaauauauuuagauaaguacuuacauuauuuuuuguugaauacucugcagauaaauaaagaaauaacugcuuaacauuccaaucaaauauauucucuagauguaagccaacaguuaaggacucuaaagacuggacagcagcacacaacuuucuaacaaaccuuauucuuaaaacaucuaucgcuccaugaacacugaaacaaaacagaacaggcagaccacgaauguaccaacauuaauuaaaaacagaaauacuggauacauauauuguaaaaucuagcccauuccaaagggguguguguguguguguguguagguuaccaucccggucuuccuguaagcauaacuagcugacuuacuuauugaaaaaaguaaacauaagcaacugaaacuuuaauucuguccaaugaguucaaaagaaugaggacuuagucuuucggagaaaaacaguuucggaagagcuccaaagcagaaccaacccucacuauucaaaguagcuaacacgcauaugcgcacugagcucaagcaguuaaccaagcacagcacucuauacaaguugauguggcuacacaucaguccugaucacagugucucagugugugggguacugcgguggcaguaaagaaacaccaacagggucccauucaucuuggagagguacuacuagaagagauuacaauacuaagccacacugagaagagcuaacaugagaauuucuauuaaauauuaucuauaaauuauuaauuguauauguauguacauauugauaggcuuaucacacucuaauuuuaaaguauacccacuaccaguuauuguucagaauagagacgucuacagcaguucuuuacaaacgaaaaggacaauuucaaauaugaggagauauuaagaaaauccugaacaaacuauaagacugauaguguauaaacacaauaaggaguuuccaaucucaaaucuggccccuuccuuuggagugcugggguuauaggcaugccccacaagccaguuuuaugcagugcuggggauagaaaucaggacucguagaugcacacuaggcaagaacucuacccaaugaguuacacucccaguggcuuaaugugguuuucuagaauacaaaauacuacuuccaucucugccuaagauccuucucaucuaagauuuuaaaagggcaugaaaauuuaaacacaaauuuuuaagauuuuucugauggcaucuguauuuccacaaaaggaacauuuuaaacuaauuccuacuuuauaccugaauccaauaauuugcuuaauuaaaaacugcaaauaguuuaaggaagaacagcugguaaaccagucagacauaugcuuuggucagcugcuuuauacaacagucuccuuaaccaaugauuaauaauaauaaugaugaugauacacugccaggauuacaaccuguggcccuaaaggagacuaagguugccgagacgucaaucuggugaagacagagacacaagauaaagagaaaauaacucauccuggcugaucaaagaagcuucauuaggcuccaucugaccagacagacaggugauaaaacgcugacauaaguugucaucaguggcccucugaacaaaccacugcagaugcaacguccuuugaaacauaggagguguuuguuuguuuucucuccuaagagaugagagauuauuugagauugaaaacaggcuauuucugggcaggcugagcucuggcgaguuuuuccuucucuaaccaaaaugauuuaacuguaucuuuucuuuccuaccuucaacuugcuguuuaaacgaagacuuaagauauacgcacaugacucccaggcugggguggagucauacucccucuuccccuucuccuacacucgcaucucauuucaaauguacagaaaaggcaaugccaggcuuucuugaaggauaucagcuguuauaucaaaugugaugaaucccaggucacuucuuucucuagggcccgugaagucuucuacauuuuuucuagaaguaaagauaaaaguuuuaccaucccucacaguaucacacuaaacguacacaacuugaaacaggaagggcuccuugugugcagaagucacacccaaguuuaacagcgaaaucguaaacuuaagaguaagcuuuugucugaaaauaaauauuauaauucaauacaagagaaggcagucagugguuuucaucugccuaacgaggagcccugagagaacacaagggaagagaaaaaaauaaaacuaaaaagaaaaacggaaacacaaauacuuuaugcggagcaggccacaagauaaucuggaacgcagcaccugauuauaagcacaugccauaugucagagccaacaugcacuuuccacaauuaucugaaauccauacaacaauccuuccagugacuuucuucacuuacaacaaauguuaacaccugcgacugcaagaaaccuguuuaagaucacaauguuuaauauguuucaaguuuaucuaggucaccacagaaggugauggcagggccgguaucuaagcuacgucuauuuaaaucaccaauaguaccuaacaaaaaguguuggggauaaaaaugaaaaaucaaaagcagcagcaguaguaagaggagacacuuacuggugauucugacaaacaaauuaguaaaccaaggcuaaaagaacgggcagauuguagaggacaguucacacagagcauacaggaauuaaaaccacugcgugaaagauaaaagugccagaaaaauggagggaaaugcuauaaauaaaacaggcaguacgggaaaagaacagucauuucgaaauucuauuuuuaaugucuccuaagacuuauucagguugcuggcuaaagaaugacguuaaaaauaacaagaaacugggauguuuaaaccgccccugugcauccugcacauccuaacuucaaggcagcagcugccaaguaguguguccacgagggacagacagacgucuucagggacugucaaagagaaccaacuggggcuggacgugacaccagagccacccaccgaggcgccuggauggacacccaggccaggggggacuggggacuggcugagguccccacgcgcgcuugcaggcggggaggcgccgggcggaagcgcgggugugggugugcuguuguguugcucccucauuggcccgggugggugagggacgugcagaacaggaaggaaggggagcgcugacccaggccacucgggagacgaccgcgcagggcuggggucugagggccccgggacgcgcguccgcggaguggacggcccgcggcgaagcccucggggaccgcgcacacagccccgggcggggccggccggccggccgcacucacagcaugauccgcgagacgugcagccgcacugggacgcuccugucuuugaaggcgguggugaugaagcagccgaaggugagcgccgccaucacgcucagcgagaaggcgaacagggaguucgcgcgcgacaggacgguguucaucguggcgaccuuucccucccgggccccggcucccacacucgcacuucaggcucugcuucccgcggccgaccaguccccgcccacccgcgcaucg

SEQ ID NO: 4440 - RNA, 1523 nt, Mus musculus
cauggagacuagcuccgaggcagguguucugcugaagcugcuggaucgccuuugccaggagaccgacccaggaaagaucuacaaaacgcugaagaaaaugucuucucuuccuucucugugugacugccuugcagagauuggcuucagagaaaccaucaaguccuugaagaaacagcagcuccucgugcccuuuguaaaggacuuaguggcccagugguccacuggguuccugcuuguaucccagccugagcaggccaggcaggacuuuggcuuggagaagggccucacaacggagggccugagcaccuccccagaagagaagccccaggagcaagcaucccaggaaguccgcggacaugggagagagguuuuccuugggcuuugcagcugcugcccaggcagcagcucuugccuaagccagagccgaaaaucgcaccaaagguccaacuguagggcaccucacauucgaagcccgcauccaggagaaaacuggagcccugagcugcagcaagauguccagaaccugguacaccuaggaauguccagggugagccuggaggagcauuggcagcaggaaggggccaagccccucuccagaaagccaggggcugggccacaggagcccacugggcuuguguuuggugggcacagaaagugccagccaccaggcaacugggagcaggaggaagccccuggagcugguuccuccugggcuugccucaauggggagugcugcucuccuuccucuucggagcguccacggggcaagaggcagaggugggaacccccguguccagccgaggcccagaguccuccugcaaaggugccucgagaugagucuggaagcuccauggaucugagucccauugcugccagcaccauuccagagacucccuccaggagccaagccugguuggaaugggaucuugcccaggagacauuuuccucucagcaggaucaagaagccucagcuugggggugggagcucaggaagcagcacagaacccaagucuauucagguugcaggccugcagcaggaccccagcagaagagcacuggaacaagagauggugcucacugccaggcuggcaaggacaaaguuggguuugggcagccagaagagaaguccuggccccagggccgcaggugcaaggaauccgacagccagccugaggcccccagauuccugcagcuucaggugucccaagaggagaggcugcaaaccgucauaggccgccuccaaagcacaagagccaagaggccucaacccagacagacgaugauggucuccuucaucaccgagcucaagagcccuagccaacaaggacagccaggacccacuggggcugccucugcccaaaauccgcacagucuuccugaggcuccugcccauccuccaguccagagggcuuccugccuucuccuuggagaaagaggcaccaaaaagggcccugcuaaaagaccugcuccucucauggccaaggcccugaaggacuacagaaagugcuucuauaaaaggugaa

SEQ ID NO: 4441 - RNA, 1523 nt, Mus musculus
cauggagacuagcuccgaggcagguguucugcugaagcugcuggaucgccuuugccaggagaccgacccaggaaagaucuacaaaacgcugaagaaaaugucuucucuuccuucucugugugacugccuugcagagauuggcuucagagaaaccaucaaguccuugaagaaacagcagcuccucgugcccuuuguaaaggacuuaguggcccagugguccacuggguuccugcuuguaucccagccugagcaggccaggcaggacuuuggcuuggagaagggccucacaacggagggccugagcaccuccccagaagagaagccccaggagcaagcaucccaggaaguccgcggacaagggagagagguuuuccuugggcuuugcagcugcugcccaggcagcagcucuugccuaagccagagccgaaaaucgcaccaaagguccaacuguagggcaccucacauucgaagcccgcauccaggagaaaacuggagcccugagcugcagcaagauguccagaaccugguacaccuaggaauguccagggugagccuggaggagcauuggcagcaggaaggggccaagccccucuccagaaagccaggggcugggccacaggagcccacugggcuuguguuuggugggcacagaaagugccagccaccaggcaacugggagcaggaggaagccccuggagcugguuccuccugggcuugccucaauggggagugcugcucuccuuccucuucggagcguccacggggcaagaggcagaggugggaacccccguguccagccgaggcccagaguccuccugcaaaggugccucgagaugagucuggaagcuccauggaucugagucccauugcugccagcaccauuccagagacucccuccaggagccaagccugguuggaaugggaucuugcccaggagacauuuuccucucagcaggaucaagaagccucagcuugggggugggagcucaggaagcagcacagaacccaagucuauucagguugcaggccugcagcaggaccccagcagaagagcacuggaacaagagauggugcucacugccaggcuggcaaggacaaaguuggguuugggcagccagaagagaaguccuggccccagggccgcaggugcaaggaauccgacagccagccugaggcccccagauuccugcagcuucaggggucccaagaggagaggcugcaaaccgucauaggccgccuccaaagcacaagagccaagaggccucaacccagacagacgaugauggucuccuucaucaccgagcucaagagcccuagccaacaaggacagccaggacccacuggggcugccucugcccaaaauccgcacagucuuccugaggcuccugcccauccuccaguccagagggcuuccugccuucuccuuggagaaagaggcaccaaaaagggcccugcuaaaagaccugcuccucucauggccaaggcccugaaggacuacagaaagugcuucuauaaaaggugaa

SEQ ID NO: 4442 - RNA, 5161 nt, Mus musculus
agcuauaauaguaauaaccuuuauuuaaaauauguguaaucuaggaagcucaguuuaugaguuuccaacuaauuauuagaaucaaaaaugacaacaacauuaaaaaaaaaaaaaaagucaaaguaaauccucgguagaaaaaauacacaagaacauuucuacaucugaaaaccaguaaacauucuuuccaggcagacaucuaugggcuagugugaacagcaucucuccuagugaacaccacugucggccuugagauccgauuuguucuugucguuccucacugaguagaugaaacauguuaaggugucuuuuucguucacuggaauagacuuaaaguggcaaccaacuaucuacaaauuaaaaaaaauggacaaauuaaagguuagauguagcagaugcugugagcugaguaagauacaacuuugccaaagugcugugugaccacaagauacuuuuaaagauuaaucugucuuaacaaaauauuaacaagcuccaaagcacauaaaaacaagauauuauaaacaaaagacagccugacuucaaaggauccguuagucuccacaauuaauacacucuuugaguauuuuacccccuuuggucuacuuaauuaaugugcacuuguuauaaguauuuuccuuuuaaacuuuaguuugcaaacuacauauucuuaaacauuaaauauuaaugaaauaaaacaaaaaaacuaauguccaucauaugagggagggcuuagacuguauucauagaaaaagaguaauauaaggaaaaaaaauucuugguaacaaacuguaccauaaauaccauugguacaacugauauuaacucuuaaguuucuuguaaauuuuuuaugaauaaaauuuaagaauggaaaccucaaggagcuagaaggauguuggacuguuuuccugucuuuuacugcacaguucuaacauguacaucagaauaaacagauaagaaacugagcugcuaauacuacgcaugcucagacucaagacugccuuuuucuagaauccacugaacuacaacugguuuauaagaccugauuuuaagagcuugagauuuagccgggcaguggugucgcacacuuuuaaucccagcacuugggaggcagaggcagguggguuucugaguuagaggccagccuggucuacaaagugaguuccaggacagucagggcuaaacagaaaaagccugucuuggaaaacaaaacaaaauaaaacaaaacaaaaaaagagcuugagauuugaguucuauauuuaaauacaacuuuguaucaauucuuggcuauuuguuauagaauagggauaauuacacuagugucuauuauauuuucauuauaguagggaaugucuauauauauguacugugcagcagaaaaaggaugauagcuuugaaauaaauuuaaagaaaaauaguuuuguugccuaggcaagaaauauagaagaaaauuuggcuaguuagcauacugaauuuuaauguuauagagcuuucuaaaaaaauucuaacucauauuuaucauuuauuuauacacauuggaaauguaggcuaacuacuaaugucaugcugaagaauauaagaacacucacauaaauauauauguguugaugcauacauacauauuuugaucugucuacucaguggaaauguuugcuuuagauauaaaguauaauuauuuaaaucuguauuuuaaaaguucacagauuuuuguggcuuuauuacuucaacacacacacaaaacuagcuuccaaaacauaccaaaggaacugaagucccauaccaagcaaacuuuaacuuuaacauaaagccuuauuuuuguucuuucucuugauguaaagaaaguauccuuuacuuaaaaacaacuacuaacaaaggcaaguguaucucaaaguaaaauuagaaagcaagggaaauccuguuucagggcucaccugcagaaacuuugaaaauuacauucuaacaaauacuuguaagcuuauuuauuuuccaucccucaauggaaauauuccauuuauauuccaauccacauguauaguccaucccuuuaaaacaagauucuagaacaaugauuaaaaaauucucauugcuuacucugaaaaaucaacauuaaaagacacuguauauacucugaauguaauccacugagcacucacuggagagcuuuccuagguggcagauagauguuucuaaacaacuacauuccacaauacaccuauuaacuuuuacuuuacuacaugcaauauacuauuuaauauacuacauucaucuauuucaucaucacuuaaugauaccuuguuggugugaacaggauuguuuaaacaguauaaagcuuauuuauauauaccucaacaaguugugcuuuauuuagaccuggucugguuggaagcuugaagugucuuuuguaucuucuaaguguauuuacuuguaauugguacaaaucaaccuagaaaaaaaaaauagaugaguuaguucacucuguugaaaagauaucauugaucuguauuaugacacuucacacaaugacuucauuuacacacucagaccuguacuuuauuaaacaguuccaucuuugggggauacauauuguaaacuuccggagaaacaaaagaggaaguuguaugucaagagcuguaagaaugucgucugagauuuaauauuaguauaaauacaucuucacugacuguauauaacuuuugagauuuuucagaugcuuuaaacaguuaaagaagagcucaaauauuuacagaaugguguugggauugccagcaugcuuaugauuuacauauaacauggggaaaagccugccaucuaccucuggagugucgauguccugaacaggcgagucucccccaucaucaucgcuuccuuuccucuuccuucuguuccgaacgcucugaauuaaguucuuaugauagucacaaauguaaagaugccuugccuguaaaggaaaaauuuucaaagacugugaguccagaaaaacugcagcuaaguauuaguaaaaugcauaggcccagguggcugacuaaaaaucaucuuaacaggccacuguucagaagaugcaauguuucuuuccacuauuaaaauguuguaacauuagcaaucuggcgauacuguuaaggaaaugggggaggggaggaauuggaagcggugggcgggcggguaguaucuuggagaaggcaggcaggcaggaaaggaagaaaaauuccaauucucugggucuugucaucaaauugcagggaaggugaccuaaauaaguuagcuccugcugauuuuaacuuaaaagggagagguggcauugcccacaaauuuguccuuguauuuucucuagcuugagagcagcauuauauuacucguagguacaugcuuucugauugaucuguuagauagugaaauucuacagguacaaaguaugcauuucuuuacaaaugcaacauugaauucauauccuauguuuaaauuugaacccuaagguuucuuuuuaaggauuaagcgaauauauuucucuguauuuuguguuuucaauuaaagcaaauuauucauguucucuugcaaaguuucucauggacccuacugagaaaccugccuaaacagaaucacaaauaaacuuuucaaaaaaauuaauuacucggggauuugagagcuguauauacaguggacuaggaaauacugagcugauugacacucuccccccccccccuuuuaaggcuacaauuaaaggccgaaugaacaggcuuuuaaauugacuucuaagcuaaggguaaguuaaaaauauacaggaugucuggagguucuguaucuuguucuuccuuugccaucagucagagcucugaaaaguagcaauggaauucucugaaaccucauagcuggccaaaacagcagacgugcauaaagacagaaaaagaaaucccgauggcugccgagagggcuguaaaaccgcagaggcuuauuugcagccuugguucggagcagcugcccgaagagcugacaccgcaaacaacguuuacaaucaucuaucucccuguaaggcaacuggugagcucagcuugcuugucuguguucaagagaaagagaacaacgaggaggaaagaaaaaaagaaaagacaaaaaggaaaaaaagagagagagagagaauugugggguccagccagacucuacuuucccuagaggagcgaagcugcucccuagggcagacaccggcucuggcagcaaaacaaaggcgccuccauuccagaagggacugcccggcugcgagaaaacuacuccgggcccucggugcugcgguccccuuuguuucguuuccagaucgcagcaaaggaggaagagggaagccuggcgugggagacacgcgaggcagcgggaguccgggcgaggggcggaggagccccgcaccacugcgcgagcgcgcgcuggggaagguggccggaguugcagggacuuuguuucaaucagagaaccacuaaucccaccugcaacccaauccccgagacucgugaaccccgccaaccauccggcgaggcacgcaggauagggcagggcggucccugggccacuuacacucuuauccagcucgaucuucaccuucuucugagagaugcucuucuggauccuuuugcugaagcuggcguugccugccgcgcgcccgcaccgcucaccguccucccgcaaacaacagaguugcccagggccgggaccggccgcuccagguggcccagaagcugacacugcaccggcaccggguaccucugccccaccgccggcugcguucccauuccccgccgaggcggcggcagccgcagcagcgaccaccgcggccacggcggcggccgcguccccgccucggcucaucuccuccggagugaagccguucaugucugccaguucgggggcgccggcgccgcuacagagccccgcucgccgcgccgcuccgccuccuuccccugggcggccguucacuccgcaccccaagucugguggcggcacgguccgacgcccagaguccagggccggccggucugucggugcuggaauagcuaccagguccugugacugugaucaggagugaaguggcgccuagaaaggagaccccacucacugucacauggagacuucagcaguuggaccgcagcuccuccgccuccuucucaaccccagaaccugcgcgagg

SEQ ID NO: 4443 - RNA, 4313 nt, Mus musculus
uuaaguauaaaaaaauauuguuuuagaauaugauacacgugagauauacaucagaauaacaaagacugaaauuugaaaaccauuacuucgaucaaaugggaacuacaaaacugcuaguaugguuaguguagacuauauacuauuacuuaguguagcuuucuaacaaacuucaaguacagguuugggagaaaauagcaaaggcauucaagugagcucagagguacagcacuugccuggcaugcauaaggcucuggguucuaucuccagcauugucagaaacaaaaaguaaagguuuaagccaggcagugguggugcacgccuuuaaacccagcacuugggaggcagaggcaggcggauaacugaguucgaggccagccugaucuaggacagccagggcuauacagagaaaccaucucaaaauaaauaaauaaaauaaaauuuaaauaaaaauaaagguuuagauuauucuaaguagcaaauucuguauuaucuauaccuuuuagcuguuauuccuucuaggacuuuuuucacauauaaauagucacaggaauauucuuaaaaguuggguaggcugcuaucaagaaagacagugaugccaagaacuucuguguagccuuggccaucuuagaacucuguagacaggcuggccucaggaaaucuguugagauuuuuagggaacuaguuaaauuacaaccuauucaacaugagaagaugcagacauuuaacaaagucagugcucuaagaauucauuuguguaauacuuaugucauaaauauaugauuaugcucauucuugauuuguuaguaguuuugaaaaauccaaaguugaaaagggauguaacuaucugauauauauauauaauuuccuuaacauuuuaaauaccauugaagcauguacuuugguggugguguccuaacuccaacccuccugcccucucucuaccuuccacucugggauugcauguaccugccaccacacccagccugguauaacuacuuucaacaucuacacaaguuucccaacacauuuaacucaccucaucucguaacuuccaauuuugguacaagcuaagacuuauaagcuaagaccuguccauaucucacauccauacugauaaaaaagugaaucaaaauaauuaaauccccacaccuggguaucuaguacauuauccaaaauauuuuaguauacuaaacuacccaaagccuaaaaauuuaaaagaucauaccccgacuccaaauuugaguggauaaucuuuuagacuuacuauuuguacaaucacagaacuuuuaaaguuuuuuuaagucuauuugcucuggaaaucaaggcaguauguccuuaacgcuuuaaccuguugcuaauauguuagcuuguggucauuaaaagaaauuggcccuucuaaccacaaaaaucagagaagcaaauuaguaaaugguuaacacaaaacuuaacuguguaaaaagacuaacaugccuguaucuguuuaaggaaaaauuaauacaaacacaaugcaaauuaauauacauuauuuuauuacaaauuuaaaaaaaaacaaaaaaaugcaacauccuaaaaaaaauuuuuacugguaauacaaauuccuaugaaguuuuuuuuuugcuagcauaagaaauuaaagaaaccauuaaauauuuagaaacauucaacaucaaaagcuuuaaaucuaacuguaguuguagccccugaaaaagcuacaaacucuucuuaaaaaguauuuucucuacaaagaaucucaucagcuauacaaaaaucuguacaguuuuuauacugaagcuaauguugagcugcacuugaauuucacauucuuagcaaaauaauugccugagcaaauauacuccacacuuuaggacagccacuuauucuucauccuccucuucuuccucgucaucuuccuccucuuccuccucuucuuccuccuccucaucuucugguucguucuucuucuuugagccuguuggccuaccaggacccuucuuuccugcuucacuuuugcccuuggcacgguaugcagcaauauccugaaacauugucaaaguaagaucagcauccgauaccacuacucaagugugaaaaaccacuuaauuguaaacaauuuaacaucgaccaaaacccuuauuagcugguauucaaaccacuccagguuugagagcaauuguucccuccaugcuugagaaagcacaucagguaacuaaugagagcucccugagaucaguuacugcacuuuuacuaucaaugucaaccccuuucgcaccuuauauuuauauuuaauauacaaacuaccuaaaaacauagcuggcacucuacccucuaaaauagauuuacacaacuaccacgaguguacaggcaggaaauuugcaagggccacaaaacacaguaucacaaggugaacuugucuguacugcucaacuuucaucugggguuuccaaaaacugacaggcagugguuaacaaauaucccaaguuccuacagcugacauauaucauauagaaauaucaguuauuauuuaaaaggcaccguaccuuuucauacuucuccuuuaguuuagcugcuuucugcucauacgguuguuuaucuuuggcagauugcucagaccacaucucacccaguuucuucgcaguaucuccaauagacaggccuggguguucaauuuugaucuuugggcgauuuucagagcaaaacaggaagaaggcagaccugcaaggaagcaagaguuaacaaauagaggacgaugggggcugggggggcgauggguucguuaguucucagaucaacuuacgguggucucuucggagcauuggggucuuuuuucuuuccuuucuuauccccuuugggaggaacauaguucuucaucucccugucauaacgagcuuugucgcucuuggccaaaucuucaaacuuggacuuuuccuuugcagacauggucuauggggcagaaaaaacgagucaaucggcaaggacuucaaagcuccuagcuguccgaguaauaaagaaaguggauaaacaaauaagucgagucaaucuguaaacucugaggcauuugcauuaagggcgcccucggcuuggagaccaaccuuuaaaacccucggguccccaggguggcaaaagcucgcgcgcucccuggucccugucgucccccccccccauccgacccgcccccgcccgcggggacccgccaaaagcagcccggaaacggccugcagccgggcacgcgcgccgcccgcccucccucccucaccuuccaucucucggagcauuucuuggagaacucggcgaaguucaccgacgagucgggaugcuucuucuugugcuccucgcggcaggucugcacgaagaaggcguacgaggacauuuugccccgcggcuuguuggggucacccuugcccaugacgacggcgcggcgucugucuaccugccgaggagaaagccguguccggaccggggaccgggguggggacccgcggggagggggcugcaaggagugaggagcgugggggaggggagcggggacagcggggaggggggggauuccgcuccgcuucccgccuaaaccccgcgcgcccccgcgagcgagcgcgggagcgcgcgccccggccaggcccggcccagcccagccccagccggcuccgacccgcccgacucgcccgcccgcccgcgccucagccccucgcccggaggccgaaagccgccgccggccgcgcgcccucccugacagaaaagccgcgcgccuuacacuuacacaagccaccgcgagacccacagccaauccaguuuuuaagaaagagacagagagaaagaaaaagaaacgcggccgggcucaagggcuuucuggccgcccuccauggccccggcccucacccaaagacucggccgcccucuaaagccgccgaagccgccacgccgaagcccggcagacguccccccacgucuacgcguuaagagccaggccgccaagccccgggccucccggccgaaccuuaccugcugcgagcgcugcuucccucagaccuccgcagagagacuuccuuccccaagcuccggcgagaacugguuucucgcuaacgcaauccccagccucuuguuuugcagaguucuccgcgccacggcaacuugaccagaccagucgcgggccacaccucccuccgcucugauuggcuguggaggauuauucaaacccggagaguccccgcccccccacggagaaggcuuccgauuggugggugucuggccaggcccgucccuccaggcuaagccuagcagguucggugggucucccaggucguuaacucccagacccg

SEQ ID NO: 4444 - RNA, 1299 nt, Mus musculus
guccucguuccuuuuuuuuuguuuuguuuuguuuuuuuuuuugggugcagcgaacuuuauugaugguauucaagagaguagggagggcucccuaggccccuccuguuauuaugggggucugggauggaaauugugagggagaugcucaguguugggggccgaguugggauagggccucucucuugcucaguguccuugcuggggugggugguccaggguuucuuacuccuuggaggccauguaggccaugagguccaccacccuguugcuguagccguauucauugucauaccaggaaaugagcuugacaaaguugucauuaagagcaaugccagccccggcaucgaagguggaagagugggaguugcuguugaagucgcaggagacaaccugguccucaguguagcccaagaugcccuucagugggcccucagaugccugcuucaccaccuucuugaugucaucauacuuggcagguuucuccaggcggcacgucagauccacgacggacacauuggggguaggaacacggaaggccaugccagugagcuucccguucagcucugggaugaccuugcccacagccuuggcagcaccaguggaugcagggaugauguucugggcagccccacgaccaucacgccacagcuuuccagaggggccauccacagucuucuggguggcagugauggcauggacuguggucaugagcccuuccacaaugccaaaguugucauggaugaccuuggccaggggggcuaagcaguugguggugcagaaugcauugcugacaaucuugagugaguugucauauuucucgugguucacacccaucacaaacaugggggcaucggcagaaggggcggagaugaugacccuuuuggcuccacccuucaagugggccccggccuucuccaugguggugaagacaccaguagacuccacgacauacucagcaccggccucaccccauuugauguuaguggggucucgcuccuggaagaucgugaugggcuucccguugaugacaagcuucccauucucggccuugacugugccguugaauuugccguggguggagucauacuggaacauguagaccauguaguugaggucaaugaaggggucguugauggcaacaaucuccacuuugccacugcagauggcagcccuggugaccaggcacccaauacggccaaauccguucacaccgaccuucaccauuuugucuacgggacgaggcuggcacugcacaagaagaugcggcugucucuggaacagggaggagcagagagccuu

SEQ ID NO: 4445 - RNA, 11680 nt, Mus musculus
uucgcgccgccaacugccggggcgagcguagcgcaguggccggaucccgguaacuaaaguuccgagaagccugacuaaacccucaaagccgggacugucaagacuaacgccggcgccgagggcggcagacggaugcgucccagcggagcgcgccucucggcgucaggcugauggaacaggcagcgaggggcggccaggagccggcacaaguuagguccucggccggagcagcccagguagggccgggggacuggagcccgcuccggauccgcaggacgagggagcacagcgggcgaccggggcucccaggcgccccggugcagggacgccgauccggguggggacgugucucuccccuguccgggaaucgaagggacaaggggugcggggcgaggccucagcuacacguugcacccggcucccggccacgggaguugcggagaggcggcgccgugggcuggagcccgaggcggacaggcuaggggcgcccccgcggcgagcacccggacugggcggggaccacaggagaggcuggaccgcggggccugcuccaccggaccacggcggcggcgccggcaucucgccuccuucaggccugcacgcgccacaggccgcagcucggaccaaccccgcgcccgccugccgccagcgcgggggucguagccccgagucggacgccgagcagccucggcuccggggagccgacucuguccugcgauuccgccccggcagucccggcguuggagcggccgccuauagccgccaccacggccgccgcggcggccgcgguagcggcagcagcagcaguagcgcgggugacggcgcugaacccggggcggggacgcgcgggaggaaggggcggccagggggcgggccggcggcggccgagggguacccgcggcguagggcuaggcgcccccgaucggccggcgccgggccagcgccaccugcggagcugcggcgcccacgcggccgcgaccccgccgccccuugcucccgccacauacacacacacacacacacacacacacacucacgcgcgcgcgcaaaaaaacaaguugcaggucgccucugccggagggggccaggcgggucacucacccucauccugcucagugggcucuggucgucgggccgcgaggacagggaagaccagaggaccacgagccccaggaagcuucccaccaccagcaaacugcguaagaugaacccgaucuucagccucaucuuccuccggcggcgagagacacacagcccggcgcagccgccgccaccgcucuccccucccuccuucccccucccccggcccuccuccuccuccuccuccuuccccccccccccccccccggaucacuacgcccgccgcccuccccaccgccugcccucuccagcaccagauccggaacuccccucggcuuuaccuuccccuggcucgccccuccgcccccuccccgcgccugccucugcacugcucugccgcacccccuccccuccgccggccuccgcagagcuccgaccggccggcguguguagcuuuccaggcuucccuucucucuaccugcccgcucuagcuccgcaguacccccuuccuccacccgcgaccgcgagaacccaccccccaccacccgcgagucccuaguaaccuuggaacuaacuuaacacuuucccccaggucuggucuuagccuuugcccuaaggcuccgcuuccuaaagcuugcagauccccaaacuuuuauuguaauuagggaccaaaacucuguccuugacgcccgugcccugccaggaugcugccgcccggugccccucagguggaccugcagacgcccuaggcugcccugcccuucccgacgcccacugcucaaucuccccagccagaggcuugcaggaaggaaaccaggaagucagccaccgcugcugcagcaguaacuccacguggcugauuuauagcuguuuuuuuuuuuuuuaaucuuguuuuuucacagggcuccuuaaggagguggauuuguaaucgaaaggcccaggugagaugugcaaacaccacagaacuaaaagaggacucacuuggaaaggcaguauugccuucucucuugggcuaauuagaaagccaagucgacuagcuaauucucacuacggucccuguuaauggacuugcaaguuccuacucuggggaaaguggauuucgggcuuuuaaaacguuccguacaugcaucguugcuucucucacaacugacuuuuccaggaaaggauauuggcaaauguuuagcuacacgccucucccuuguacauugugccaaagaugucaaucacuuuaaaucacagucugcagugugugccauaccccuaaacuacucaauuuguugaacaaaugcuuuucgguagcagguuuaaggauggcguaaauugaccuuuuuaauccuaauauugccuuaucugcauguauuuugcuuucgaaacaagugaaacuugguuaagucuccccuagugaucaacaguauaugcauuguuauucagauaugguuguccacuauugagaagauggaaaacugacugugauuaugagcauagcugggaaguagcccucaucgcugaagugaugggagcucacccaacugcuguuaguagucuaagaugaccuugccaccacaacuugaaauaugcaaggccaaaaaguuagaaaaugauaaccagguauucgguuguaaaagccgguguuccucugaguucuuaacauuguuuaagugaaacugaaaguauaccuuaaaauauacgauuuucgccacacuuguuggcaguuagccuuuguagagaacucuuuagaaaaugagaagcuauguuaaaugauugggucaggaaaaagucacacuuagccucucugagccuagggcccuuaucugccaaaaucaugauuauaauacuucauaguauugccaaaagagauaauugaggccaagugcacaugcagauaauaaaauaaagcacagauaauacgaauaggguaagucuuggugauuauggguauaauucuugugaacgccgcagcuauuacugcauguagagauugccacucugagcuguuuccgacuuguugauccuuggguuaguggucccugaagagaguaaagaguugcaccuaaugggaggggagauaugaagaagagaagcaguagucucugacagguuaugaggucacaugugaauggugacaggguugccuuugccucugaggccagcuggagacucauugcaaaggaauaaaacuucugagcagacaguauguacccagugguucacgccugucgucuaagcuuucuaccgccugagauugguguccgauguucuuugaauucagagguuuucucaucuugccaacacaugcacugucuuugccaaacaguauaaucaucuuguguuuacucuaaaauguuuucaggauuccacaggucagaaccuuuuaaggguuuggugauguuuaaaaaaucaucacccacaugaacucugcuaaagaggaccuacacacacacacacacacacacacacacacacacacacacacacacacacacacggaacugugccugcuuuggggcuacacucuccagggcaucuuagccuccucauacuguacccaagcuaggggaacuauuucuaaaugucagugcucgccugcaggccuuucuacagagaucuccuuuucaaaccugcaguaucuucugacaccuuaacauuaaacuuuauugucaguuacaaaagccuuuucuagacucuaaccuguuccuguacaccaagauauuggccaggaaccccaccuucuacucccucuccucccuaagaauuaccacuuuguugugacugcuuaauuccacuugcgaauaaaaaguuacaugacauuggagacuugucuauggaguuuguuguauuccugugucagauguguaggaaggcuuuaauauuuuugguggaacacuggaaauaguuggacuaaaaauacaaagggggaauaaagcuuagaagagggcuuaggagcacuucaccucugauuguucucuaccuagaggcugccuucggagaacaaaacauugaaggguuuauuccauuagaucggcgacuguuuuacaguaguacuaucaguugguaagcuauuguuugccaccuacuuuguugauagucuaccguggcuacucaagcuaaaagagucacaguuucaaucuaaauccggauagucccccuaacaguagauuacuguuccuaucauaagcauaauaaaaaaauccugugcuguacucaaucuggaaugaaacacuugucaaaggcugccauuugaggggauuaauggucuccuaccauguuuugaagguucauugaaagcucucuuugauuucauacgguagaauacuacaucuuccuagcuggguacuguuuauagcaccugcaauacagaccucuucugacuuagccauuuuugaagagguaauugaaacacauuuugucguucuucuucaaaaccccaaucaccagcucuuucuugcucuuagaauuaauccgaaugccucgguuugugagcgugcauagccuuguaccuucuuggucaccaccgcuucucuauguuacagcuacgucauuuucuguuucugaaacagcucaaguuucuucuucccuguagaccuguaagcauaucgcuccuuuuucuauaacauacuucguaauuguuacaucagcugcccccauaaacucuauaaucauucaaauuucaguucauaugucaauuuuuuuucagaaacuuugcucucaucggcccuccccucccuugcuaaguuagaaauuucugcuucauuuaagaucgaccuggaaggucccucuuagagcacaacucagccuuuguauuuguucaacugucaccucaauuagccaacguuuuuaagggcagggacugaguugucguuuagcauuguguuccuaggauguugacagugcaagacacacucagugugagagagugugggugggagaaagcauaucucaugcacucccgggggaagcauuaaaaguuuuggacauauacacuaacaucuuuaaagacuaauuauaccucagugcuugcaaaaagacauuaugaaaaucaauuuuucucuuaaagaguuaggaaggaagggcacauuguucuggaucuuauccaaccaacauguguaccaucauuccuagauaaacugauaguuccuucaaacuaaccaccuguuugcuggaaugaauacacauggcccagaaccuuaugggucuuuaauugagaaccugguacccagaaaaagagaaaaaggauccugucuuuugcugauaacaaaaaucaucaugguuuuuuaaugaaaugguugaaauggaaagaaacuugcaguagaagggcuagagagguucagcggugguggcacacaccuuuaaucccagcacuugggaggcagaggcagguggauuucuuaguucgaggccagccuggucuacaaaaugaguuguguuccaggacagccagggcuacacagagaaacccugucucagaaaaaaaagggggggagaacggccagagaacacaucuugcugcuuaaagcuggagguuugacuagacuuaaauuucuaauauccuuuuacagguucacagaagacucgggccucagcagaaugauuaaaugauuccaaagucuucaccacugagcuuugucaauggugaaugucucuaaauccgauuacauauaaacaccuucaucagcaagcagacagguaccuucaaacagcugucaguuuaauaccacaucucuccagagaucucacuuauucagcucugcccagagccuuacugucuuuaaugggcaaaucugauacuacaagacaaaccagccucuguccuguuaauacggauaaucucuuguacacagagcacaaccauucuauagugaauggaauggaaagaaacuaugucagcaaaugggccagagaauccacacuuuguaauauaagagcuaugguuagagccauauugggcagaguucuggacucaagaucuccggaggaaugggaaggcuguugagaucuggagaagagggcgggucugugcucuucucuaagagcugauggaaacggcagaggaugcuucacgcguacccccaccuuuugaaaguuucugauuaguuuuaacaagagucggguauucuuaguaaugaacuauuccuacaagccuuuuuagacauuucagaggagauaaacagagcugaauacaaauaaagaaaucugaagccagacugcagagagauucugcaggaagauuaucccaaauccaggaauuagagguuggacaggaacucauuaucuguugacucugcucuccagcuuucguaugcugugcugggcucacugguguacacaaaucuccuuuucucuccagccauuuuucuaacaacugaacgaugaacaaguauauuuucucuuuuauuugaacacauggcucuauauuaaaucacuguuuggagagucacaccagggacuuguaaagccaaaaguacugcucuucuagggaguucaaaauacugccauucggauaaagguaccuuuuuggcauauugcaaagaauuucaaaaauuuaauuuuaauuacauuucuuuuguggagagcagucuuaggacuuggucuuuugggacagcugcuguuucucaaaccguagaaaacaauuuuuaagauccucuucuaugaucuuuuauuguauauuaauagcgacuuccauuuguucaaagcacguuuuuguguauguaucaugugguagccaucgcucuaggcaugggguauauagucauaaacuaaaagagcaaucaucccuguccucauggagacagauaauaaauucacgugcaaaucauuuuaugcuguuaccaaauaaacugcucccucacccguguaccaagcacuguuuuaagagucuaugaagauuaacuuacagacuuauauaguacauuagagaauguaucggauggacugaaaccgagaaaggaaacguaauacagaaugcuggaugggugugaaaagugauuuccauuuuaaaaacagaagucucauagagaagacaacuuuuggccaaguccugaauggggauuuaagaccaagugaaauagaagauagcagcaagcaagaggaacggccaaugcaagggcccuagggcaggaguauuuccucuuauacaguaugggggagacagaaagcccugggagguuuacugcaaagguggaacugucuaaauuagaccacagccucuggcuucugggucuggcgugcaaagcugcaaagccaagaagcaaagauuaucuaguuaggaacgcuaucugaacaauccgggagaaagccuccaaaagcguagacucagauuauaacagcaguaauugcacuaggucagaccauggcuacauuuguuuacuucucaacuauuacaguuccaaauaauuuaguuuacuguuuugcuucucgacuguaagcaguuaaauuaauaaccuguaaagcaacucuuuaaauacucuggcaaaacacauuauuuaaggaaaccauguaagcuauuacucaacaauuuaauuaaaugucccaugcaacaauagcagguuagaugcugggcucaacagaucugaugaacacaauggaaaaugugagcaaaauacauuuuuaaguuuaaaaaauugcacccaugagauaauaaagaacauuaaagucacacacugaacaaaggaguacacucgccccuacuuuuacauugcgcgcuguggugaaguaugaguuaaccugaauaucauuuauuuugcauuuauggauuuuggaacaaaaccauuuauuuccaagcugacaccggaauggaaagcccaauuguucugugaaaggcuguggagacccccaaggugagagaggaaaaccuauucuccugacauguugaagaggaacuucucucuaccuauacccacaccgugauguaaggagucacagucauacauugacccucaugcucuuuugcaguuaaaacacacgccaacuugacagcuagagaaaacccuuaaaaacagucauuaguuaaaagugauaccacaacagugucaucaggcauccaaaaaguaagccuggguuucuaugcuuuuuaaaauuacauuuuucauaaauguauauugauauauauaccacugcccccaacuaaaaagcacauauacauagucaugcaauguguuuucuguuggcuaacugcugagcacaaggcuggcccuagagugcaguugauauacccagaaucaguuuacauaaagaagaccuguuuuuuccccucuuccaggagcuaucaauugcaaguagcaucgugcuuaguaguggaacuuugugccuccuuccauuucuuuguguugggauuuugucuggcuugaacuuguucaggcuugucuuagucucacuccgucagcuguuuugaguauggaaaaugcuauuugggguucacccaucaucucuaguucuuaugaucuuuccacuuccucuucugcauagaucucugagccuuggguaggggguaguaaagacauccuauuuacauacacacuguaaauaggaugucuuuacuacccccuaccauguguguacacauggucaacuuggauuuucuuuucuucacauuguaaguuccaaggguugaacucaagucaggcuuagucauaagugccaccacccucugagccaucuuguaggucaaaauaauacugugugggggguuggugguggugggggugacaaugucugucuauugcauaccuaucuacauagaccuccuaacuuacaaaccugccugccucugccucccaagugcugagaugaaagguuuguguucccacucccaauuaaaaucuguguuugagaacuuacaucaugaggcuuagcaguuaagagcacuggcuguucuuccaagaggaccuagauccaauucccagaugacaaccaucugcaacccuaguuccuuaugaccucugcacucaccaggucaaggcacacauguggugcacagacauagaugcaagcaaacauccaaacaauaguaaaggaacccccaucacugcaugcuuugaaaacauacuguucucgucucuuuaaaaagucacauuugaaaaucacugaacacuguccugugaaugcaggcagccggaagaaaauauggcgauuuagaaauagcauuucuagcuaucgacacaauagaaaccacauguaaaacauuuucaaaaauugaaagaaaauacaaguaaaaccgagaauacacucaaauuccaggaaagagaaucaugaggacuauagauagguugagcuguagauuuaaauucuuauccaaccuuuuucaguugguuucuggaguccugucuccuguagagucaguuucagucaaugccagugcucuuaucucuaaaaggagggagccauuuaaaguuuagucugaguuuguuuccuuaguuuuaaaucuuuuccuggaugaacacaugauucacuuguguuaauaauuuggacacccgaauuucagccccguuuuugagcauuaaaggacccauaggacggacauguguaagcgucuauggugcuugaagucaacauuuccccaggggaauucgauuuucccauaaaaccuguucuucccaggcucccgacucagucuuuaaaggcuuacacaagaagugucugaggcaucuuaugucuggauggaugugacagcugucaauccgauggcuuaugcuguaggcaggaaaucugaggugagacaucuuggagaacucuggacuagaacuaggcacaggauaucugccagggaagaugugaaguacccgagcacagguaaccagccacguggcaauacguagguuaaaaugaaugggauaguuuguuagcgaucuagucagagacgugccuagcuauauggccaagguauauguaaauuauauuuugagucugagucuuauuucugagagcauggggcugagaggaagaacagaauguaacauuuacaaucucccauaauugucuucccuucuagauuccggugccauguuguccggaccucgacacuuagguugcuuguucccaugguuguaauucaggagcccuugcaaaccucaucaucugcguucuaaccucguacuuuccuuucuucuccuccccucaaaacaaggucgugacgcuauguagcuauccugaaacuauguagaucaggcuugucuugagcucagagagauccgucugcuucucccaagcgcuggaauuaaaaguguacagcacuaugcuccucccucuuguuccauaaaccauaauuucuagugcuaccagaacuuuucuaaaaguuaaguuucaucauguuucugcaggggaaaaaaguuguauugguuuacccuuaaagguggcaauucaucacauccugggagguccaaagcucuaggacauaggucauugcguugguuaaguacaucuuggagagcauuacguuuugauggaguuguaaaauuucauuuuguuuuauagguguaugucugugcgccaaugacauguuugggacccacagaagcuggaaaagggugcuggaucuccuggagccugaguuacacauggcuugugagccaccaugugggugaugggaauugaacccagguccucuagaaaagcagccaauacacuuaauuaaccacggagucaucucuccagcaucugcuaacccaaguaauuucuuuuaaagaaagacaauggaguaguucaaaagagcucuuuauauugcucaaaauuacccgcgaaagagcacugugcacaguaaauaccgaaugcauaugcacugcuuuaaucaaugugcuguagacuagagcaaucaagucgaaaaacaaaagcauuauggaaccgugcuuucccuagugacgcugucuaaaaggccguaacuggcaaacgaaaggaccacacuucaguccuaacucucaaagcacacaguaaauguggcagagaugcuggugaagucguugaggcaguacuuccugagcauuucccauuuggaacuguucauaguauuuucagucauguuugagguugugauagaguauuguuuuaauauuuuuaccucaauagcccaacuuuguacuaacuuagauuuagcucugugcuaaacggaaauacuaucauuacuuucuacauauauuaaaauuaauguauauaguuguaauuaaagauauuuaugucugaggguucuuaagaauuauguauuacccccaacuucaccauggcuugggaguaacuaauauauaacauuguauuuuuuuuguuuaaugucaacuucaguuaaagccugcaugguuuagggauuacaaaugauaucugguuuggcaucuagguuuuuguuuguucucuguuucuuuauuuggagauguuugggguuaaaugcaaaucuuuguggaugcaagucuucuaucuuugagcuaugccuccugcccacugucaucugguuuuaugacuuauggucuaauuuuguauauuugucucuuuauggaaauuccaagcaugaauauuuucauagaucucauacaaguggccugccuuuuucuuaaacaacacucucccccaaccacccacauacaguagaaguccacuaauaaaauauaggauauuucuaauuuuu

SEQ ID NO: 4446 - RNA, 1604 nt, Mus musculus
ucuuuuuucaucaugaagcuaagccauugaaguucacccgugaaagcaacggagauacacaagacagagaucuuauuaaaaaacauuaauuucucuggucuuaauuuaaugugccgugucuuugcuucccuacauaaugagagaaaguguggugcacaauuaggcaucaccucaugacagugugugcuguuaaucaaacaguuauaaugauugucauggaagggaggcuuggguuuauucuuggaauaaauauccuugguggugaaaaugaaacaucaaauauuauacauuagggucuuaaauuauuuaaaguauuuaaaugaaucucucucucucucucucucucucucucucucucucucucucucucucucuguguguguguugcccaaggagcacagaagagggcauuggauucuuuucuugggugcuggaauuacaggcaucugugaaucacccaauuugggugcuaggaacugaacuugggucuucuggaaagggaggaaaugauggucuuauacacugagccaccucucucuauauauauauauuuacauacauccacaauugaauuauugauuugcauucagagagguuccuacugaagaucaccuucaggauuuuauuuuagggcguaucuucucaucauuuaaaguauuuuaauugaaaggaaggcauaaguaaaguagcagacacugcacuugauauuugugcguaauacuucucuuuuacccaauacacccucuaaguagauuaguauuaaaauaacaaugugaagguuuuaaagauuuauaugaccaguuaauucagcuugaccucaaagcaaguaggaauugggugauuuaauuaccuugcaauauuuauuggugugauauguuuaaaauugccauugcucugacacuauuccuugacuauggagaaauuucauuuauucuaucaccuuggauuguuauaaucucuauuucccucacaccaaugaugcuaaucccacauucacuucucagucuuuauuuucauuuccgucuuguaagagcacaacaguacaguuuagucaucaaaauuugacacucuucuguguuggaaagaucaccaguugugugguguggccacagacgugucuggcuucuacuucagcucguuggauugugcauauccugguugcccuuuugucuuuucuggaggguagauacugugaauuuaacaggugagcauaaaggggagaagaaaagcuuuguuauaaauguauuaaguuugaggcugcaugaucucuagaccucucuccuaccucccacuuuccuucauuccuuuagaguccuaaaaaggagaccgaauuauuuucagauaacuccuugagaaugugagagucaaauauucuccuuaauuuuccccaaguuaagauuagccaucacacucagcucauccauuaaaccaucucuggcaagaguacaaugcagauggaauaaaaacgcaaaagaaagcugucuuccucugauggaaacugagguaaaguauuugcuuaaugaggaaggagagcugcacuuaacacuacaguggcccauagaaaagaaugcuguaauuggggcacgauggcuuuugaagagcuu

SEQ ID NO: 4447 - RNA, 2546 nt, Mus musculus
auugcuuaaaaugauauuuuuauuauuuaauugcaaagcacuuuuacuucccuucaggucauuuaucaguaacuuguguccaaaaaugaaaaaaaaauccaauaaaguuaaauaguucuccuaacaguuuuucgugacaguuaauuuauuccaaaacaacucucccuuaguacauggcuuccaggccuucaaauucuguuauagaacuccuuuaacucagagcaggauuugaaaauuacgcagaaccaauaagaguguauaugugugugguuuggaagcagugauuaaaacccucuucccucugcaccuucaaauuacacuuguguaaaauguaaagcaaacuauuuuuacguacagaaagcacacauucaaaauauguauuuaguguguuucgaaacuuuucugagauggcaagucauccacagagaacaagugcuuacaacauaaagcuuuauuuguguagcaguacagccaaccucuauuguuccagucccuuuuguuuuaaaugaauaaccugaacaguuuaaagguuaacucuccagggucaaaucugggucuugagaggcuugagucccuguggauagagaagacuaggggaagagaaaaaaaaaaaaaaaggcgggggaugggggagggaaauuagagagagggggaaaggggaaaaaguggaugaaggagaaaaccaucuggagugaggucucuauaucucaagcauaugggcaucacucucuagacuguaacaaggaggcgaccacaguguuuugggaggcucuggauagccugaugcugcgcagcauggcauggccauccaucaccuuacuuaaguucacaccaggaguuaggcgcucuggauccugagccaggcaggcacaaagguuccuuagagaggccacagguucuccuguguguguugacuccguuuucuacggggagggaagggucccaucugcuggagacuuaucucaguucuaagguuucuggauaaccagggaggggugugugagcuaagcgaggaaccagaagaccucucagcuaucagcagugggaggugcaggcaugguagggcggagaagcaucaguuagugaagccaaaucuaaaccugggccccaggugcuggccgacucccgcugagcugccucuguucuccacaguguugucuggaagcugcggcuaacaacgcuguccacgcggcgugggaauccucuuucuccuuccacgcuacguaccuggcuugagcuguagguucuggggaaacccuccucucagggaccaguccagacuggguugccucugcucgcugucgcugccgcgccuuccucgcugcgaucccaucaggaccauggaggaauucuuccauugcccucccgcucagggcgacuuguacuccggaauuucuggccuggcgccuuucgggugagcucagagacgaaccagucucccugccgguucgagauuacccgagaagagaggauccgauugucccggagcugcaaaucgauuucucuguccccgccuucauccuccucuccuucccccuagccucuggguuuguuuauguagcaucuggcagccgcgaggcaguggccacuaccuuccggccgugacucgcccuccccucccggcuucuaggcucccgcacgugguagacaccaguaucaucgccagcaggcaggagacagccagcgggaggcggaccccugggugccagcuccacgcgcguucucgccguccucacucauccuccgcgcgcccucucccacuugccuguaaagcccggucacacuugacauucgccgccugccauccgucccuugccgugaaguggagaucagaaauacugcccugggggugcuggugaugcuucgcuggguucguucaguugcuggaaaagaaugguaacaugaacaguggagcgugagagcgucagcagaggaagggggcgagauugauggguagagagcacacuucucugaggcucucauucccaggacugcacuuggaggaagggacgucuuugcgccugcacuuccuggcuggacuccgcugacaucuguagccuccuuccagccagguucccaggucgccuagaugcugccugcagaggaguguucugacggcgcaugaagauccaggaguuugugaaccccuauccaaacauaguucugaccugguuauggugucccuggaucuugccugacaagcuggcuuccaagggaguugaacuugaguucagguggguuaucccaaagcaagcaaauaaaaagcuguucggggaagauaaggaagguguugugccaaugucaaaagcggacacuuuucuuccagacacuugacuggaccaagccacucccucccauucaguucucgcuuuucaucuccgacucuacaucccggaccucccacacuaagggcgggggauggugggcaaacagcgacagacaaacaccuccuauuuacugauagaucuagcaugcucucgacuuccucauaacuuaccauuauucuaugaaacgaucguauuuacuccacugcuuuauauuaaugg

SEQ ID NO: 4448 - RNA, 18283 nt, Mus musculus
agcggcagcucggauuggcggcuuuugaacccggaagcacuagcgggcgcucggaagcggcaggagcgcgggccuuggcucgcucgcugcggcugcgggaugguuggcgguggcgggaagcgccggacggccggggcgggaccgcagguaggcgaggcgggaugcgcuggguauggggacgcuaugggccguggaggagccgagggccgcccugcggggcaauggcccggggaagucguuccuuuccagcgccagcccaguucccacgaagcucugcagccagcggacggaccauucauucauucauucauucacucacucacucacucacucacucacucacucacucauucacuuacuaaccagcugauggaaacuggaggagcugccagggcggcgaggcacacgcgaacaaacauuucaccuuucguuuuuuuuuuugcuugggguuaacgcagguguguaaaagaaaaugcuggaauuaacaagcccuggaguuauuaaagacuuuuguuuaagacagucucuauguuguagccccggcuguccuggaacuugauauguagaucagaacucaauauguagccuccaaaucacagagacccucuugccucugccuccaggacacgaaccaccacugcccggcuacuuugguagccugaccuggaaguguaagggauacggguucucagaugagugauagauuggccagucuggacucuuacaugauuucauggguuccuuaagcauacaguagcuaaugggagaaguuaagcagggaaacgaacguuuaacaaaagugacaccagcuauguuuuaaacuggguagggugaggcgauugcuaaggcuuaacggccaguggauggcgaacauagguauuauucucguuguguuguguuuucucacaacaccaaguuaaaaaugugguuuaaagagaacagccuugucaggcagaagcaauaagaccaaaaguucaguguccuccucaguuacauuacaaguucaagaccagccuggguuacaauagaccugucuuaaacaaaguccagcuugaugacguagagaguaauaguacugaugacuugaauucagucccugaagucauguggaguuagggaaggggacaaugugaccaaauacguuguauguaaaaccacucccacaguucugcaucuacccauuugggugccuuuuccuuuuugccuaagcauuuccugccgcuucuagucacuguggcuaucacccugaaguuggaguuacccuugccuucuuguagaguuuguuguuuccuuaaaaagcuuuuaugguacaucuugucuuagucaguauucuacugcugugaagagacaccaugaccauuaaaaaaaaaaaaaagugccuagcuggggcuugauuacaguuuuagagguucgguccacuaucaccacggcuggaagcgugguagcaggcaggcagguaugcugcaggagaagcagagaguucuacaucuagacuggaaggcagcaggaagggagagacucugggcguggaaugggcuuuuugaaaccucaaagucuuaucuauccccuagugacacacuuccuccaccaaggccacaguuccuaguccuucccaguacugccauuccuugguguacucaaauuuauaagugcuauucuguuuaaaaccaccacacaucuaucuaaucuugggggguuuucuuaauugaacaucauacaaagauugagccauguugucuaacuguacuucucuuucuuucauuuaguuacuguuccccaguguuugaaagcccuguaacuaucuauuuuccuguuggcuggcauuucaaccuccuaaggacagugcugucaaaaacaauucuuacccgaugccugacuuguacauacaguguguaggcuuggaaugacaguuaccaauacauaugguuggaccccugagaacauguaguuaucaacaccugggugagaaaugccgacucuagcggcacuggcuugcugagggcagcucucccgcgcacugggcggcguugagcuguaucccuuagccucugcagcacuaggugccgcugguccugcugcggguagaaugugccgaguuucgccuggauucagaaccacaaggaucuaaguucccagaaagaaagagauuguacuuagaaaacaagacagauacgcaaaguaagcaaguugccuugguagcacugagccaguuuccaauagcauccuuuaaccuuuaauuugcaugggugcuagagaugcaaaucuuagcauuacaaagccuuuuccgaaagacaugguuuuuagcucagaggauauucccauauugauccuuaacuauaccauaccucuccucucuuuuuguuuggaaugucaaaaggaaguuaucugguuuuaaguggaaggguaguaaugauugugguaaguagugcagaccuaacuaugguuggaguuccugaaaaaacagcuuuuuucccccauuauuuauguuuuagguuagaauacaaagaaauuggucucauccuggcuuacucaugcauaugugccauuguacauucguuuuguuuguucuuaaagauguauccgacgauggcuuugcucaggcaguccucuuaagugcuaugguugcuggguaauaacaugacaggugugugcccuuguacuuaacagaaacagcuuuuaucugauaaguccuuuguauccaguuacuugugaucguuugcuucuggugugcgugaugagucuguuuaagugaaaggccugaugaugugauggcaucuugguaccaaaauagagcugaaacuuuuaugccuuuaugacagcuuuacauuuucccuuuguuucuucuugguuuguuugucucugcuauggagaagcacauuuagagacaugcuuugggugguauuuuuugaccaccguguaaacuguguucuuugcacaaaagaaucucuuggaguuuacuuaaguaucacgagcucaugcuuuuguuauugcuuuuguuuguuuguuuguuuguuuguuugaacauguuaaaauggagguagaaagauggcucagcagcuaagagcaugcacugggcuugcagaggacccaggacaguguccacucuguugggcaacucccagcuccagcuccagggaucagugcucuccucuagccucaacagcagccacucacacacacacacuucacaaucauaagguauuuaggaaaauguguauggugcccauaaacuggccaguaagcaauauuggugugcaagggugguuguugaaguucguugggaggacuuaaguuucauaugccaauuucagugugaaaagacaguugaggugaagaagaguaaguuuucugaggcugaugucuccagugaccuucgaaaagaaguggaaaaucuuuauaagcuuucacugccugaagauuucuaucauuucuggaaguucugugaagagcuugauccugaaaagccagcuggugagucugucuagucucucucugcuccugugacugcaagagaugacaggaaacuggaggaaggacagaaacagcucauagagaaagugguuuuagccacacauggugacaugccuauuauagucucagcaauuaagauacugguuugagaguaaguuucaggcuagccuaggauacacagugagaccaucuuaauaaagagaagacaaaagaacauucccacaguucuuucuagugagugagguauguagucagagaacaaguuaauauuucugucggucaacuucauugcugggaugugaaaagacagccgagcaggaggacagcguccguuacaucaugguuuuacccagcaggaggacagggacaggucagaaguuucugacuaugguuaguuugcucuauuguuuuggggucagugauaccuuaugucaugaggaugugucagaaagugccuaccucaugucagacaggaagcaaagagcauuagggagcaagaguccugggauaagaugaacccuucaaggucauguaaccauuagucacacucaugucauuagcuggggacugugcuuuccauacaugagcugcuuugguuuaaggucauauacaaaccauaaugcuaaauaugcuacugucaccuauuggccaaggcaagcaguuucaggacacuccuucauuuaaggaauacagaauuaaggaaagugagcgggugcauauauugucauuuuacgucuauaaacgugucuuaauggacuagguaaacuaagaauuugcaucaaggcuauuuacuggagagagagacagggagagggaaauggcuucaguguuuguaacccuccuaggaaagcugcagacacucugaaguuggaagucuaaagaccuggagugacagcucaugagaaggaaagggaaugguuugguuugguuuuguuuucuauccuuaaucuauguugucuccuuaaccuguauguuuguagcuauagcagauaguggugagguaagguaagugcauggcuuuuaggccuggaagggugcacagcagcuuggcuggggccaaggaaaggcagaaaugcucuaagcguaagcuaaugcaguaguaaguuuaagggggaaagcauaaauucagugcuacauuucuguucaacugauguccuuuccauugaguaaaaacauuuuuacagacuuuaaaguguucuuuaaaacaacugcuuaagaauaauuuagaacugguaggcagagacagguggauuucugaguuugaagccagucagaucuacauggugaguucuauaagagucagggcuguauagauuaaacccugacucaagaaaaggaaaaggaaggaaaagaaucuuuuagaacuggguaugaugguucacaccugcagucccagcacagaucacgugguucucggauucccaggcuagccuagucuauauaaaguucuagucuagccagggcuaauagugagacccugucuccaaaagggggagcaggguggagagagaaaggaaaagagccauaccaccguggugaaaggcauuaguuucuauuugccucuacaaaguguugccucauaaacuuauuuuccuuauagaugcgcuugccacaagccugggucuucgguuaguggguccuuaugauauccuugcugggaaacauaaaaugaagaaaaaacccacaggcuugaacuguaaucuucacuggagguuuuacuaugacccuccugaguuccagaccauuauuauuggagauaauaaaacucaguaccacaugggguauuucagguaaaggcucuucucuucucuaaaauacagcugcucugcuauuacugagucucaguggaccgucacuggcauccaggcugaaaggcuccuucuccucuuaccagugccuccauggucgcucuguuauucuggcuaccuuccaccucuuuagccugcguggguuggugaacucuuuacaccaaaguuccuggauuucuuucucucuuugacuauaaaguuuuugaguuauuuuuguuuuuguuuuguuuuguuuuggguucagaagaacuuugcagccaaguaagauaauguagaccagcaguuugacuuacacccugcacuuccaggggcuggaggacucacagauugguccugccauuccuuaucuugauggcaggaugccagucagugacuuucugugacuccgugcacagaaagucuugcacacauuugauaggacugcugugagaacuaagcgaagcaugucagcagauagggcaaugugagaagugcucuguccacuuccggaggacgcugggaccugaagcugaggugaaauagcagaagaaaggaugacuguggcuagggagaagcgcugcacagaacucuggggcugggggcugggggcggcucagacagcuuuguucuugcuuuggcacugauggacugcuagaaccuccaccgagaaccgugacucucucuacuagucucuuuaauuuaaaauaaaagggugggauacagacaugauuaagaugcuucaguguuuuauaucuguccuguuuccuuucacuuuuacuucacuuuucucuccugcauuuuuuucuuaauauacucuaaagugaaggugaccagcaguuguuuguaauacuauguugacagauuuucuuuccuuauuucucauuauucaaguaaaaauuagguacuaaaaagcuuagcuguagguucugauacaagcuuuauuguagacagucuaaagauacuuggagguuaagccuagcaaguuuauucuacuuuuuacagcuacgaguuugucuguagacccgauuuucugcuuguuggcauuauaaauuauggauagcuaaacuuuuauuaucuuuaauuaaaacagggauucuccugaugaacuuccuguauacguggguacaaaugaagcaaagaaaaauuguauaauuauucaaaauggagacaauguguuugcugccaucaaguaaggaaaaguuugauuucaguucucuucacucguuguccuuauacagcuuugcugcuugucaucaaaaccuucuggaacugcuuaucuaaugaacauauugcuggguccuagggugagcucugaaccugaagcagagaaugcuguuagcauguucuuagcaugucagaaccucuggaauucauccugugcagugcaaaaaaauguguaagaaguguuugaucuucauuucagaugccccagggaaaaaucaggguuuuuuuuucucuacuaaacaucacauuuaaacggugucauuuagaguucauuauaagaaccaacagcaauguaguucaaacuggaaaguuuuuaggaguaaggaauuuacagaauccuuggaauggcugcugcgacaagcugagccuccagggauaacaguugcaaggcuacuucucaucaucggcgagugucucugcaguuauccagaggcugggcaaugagcugcuguaggccauagcauugauguauaguuauaccagaacaguugcugcccugccaucugccccuacagcuuauaugaaguaggaauaaggaagcauggcugcuacuucccacuccuuccuucagacuugaaagaagugcuucugcuuggggucagccaggucugaugcggaaucagcuaaaaauagcaugagaaaugcaccaguuuucuauguaggaggggucagaauccagcugagugaaccaauugguauuggccacaaacaugauuugaagucauucguuaguagguaugcaguguacguuguaauucaacagguuaaucucuaucacuugaaauagcuagaccauguuuuguaugacuguaaagggcuuuaugucccccugacuuaauaguauaauuuauuauuaaaggauucaaaccaagucaguccaaggugaccacuguucuaugguguauauacacugauguaccuggaugacagcagcauucuguucuuucucuuguaagacuugagucuuacguaaaaucugcucgggauuuguaauugcuauaaguucucuuucuccccuggguuguugguuuuuauuuuuaguuuugaguacuggggacugaaccagggucaugaccauccuaggcaagugccuacuacuuguuauauccuuggccucaguaacauuucuucuaaaccuuuaagauuugucauucagcuuaaacuggaauugucuguauuagaaacuguaguuguuuacuggcauauggucugucuccugugcuagcguguaagccccacaaggacaagggcagugucuuuuauaucgugcuguucccuuagcauagaaauauaucucuuuuuaaauuucuagugcugggaaccaaacucagggcauuauuauuauaaauuguugauaaaaacaaauucuagaaaccacaucuagcaguaaggaagauaaggcaaauaaauacaaaccauuugcauuauaaauuauauuuuauauaaaucauauaauaaaagcacuauaaaugccgugauuaugauuggugugaagagggcaaguaagagaaugggaugauucugauuuuucaugucuaaugcauguggaaaauaaucuauauucaaagauuuuggucuuuacacaacagaagugauuuuuguuugucuuucggcuuucuuucccuaaaacuaacugcuacaauaguucgaacugauggaccugugguaguccauaccaccuuagauacaaaguaguaaugcaauggguucuggguuuuuguuuguuugugcaccaguggcacaaagguagugguugcuguuggugguacuguuggcaugcuuguaagauucagcauacugacacuaaguuagcgcagaauugcauuguucauuguugcguauauguuuaaagacaucagcaaugcaugccuccaagcgcauuagaucucucucugcagcccaguauguccugcgugaggaaaugggaaauagguaggagucacuuuuggacauugaaguguugugaguugugaguugaacuuucacugacuuuugcugagggguagugauuggcagacuuuauuugggcacaaguuauaggagcagacauuuucucaauccaaaggaauugccaauuauauuuggugucauugcuaaaauugaauguuuagcacaaauaagauaggaagggcuaguaaccaccaugaugagcguuucccuagaacauccuaauagucaugaaugagauguuuuucguguugcauaaugggaugaacuugguggagugagaaguuucaacgugagauuuacauaacuuugugagccaauauguucuaaauaaucauuccagaaggcuguaaaaaaaaaagaugcauggguaaagcuuuauucagacgugcaggcguuccagugggucuaacaaaguggcugugaucacugcuucggucgguuugcaugcugcacgccuuuaaauaucaucuagcagcguguuuaguagcuuugagugguauugagaugcucacaacagcuugguggggaaagggucuugguggcugcacaguaccuuacuuggaauaguggggggaugucuucugugaaggaaugugucuaagggagagacccaggguauuugaaggccuccuagccuccuugagcgagcuugaggaaaagauucguucauguuuugacagggccagaucuagugcuuaguagaucucuugauauacacaguccauggugguuaaauuaagcaaugagaaugugcugauguuugugguuugggucuccaugacaugcaguccaucauuacuaccuuuugugccucaguuuccugauauguaaagaggacugaagaguuauauggcuugaaugacuacugaauuuccuaggguagguugcaaauaguucauuccaggggccugcuacgaggguuauaaaaauccaaauccuuuuuguggacagcacacuuguguuucccucuugagccagcccuuccaggcagaauaccauuucucaguuuccagcaguacgacuuaaacuccgccuccgcuuuucgaugguuuuccucucguguuugcaaugaauauacacaguccaggcgugcgggcucacucugugcuuccagcuucauauuggcucucuuaugccuuguuugacugccugugagggcuuggagaggaucauauggaacuugacguuuuugucucagcuccuugacuucuguguauagacagaggccagcaguguaacaauagcuuuugcuucuuuuccagauuauuuuuaaugaaaaaacucaaagaaguaacagauagaaagaaaauuagcauuuugaaaaacauagaugaaaaacucacagaagcagccagaaaacuaggauacucacuggaacagagaaccgugaagaugagacagagagauaagaagguagggucgcacguguucauccgacuguugugcucugcccugggcuccuccccaccugcaccacguacuuuucucuaguccuguccuaaggacagcuguaugccaucccccagggacucugggaugucccuagcuggggucagguggcuccugcaugugcacauuggcgugccgccugaguccuguaacuggagcccguuccugugguugcauaaugcaucguaguccuuuaaucuuguuguauuggccauuguguaaagguagagaaaagcagcuuugugcuuaauacugaacuucauugucugguggcugaguucucguuuuagugcaagguauuguaguggugcaguucuguacuuaagagacuuaacuaagaccucaaagguucucuuucuagaaacaguauggguuaagauuugcuaauuuccuccugaauccuccuugacccuaucagcauucccucgagcuugcaguaugacagaguaucuuguaaaggagcaaggaauucucagguuagggguucuucuggguuuucagcaauggaugucagaaucagucuacagauaugugagagaacuucucuuugugggcauuccuccuaacuacugggcaagugagggcugguguucuccugcuucuucucucacuguugucuucugaagcugguuggucugaacaugcuaagccauacgaaguccuuguuauuucugaguuaacagguacugugaaaaguuuguaguacuuaguuacugaagaccugcuucauucuuuauucuugacucaguggcaggcaugaaucacagccacucucuuaguaacucugucuguaguccuacagaccagaguuucuaaaugugagguaauuacagugacaguuaacauuuuauagucuucuuuuaccuuacuggcugucaaggaaaauucuuacuagaagaaagagacauguaucucacuuuacuauuauguauucugaagauguccggaguacugagcaucuguggaugugauggucagcaaguucuuugagaagacccuuguuuuauuguuaacagcuauaccuuaguucacagaccuuacugcuuuucuucauguguuuccuucaugguugaaacuucaguuucuuguugugcuuauucugacuccucccaagucuauauucaguguuuguuuuucauuaaaagauaguaacauaaauacaagguaaaccauuuaaaagagaauuuugacuuuucuccuucccuguugacacuuuucagaucccuuuuuuuuaagauuuauuuauuuuauguaugugaguacacuguagcugucuucagacacagcagaagagggcaucuuaucccauuauagaugguugugggccgccauaugguugcugagaauugaacucaggaccucuggaagagcagucagugcucuuaaccacugagccaucucuccagcccuuuuauauccuuuuuaauuuauguauaauucuuaauguuacugugagauuuccauuuaauucauacuuuccuguuucugagaacucaguuccaguaguaugcuggugacuuugcccuagcauaugagcauacagucugcauuguaguacugagugucucacagcaguguauagugcagcauaugagcauacagucugcauuguaguacugagugucucacagcaguguauagugcagcauaugagcauacagucugcauuguaguacugagugucucacagcaguguauagugcagcauaugagcauacagucugcauuguaguacugagugucucacagcaguguauagugcagcauaugagcauacagucugcauuguaguacugagugucucacagcaguguauagugcagcauaugagcauacagucugcauuguaguacugagugucucacagcaguguauagugcagcauaugagcauacagucugcauuguaguacugagugucucacagcaguguauagugcagcaguguuugcgaguacguggcaccuuggacuacuuugaaaugcagucugugugagucauggcauuugucccacaggaaaucuguacagagcagaacuuuccccuuucuucuaguauuuuaguuuuguuuucacauuuaagacugaaagccaaccuaagauaauccuguguaaauauuaagacauaaggcuguaaacuaucuuuuucuaaaccauuuuccaugucuguaaauuccuucugaacauucugcccucugggguagcuuagcaaaggcugauagaagacguggagggagggcuaaugggagagugggagggguguggccuuuaacauaccugggcuaggugaagacuuuaaaaguagaggucacagccaggcgugguggugcacgccuuuaaucccagcacucaggaggccgaggcaggcggaucucugaguucgaggccauccuggucuacaaagugaguuccaggacagccagagcuacacagaaacugucucgaaaaaccaaaaaaaaaaaaaaaaguagaggucacuuuuggacuguauuuuucuucugucuuggaagcuuucacuaaaauacacaguggaauacugaagauauuuuacuagaaaauaccaagaccuaguaugucagugcauauuuguaaccccaguacuaaggcagaaucaucaagaauucuagccagggggauggagagauggcuuggcaguuaagaacacaggaccaggguuggauucccaggacccccaugaagguucaccaucaucuguaacuagguccagcagaucuuuuguucuuuucuggucuccgcaggcaccagacacguaaguguuauauagacacacaugcaagcaaaacacccauauacauaaaaugaacaaguugaaaaaaauuaaagccagccugagauaaugcuaaaaguaaaaauaauugaauguagaaguaaagaaaaugauguaaagcuaaugcucaaagcauguuccucagaaggcugugauuguagcaccuagagcugggucucuuuucaucuuugaagaugaaugcuuaaacaggccaugugauuugucuauaaaagcacuagcugcuuuaugggaguuuauuaaugagucugaauuucccaguucaaaaagaggagucugaauuuggccguuuugaugaauucuguuguuuuucuacagauucuacccuauugucucuucuuuucaaacccugagucuuuaucuaacaaggacugcuauucggacauguaacaagucuggugguuuucugaaguaucaacacaaacuuguaaaugacuagcaugggcuggugagauggcucagugguuaagagcgccgacugcucuuccaaagguccugaguucaaaucccagcaaccacaugguggcucacaaccauccauaacgaaaucugaugcccucuucuggagugucugaagacagcuacaguguacuuacauauaauaaauaaauaaguaaauaaauauuuaaaaaaucaaucaauaaacaaaauagaaaauauuuuuuaaaaaaugacuagcaugauucauuuaauccacuuacuuuauuuuauaauuacuugaaacguuugacuuuugguuuaaaacaaucuauucuccccaagauccagguuuucuaagauaaugucucuggaugcucuguuuugacaacauucaggguuugugugugugcagguggggagguagaucuuuuguucuuuggguucucuuugcauggucucuuuuuuuucccuuuggucauuuguuuuguuuucuucuugaauuuagguugugacaaagacuuuucauggugcaggcuugguuguuccaguagauaaaaaugauguugguuaccgagagcucccugaaacagaugguaauguguucccuguggaaauaugugcauguauguauauaagcauggggaaagcuuucucuuguguugagaaauagguagguguuacgagcaaacucaggcuuuccuagcuugaucuugauugaacaggcuauuuagugugaccaagcuguaucuuuuucaucugcaaaauaggcaguggucuuuaguucauagggugucuguaaugugaagggcuauagagcacucagugugaugucaccaaugcuccaagcaaggugagugcuuuggagacucuaagggacucagcccauucaauagcuuuucuuucuaaccuucuuuagcaccuuugaccuaguaaugacugcauuugguugcagucacaaaacacuagucuuggugaacauuuuaguuuucauacuccuaauucuucaugcagucauacagaaauacuuaguuacacaaaguuaauacuguugaaaaggagucauauguucuguuucuuuacugugaggccccacccuccauccccccacccucagccccccuugucauucuuuauauuuuuguuucuguggacauaaaauuuaaagagaauccaaauuaguaucuccucaaggaaagcaaguacuguugcuucauacacauagcugccugcuccucgggacgauggggcuuaguaauugccaggcuuuaauucuuacgugguguauacagccaguacguugggauguguuuuggcgcgauuuauauuucauccggcuugcuauaguaggaauuuauagaggaacugaagcuggcugauaaauggcuccugaacacuuaaccuguggcuaaugccacagacaaauggcauaauuuaaauuuguuuacauuuauaaguuaagccagcauuaaacauuuuuauauugauuauacguugaaauagugcuacauuaggcauauuggguuaaauuaguuucaacuauuuuuaguuggggggccaaaaugggggaggugugggaggaggaggggagagugggagcgagaaaucaccacaugcucugaggugcauauggaggucacaggaucgcucuuggugauuaguccucaugcugccucaugaaaucugguaaugaacuuagguggccuggccuuuguaccagagccuauaauccagagcccuaucaccagcccucucguuuuuuuaguguggcuauuuuaaaugugaauuauauauuucucucacugaucugucuugucuguucccugaagccagagauaaucaaucucugggaaagccuaggggcucuggcuccuggugcccaggcuucugcuugaaucagaacggaaguaacaugacagacauuuucaugguggauuaauaagauggcauuaguugaguuaguagaagacauacagaaaagccuuacuuaaaaucccccauuaaagaugauugugugauuuuguaguugauaucuuuacaucaugguuuuuuucagcugaccuuaagagaaucugcaaggcaguugucgacgcugcaagcgacgaggagagacugaaagcauucgcucccauucaggagaugaugacuuuugugcaguuugcuaaugaugagugugauuauggcauggggcuggaauuaggaauggaccucuuuugcuauggcucucaugugaguaaagcuccuccuucugcaguacugaauacacaaacucacgguuacuuaucuucucaacuccagcugccgagggggggauccagcuccuauuuccaaaccuuuggaagugauuugaaaguaaaaguucuaaaacgauuugaaaucuuauauugaggcaaaggugaauaagcagaauuacuuccucaaugucauauugaacucagcuuguguaucgguaucucgggggcgccaucuuugcggggucuggauaggcuuguggauauggauguggaaauguauaugccccuuucuuuuguuuuuuuuuggggugggugucaucuacuaccacgucuuaaauacuguuuucaaguauuuuaauuaaaauauuggagcuaguagucuaucauugacccuuucccaccuguaaaauugccuucucaugggcacaugcaugcuccucacuguaccuuugguaagccacugcuagggcaccaucuccaggcucccaauggcagccccauuccagugucuaaguaaaggauucacaaacugcagaugcuugggagccaccguaguuaguauuaaugcaaacuauaugaguaggucagagguguggcccugcugucauuaacauugccauguggcaagaaugccaccacuuuauagacuauccugaggagcaagacuaagccagcaugcaucagucauccagacgagacggcuuugaucacagguuaguguuuccuugucccccacuuugaauuacagggugguuccugacaaacugauccgacuggucaagaacccugacugagaccccuguuuaaagcaucauauggccccuuucuuccuggcuucuaguuaucaguaaaaaguguccaaaguguuacacaagcagaaugauauaguugucacaaaggaccuaaccauaaaugccauugaugaaguagguauuaaaaaaaaaaaauuacaugagaaaugaaaagaugugguacacugaauacgugcuuaaauaaaugcuaguucucacaaaagaauguuaccggguuuccugcuaggguguauguaaaagcaaugcugugaaaccauucaguaaaccugagccugaacucuaagcaggaaagaaaugcuuacaugguagagaaugagcugagacuaaaggggaggagcuggagagauggcuccgugggguagaacacccagagggacccaguucuauuauaagcauccacaggcacucacaagucaaauauguggugcacauuuagguaaaagacauauguaaaauuguuuaaaaaaugaugaagagauuuguaaccucauauuugucauaccuauuacaaggucuauuaaaaagucuuaacuaauacaaauaguuaagaagaaagcauuuaauggaacuuugggacaaaaauguugauaaaauuaauggaccaugagaaacuucaauuuguaaugccucugagcuccuuucaggacuuggugaacaguugucuuuagggcagaagagcagggacauggcccauguuuagggccaacuggguggacuuuguugcacagguguguucccauguauuuuucagcuguaccugccauuuucucacccugauguuauguucuuugcuuuuuaguauuuucacaaaguugcuggucagcuuuuaccucuugcguauaaucuauugaagagggaucuguuugcaaaaauuauugaagaucaucuggcaagcagaagugaagagaacauagaccagcuugcaggaugaacaagcugcccuguuagugcagugcuuugaagugggaccagcagacggggcuuuguuuuuaaggaauggagaaauaaauaaugggaauuuuauuaaaaacuuuauaauacggcucuucuaguguuucuuucacuugcuaauuaauaagugacacugcucaacauuuuagaaauucuuuaguuucugagguucuuuucugaguaugguccucaauauuagcuuguguauaaaagagugcuuauccaaaaucaaauaaccaucuauuagcuagaaauacuaggcuaguuaaaacuaaaaacacuuggggcuagacaaauggcucagcaguuaagagcacugacuacucuuccagaggacccuuucauuucacacauggcagcucacaacugucuaacuggcuucugacuaccuuacuuguacauauacagaacaaaaauaacaacaacaaaaaaaaaacccucucagugaugacaacagucucaaaaauacgguuuuaagacuuuauguuccauaggaccaauaugaaucccauccagauuuaucaagaugaaagggaagaggcagcuuuucauccaugccacccacaagcuaacacggagcuguguuuccaaagcugugcuaccuaucagaaccaagacaggaacuggacacagcaugacuguuauugugggcugaaaauuagcucagccauagagcacuuugucuaaugugugaggccccaggcuugauuccagaauuauuuacacagcaauuacaacuuggauguuugugaauacaguaaugaggauaaugagauaacugaucuuucaguuacugagcauuucauuagagagcaagcucccugguauagaauacggagccugacauucucaccacuuuccuucacuaaaggcaguuugaauugacuacuauacauauuuaaccuaggggucugacuggaacacauuuuaagugccuaagcacauucacaaaccaccaugacucaaucaggauuguaauccaauuuaaauccauuuucuuauuucuuugggcccaaugauggaauuccuauguuaaccuuucaagcauuuauguugaaccaugcccaaggacauggaaugcuaugaaagauauuuuauaaugaccuaaacucacauuagcucaaaacugagcucguaaugguauugucucuaaauuauccuaccauaauccuuucacugaugca

SEQ ID NO: 4449 - RNA, 73382 nt, Mus musculus
guagcuaaaaagcauguauuguuuuuaauagaagagucaaguucaguucuaaacguacacauuagauguaucccaacugccuguaacucuagcuccagaggaccugacgucuguccuccuuggacacuugcacacauucacaguuuaaauuacacacacacacacacaaaaacacacaaccaaacaacagcaacaaaaacaaacaaacaaccccuuaguauugggcugacaagauuguucagugggcagaggaacuuuccagcaggccuuaagccugaguuugaucucuggcucccacauguuggcaggagguaacuggccacugagguacacugagcccuagccuguugcagugcaguguacacgcauucucaaucaugcuggcuuacacugaccacacagugcggcugcgcaaaggaagagcuguugguacaggugcaauuaaaagccaaaccacacuuuuaaguagagauuuuaauagaucuuaacucaucacaguaaucauuuuuacuguaaugauaugcagcuuuuacuacacuaguauaaauaaaaacagauaaauacagcucuaggcaacaucacagguuaacaaacuaagcauucuucaugaaccaaaaccaaaaacgauuauuaauagaugcugacacgcucgcccauuuucaucauaccuuccuaaaaaggguacucaaaugaggcgcugcacuuaguauauuggucaauaaguuugccaauuagcuaggcacauguaguucaugguauccacuaucuuauuugguuggaaaucaaccaaaccuuuaugaaaagagaaaaacagaacagauaguaauacccaaaagaaagaaaaaacaaacuccaaaccucugaacgcauuaaaaacacgucacuuuucauguguuucagcaguaagacacaucagauagagaaauguaacaaagaaaaugaaugcuuuaauauggauccugaaaugucagucucugaagaugggucaugaaaccagaauaugaaagaaaaggaaaugugggggaaaaaaaaucauguucaguuucaucgcguuaaacuacaaagaaacuggcgucuccuuugaagaccuggaacucagaaggggcugagccaccaaucagcagugcugaagaguuccuaccccagcagugucuuccauacugcaagaauacuuucagagcuacagaacuaccauuaaaaaugaguccacucuauuuagccaaagagcaacgaggaauauugaaaucugccaucaggaguaaaaagacaaaauaucacuggcagacagcaauuuuggggaacuuuggaucacucgaauauggcuuccugauuuucuaagucuucaagaucauacagaccuaaugugauuucauauuuauuaaaaauggcucaugccaguuguuucagaaaauaucugucugcacaaaugcauuuggccuuugaaaaaugcauacuugaagacuagcugggcagucuagugaguaaacacccuuugccaguuggaaauuaagaccaugauuaaaacacugccaauaacaacuccuuauacucugagguacauuauaacuaaucuguaaaacgugcaccauaucuacugaaaucaucacagaacacuucagggauggcugugaccuacccagugauucaaagguuauaaccacacugugauuuucuuguuuucauuuuugauugauuuuucuuaaaaaaaaaaaaaaguuuggcuuuaaucuaguacuaguaauuuaugguauuuucaacuuucuaguuuguggucaagauggacaggucaaagggcauaggccaggagauggcagugagaaaucagaagguaucauguguacucugggucacggacaugacuaccucuucuuaaacccuugugcccaugguaaucuuuacucauaccuccauauuuguaagucagaauuagucuauuaaaaaaagucacauuaaaaagguaaaauuauuuaugugcaauauuaacugaucugcauuuuauaaauuuuaauccauaaaaauauaaauaaaaaugguaaauuuuuaagaaaagaaauauacauuuagugcaaguuaugaauuacaguucaucuccagugucagcagugaaacauccugaaauaaaagaaugaucuaauuugaagaacaaaauuccaguguuuaacaugcaauuaauaccagguacagcuaaacagacuccuuccuccucuuuacagucacggcagcagcgcuugcuuucguuaugcugaacagcacuucucugucauaguagucaucucagaaauagaaaauuugcauaagacuaggucacauuauccauaaagucugagaggaaaaaauaaaacugauuagagucaaguuuguuuuagauucugaaccacacagcacacaagcugggagauugcauucacaccuccagauuuucccugcuuggccagcaguggugugugcacacauucccaagccuuuagugaugguacagacuacaugguuaauggcacaagaaacauucccuucuugugaugaaacgucaguaaaaucacaguacaucucaauaugagaaaggacugcuucaaaaggacacaccagagagguuucguuacagcuccagaggaagggggagggaggacagagaagcucuuuuggaauguagaaaggugaugcguaacuauacaauucaugaguuuaacacaacaguucugguauaaaagggcaagaccuugcagucuuaauagauggcucaauucaaaguagucccuccagaaguagggacuguaaugcgucucuguggugcugagggaaccgccagacgcucgaggaucccagggacagacggacggcuccgcggaggcucaagccugcacucccacugcacuccucagggagugcagccagugaggugcagagcaacaugagaugaauuacuguuccagguagcuagggaaauaccucacucuuucccuucucccuccccaaacaaucccucugcucucccagcauuauuugcaaaccggguugcaaagcucgccuuguauuuccuuuuuuuuuuuuuuuugaaagaagaaaaaaguggacgagucccgcagauuaaagaauugugcuauucaacaaacgaacuuccucuucugucuccucucuguccucaucuacaggacucaguugaacauuauugaagcggggucuugguuugccgucugggccauaugacggaggauaucuuuuuuuguuauaaugccaaggaggcgucugaaaaggauaaacagaaaaagcuauuaaaauaaaagggaaaagacaagaggaacuaaaucuauggauaaauccuuuuuguugacaggaauagagagcaaagcaagcagccugauugugcuuauuuuaaaagguguuuuacugcaaagacaaugaaauuacccagcaaccauccucugacaaaaauacaguggccacguagagugugaggcccuucccacuggggcugggacgcaggccucacugaagcagggcugcucugauucacguaugccaacagaaaaguagcaaaaacugggacgauguuugaacagaaaguaauacugauccaguuugaaaaggaaccuauugccauuauauuagaaaacaauuuaaaaccgcaauaguuuauagaaccaaaauuuuuaagaaauaauuugccuaguuguaugcagacuauugcugaaagcacauacaauugagaugagauacauaaccaaugaucugcgcagagcuucaccucccagacuugacagugugacaacccaggauucugaaagcauacuuagggucuuugcuuuucaauuuugugcucgccccaaagaagauacagugcuuuauucaaaguuuggauguuaauguuuacauuaaacaguagguaagaaaucaagaggcaauccugaaagauuauguaggugaggcagaaagcagaaugaaugggaagcuacuauauuugguuaguaguuuaaaaaggaugcaugaaacacuugugaaauauuagcauacaauagaaauacguacuuaaacaaauggggacagguuucauauaauuaugagaauugcaggucaaaauaauuugagguauuaauuguuaaagucacacaauuuguuaugcacaaaucaaaacuguaucucuaaucaaugacaccacuaagacauaaagccuauuaagacaaaagcuaccuaugacagucuagaaacacgaaacaaaggggcacacacgggaucuauggacaacccauaacgaaauggaagacacacauuuugacugugagaaucuauaaggguagcagagacagaacgaaugcuuugagagcucaucuccgcacugugcuccaguuagggugccaguuaacaauguacuccgucagcgcuucugcugcucagcucaguucaaggagcuuagauucacaugaccacagauuaggaagcaaaaaaaaaaggggggguuugggggugaaggccuggggcagacaggguuggcaguuuuuaaccagucaggagucuucugagacuggugaauccacuaggguagacagacuuuucaugcuuaaacaaguccaauaauguucuccgcauuacccaacugucagcaggacuuaauuguaacuaauucugacgagagauguuaguugcugcuuacuuucuaagaauggaauuuuagacaguauaucuaaauuugucucacagacaucugggcagacaccaguguaaguggcagcaggugggacuguggcagggagaccugaacaguucacaaguuucaugccuccugacuucuagggugucuagugaggacagcugacacagcuaaucaccaagggcuccacgugcugcuuuaguugcucgagaugcucuaaaauguucuucuuugugaugauccccaagacaauccugaaacagauuauuaugcuaauaacugugagaaauuaaacugaaggggguuccaaucauaaugauaaagaaugagagaaggaaauaaaacauaaaccguaagaaugcuccucaugaacuugagauaaaaauaagaugauuuaagaaucuagguuccauuuucagacauucuacuaacuuaaaaggugacacaauacuacuuuuagugguugaguuuauuuuuaaauuaaaaaucaaaauaaugaaaguaugacuaaauuuuaaugauggagaugaauaaaagugaaaaagaaacauaaugacacacagcuaccggccgcuacacuugggacugcuuucagugcucuuucccuggaugaccagcucucaguuucugagguaacaaccuacacacuguguaugcuggggagggaggggcuuagucagaaagcgcccccccccccccuuuuugguuuugguuuuucgagacaggguuucucuguguagcccuggcuguccuggaacucacucuguagaccaggcuggccucgaauucagaaauccgccugccucugcuucccaagugcuaggauuaaaggcgugcaccaccacgcccggcuaaugagaaaucuccuagaccucuacuauucauuuggaaauccaauuaaggaagaauacauguaaauacuaccgaccucauucucaggaacugaaucucauuucuuaagagaugguaauaaaacauucauggguacuccaaaugaguuuuaaugcauauuuuucuaaguaauuuuucucaguuuaugucauuaccaucacaucuuacaaaaaaauucucauaaauucucaugaagauacuuguaacuagacugcuuuuaauuauuaaauaccuugauaguuauuuuccaaaaauaaaugaauuugccuacaguaugugaugauauaaauuucagaagcccuucuaaaaugccuucagaauaaucaggcauuuccuuaaugaucugucugcuuaagucaacuuucuuguuaagcugccuuggaaauauuugauuucuuuuccuuccuuccuccuuucuuuccuuuccuuuucucauucccccuuucccuuuuucauuccuuucccuuccuuuuuuuuuuuuggugacacaggcuuucccuguguagcccugggacucgcucuguagaccaggcugcccuugaacccagaguggccucugcuuccugagugcugggacuucaaggugugugccaccauaccccaccaaaauuguguacaaagagucacuaugggacuugaaagcaaucugaaaauauuuagaaacauuucccucaugaaacaauagcuggggcuagagaggcaggaagcauauucacauuauuuuguuuaaaacaacggugugaaguuuucagagcaugugaaugaccucuccagaaagcgcaacccuguacuguauaaaugugcauuuguccccuagaggaaggaagguccuugggcaaaacacuugagggguuugaggguuuuuuguuguuguuuuaguuuugggguuggugguaacuauguuuaaaguauauuguacacauguaugaaauguaaugaauuucaugauuuuguacaauuaauuaauauauaauaauaaaaaacaaggcuauuucuuaaagcuauaaagucuauagguuuuuaugguuaggagaugugggauucuuagcacuuaaauauaguaagagcaguuugauucuugugugugcuuuuuuauccaauuaaguagaaugguuaauuucaguuucccauuuguauuaguaagcucggucaguauuugacagggugaggaacaugacauauuugcacagacaaggcagcacacuuaggaguauacacguguauacauuuggauacacuggaacauuuacgaacuuucucaugcagaauuuuuaggagaggaaaaacuagucauaaaguuccucuucaccagucaagauugacuugagaagaugaaguuaguuucagguuugcucuuucaguuuuaaagaaugaaaugaaaagaaaaaaaaaaaaacucaaugcaaaauguuucugaucuaucaguaaucugacguuuauuuuugggcuaacaaacaaugauggggaaguuaguaaggcuuuagaaacuggcauuucccaaaguaugcucuaagaaacagcaauuccaacagugcaucaccccaccaaaaaaugucagcauuuucaggcaaacuagguaagcuaugauuucauuacugacagcuggagaaucaaaagccaucaacaucuucaaaguccaaagaaaucuucaacuauaacuuaauucaauacuucucaaacuuaugagucacacaacuuuuauuacucgccuguuuguccuauaaacugugagaacuaggguuucuuaaacaaacucagauguucuguuagcauauaaaauaugggacgacacugacaugacauccugucuguaucuguucucauuacuucuccacucuuuuuaccuggaccuagagucccugguuugcugcauuuuaauucccccaaauaggucuuuuccacugcuaagguacuacaugaaguuggaaaacaaagaacuaccuagaacuucacagucuucacuuuaaagcaugcugucuuuccucaguuuuagccauuuugagaauaaaacaccucccuacuuaguagcucaagacaauaaagucaagaguuuccuccccaaaugaucuuuuucuuuccaaguauauuuaugugaacuaaggaaaauaugaucaaggcugugagacgugacccuggaggaaaguuccuucacuuuguuuauaugccagcggcagcagauaaaacuguauguaacuaauucuugucccccuaaaaaauaauuuaauccuuuugagggucuauacugccgaaauccugucaauuaaccaguaaaguaacauauaaaaauuaaucuacacaguagacuaauuuaaccacaagaacugaacagaaccgaacagaacugguguuugucgaugcaaaagagaaccuaagccaggcacagggaacucaaagccaacaguggcuuaagaaaacucacauucgguuccaagcaagccauauaauggcucaaagggccugaggcaaagcuuuauuuauuaaauuuuaaacaaagaaauuugguagcauuuuuaaaaauuagguaagagcaaacaaaauaaaacaguagacaauaguauuuuauaaaacaucuuugauuucucucuaucacacucuagaagguggcucuaauagucucacguucugcuucgugcuguuuuuaaguagaaugaguaacuaugacauacugcugcuccuaacccaaugugguauaauguagaggcccagaaaauguuuuaagagauuaagaaaucaugaggaaagaacauucauucugucaguaaacuaugcuauagcaggauucugggauuuugucagcuggggaguuaauuugaaaacaucuuuacaccugucaaacagaaccugaccuaccugguuuucugagcuuuaugaugaugagaaaaggugucaaaguauucaggaaguugucuuccuuuguuuuuucuuuuuguuuuuuaaugucaccuuuuccuagagagggcucauacguucuguuacccacaaguuuuuauacaaaacuuuaaaaagauaaaauuaguugugauucucugauguauaugcuacaguauuuaaucagcuucacuuuguucagggugagccacggguucauaacaaacccaggaaacaugguucccuucccuaacacuucuguggcaagauuucacacggaguguucuauggauuccagcaagucacuggcaagcaagcaaauaaccauaaucucagugucccugaagcucacaagggucacagacucgaggccagcuccaaauacagugaggccccgccucagcaacaaaaucaacaaauaaaacauuuaaaauucagcaaagaaauaaaauauagaaauaaaaggcucucaauacaugaauaguuuuaaguaauuaacaguucaguuuaugggucugauuuguuuuagagaagguaaacuaaaauaaauaaauaaauaaauaaauaaauagguaagaaggaaaaccagaguuauagauuuuuaauuaaacugcaaauuuucacauauuauuucauuaaugauagauacuggcucaaauagcacauaccaaaauaccuggaaaaacaguuacaaaaaacccuauacauaaaaaggaaauagaaaaagaaaaugguuuugucaaugcucccuacccccagguaagaaacaccucaaguucaaaaaacucuucauguggagaugucucccuaucuauuucuucucugacucugaacuacaauauccucuuacucucagggaagugugaagcuugacugauccuacauuuauagcuguaagccagacacucccacuugggagcuuacuuggacucuacccugaaaagacuccauuaguaaggagcauuaauuacagugagucagcugucuucuguaguguuaaacuuacccguugugaguuacaaggcacugccucagaccaagcuuucgaaagaugucuaccacaaucuccauugggguguggucugucacuguaaaagggcucaugucaaggaugcuucucaguuuuaauggccguggacuuucugcuggaagagauggaguaugcugugcaaaacacacccgagaacugccaacaaucccuucuuguuuuuuucuggcacuuucugaaaaagagauagagacaaggauccauuuucaauugguggauuuucuuuucuuauaggcaacuuugcuuauucugacauuaaaaacaguguguucuaugacuucugguuccuuuucuuuuugacugacaaagaacuugacaguaauuuccuauaguuuuauucugguaugauuuucaauggugcugaacuauuauuuucuaucuucagaaacauggaagcagguuuggaauuggaauuuuauuuaaaaccuguagacaucaucacaagagcacuuuacugcagaguccaucaucaacugaaguccacaauuuauguugagcaauuuauucugcacuggagacgagacuaaagccgcucacccuugcucuguguugcugucaccccacuacugugcaauuacacuccauaaaggcucuaucaauuucuccuccccuccaaugugccccguccagcugccuguuucuucuuccaccuuugaggguguaagacagaagggaaagaacagaaagcgaccacacucaggaaaaugacauccugagacauaaaacaugggcagaacaugcaaaugaaagacaugcagccuugugcuuggucuuuugacaaacauuauugaaaacuaugugugguguaaauacacuauuaguuauagugaaaauauuuugagcauaaauuuugcuacaaaauacuuaagccaaaauaauaaacuacagucugacugggaggaagggaaaaccacugcuuggagugaaugcuaccaaggcuucuuccucuuucuggccacuaaagcuguacucagcugugcugucgcacaucuggguaccaggcacuaagugaggucccaauggcuugugaaccagccaccugacaaguaccgucaugguaugaaagagaccaacauaaacaguucuuuaaacgcuuccuacauugcuuuuagacuguaaggacacaccuaacagcgugugcauggcaacugaauauccaauguaaacagcaacaguggauaugcauaauggagacagacacagaauaugaugacgggaagcaugacgucaaaaauagcaagaguaugaagagugaaaguacagcuguuacaugcaguagguuaucaggaggagacaaucagacuuagcauucucgaauacuguaauaggggugugcacaucauuuaauacucgaguauaaaaagcaaacauuuuaaaaauaacuguaguuacaauaaucuauuaauacaaacaacaguaacaaugugauaucaaauaguuaaaauauuaaauauauaaauaauaacaacuaugucaccaaugaaaauaacucuaaauauucaaacauuuagauguggcaauacauuuuaugaaaaugucucuuguauucaaagagacuggaacuucuaguuacuaauacaucuugaggucacuuaaaagacuguaauuaagcugauuucuuguuguguacucuucagcuuguuuaacuugccuuuuaagaaaacaauauaacaacuuuauuugucuucaauucuuccauguagucagcuuuuacaaccuaagcuaaagcagagcuuuaaucuuaaauuacaugcuauucuuccaugcuccugaccagagaguaauguaugccuguacauguggacugugguaguaacuuccugaaaagagcaaacaauugaaaaauggcuuuauacaggcacuuuuugccaugagugccaggagcagauauuauuugguaacagcacaucugcagcuaugcuugcuuuucugagugcuucuaggucagcggaaguaagugaaucccuugcaaaccucucagauuuuauaaagcaccccuuaucccuuucccgugccgugcuuccugugcuguucaagaaacccagagcaaagcuuucgguagggacacaccaacacagagacagauauacaacaaaacauagcaagagggacaacgagacacagaacagaauucaagcagacacagacagacacauguaugcacacaugugacagauaagccaaaaaccacaagcuccagacacagugacugaagacacagggacaaguagagaauucaaccuugaccuugcucuuucucaaguuaauccaagagcaagccugugauuccacuccguaaugugagaacgaaacgcccugcgccucugagguagcauuuaauacauuuaaccaacacauuuacaacggaaaaguuuguuuugcuuguacuuacugcggugcagggagcaacccagagccuggugcuagacacauuuaccaacugagcugcaucccuacccgaaaacgcuuaguucuaucuaagaaaaaaaggcgcacuuuuucgaaugcccuugugugacagaagguagcagaaguggacguccagccucuaugccuuacaugggucauuuuaagaaguggagguggaggggggaugaucaagaauuaagucauccucagcuacauagagauuuuugaggaagccagccugggcucaaaacguucugugguauuucaaauauauuuugcugagcauggacauauauauauacuauacuauacagaacugauuuuucaauaaauuuuuuuaaguuuacagaagauauacuggcaaauauuuaagauauguucaaaagucauccugugauggaagauuucugaugccacaucuugauauuucucguauauuccucuaaaccaacauuauuuccugugcaacagucucucugucaagugacaaaaguugaagucaguaucucucuacagcagguaggaauaugaauuacuaaaugcaucauggcuucaaacccuggccauuccuuucccugucuuuaggaauuucaaagcuccuuaagaccucuuuccuuuuucuugggcuggugacuagcagcaacccuagaaaacaggaaggauugugacaccugaggauuguuugacauuucuagcucaagguacuacccaaaaaucuagggaauagcagaucaauggcuuaaugagucucuuucucaccucugacaucaugaggaaggacauuuagaguugcugacaaagauuaaaauucuuacuggccuucccaucacagggcagaaagauaaucacugaagcauacacuccuacagaacacaagacuuaaacuaacaccacuugccccugaaaacccaaccaauuaaacaucauugcuuuuucuccuccuaaaauguauuacauacaagacauauacauucaugaaguuguuuuuaaaagccguaccuauugcaauagucaggucucuucugagggcaaaucccacuaaucucugagauucuuuugacauuauaacaggaaagccauuauagcugguuucauuaaucauguuuucuaugucaucuacugucauauuguccugugucaaaacagcuaagggagggucacuucuucgaggucucauaacaucagcagccaggguuguaugagugaauucuucuuuugcauccaagaaaggguacccauuuagucggaugugugcuucauaaauaccuucccuaccaaaggcaucaccaacccauuuacuggucauuacugcagccauaagaggaacaauauauuccaagccuccaguaaguucaaaaacaauaaccaccagagacacagucauucuugucacaccaccugaaagaaaugaacaccaguggucaggaaaggcaggacucucaccaggacaaguuacuagagucgcauacuaggcaggugaacaggaaaucuagacagaucuugaucagugaaaagcauuaucauucaagacgauaacuauuaugccuaagaugaucuggagaaaaaucaaucuggcuauaccauggaagaugauuauaacacuuguaaacuuuuucuagcauuaaaaaaacaaacaacaagcugagcaagaaaagagacuuugccauuuugauuuacggcugaagcaaagaaaaauuucacuauuauaaaaguuuacuauaacuucuuaaauacaaauaagcacauuacagcuuucuugcuugcuaccaguuuagaaauugcguguguauguauauguagaauauuaaauaaaauuccuuaugucguuucaaaacgugugaaauauuuugaagccuugugauuuauuaacaguguaagugauaacguuagguauaaaauucauuugaucuggguaggguuuuacguagcuuggacaaggaucuggguuugagucuaacaucccaagaaggagguggaggaggagggccgggaagucuccugcuuuccucagaugagcauucuuggcugucaucucucugccuguacuguccuagucccucugcuccucccuggccucugcuauacuccuguccugcacaccacaccugacuacuuguucugucaacuacagacuuugaaguagcuaccaaagaaaacaacacacgcaugaaauccacauuucucuucuuuaccaaggaagggccauucucugaucccaaauucuugcacacgcucuuccucucaaucuaggugauucuuuuugaaaccuaaaguuuuauuccaauaucucaacuguucaccucuacagauuugaauucuucucuaagauacuugaguccuuuucucaggauucucauuguuacuaaacuagcccaggacccaaauuauucuuucauuaaaaaaaaaaaguaugcuccuuuuaaaaucuuuuuugagauauauuuuauuauguguaacuguuugccugaguauuacaucugagcaccugaaggcuagaagaggauuucugauauucgggaccuggacuuaccaacaguuauggaccaccaugugagguguugugacucaaaccuaggucuucggaagagcagcccaugcuccugacugaugagccaucucucaguccucgugcucucauucucauagcacuuuaucuuaccuccuugacucucagaccccauuacuuucaaccuacuucacaagccauuuacuacaacuaagaacuacuuuguguuuuuaaagacagggucuuacuaugcagcccaggcuggccuccauuucugcugggauuacgggcacgcacagacacaguggcuuaagugucauuuccacuguguugcucuucuggucagaaggccuaacaacuuggccagugagaugcauuggcaagcaaagcaguugcugacaaacaugauguucugagcucaacccccauuucccacauggaaguagagaacugauuuucauaaacuguccacuaaccuccauaugcaaguauaacaauauucugaaacacaccaccaaaauaaacccauagcuguaacuuagggagcucacagugcugguuaguucaguaagccuuucaguuucuuaaucuaaaaaaucaaggacggccacacaucauguacauacuacucuaugucagcauguccuugccaguuuauaaaggcuuuuucuugaauuaaacuaagaacuuauuguacaggacucaugaccacauccuuaugugcaugcuaccucccacaauucucccgacaaccaagggacacgcuggcauuuccauuuuacagaugagaaaaguaaauaucaaagaaccaaaggaacuuuuccaaagucaucaagcuaaaaauggaaaaccaaggcucugcaacaaauuggaacaauuucaaauacaaauucaucccgaugcaaccucagauacuaauuuuuauaaucuacuucuuaccaauucaauguguuucccaggauauucaaaauguacuauauaauacauuucuucaaauuaugaauuccaaauauauuuucauacaaauuuaucuuugcauuagaaucuucccauaaccagaguacccugggaaagccucaaagaguaauaacuauggcucugaauuacuccgaggacuuauguaggucugugagaaggagcuaugugacaaaaguaaagaagacaguguguguguguguguguguguguguguguguguguguguguguguguguguguguugcacaugugcaugcaugugggugcacggcagugcuagaggacaccugcugcuuuccucuacuacucugccugauuccuuuaacaaaggcucucccacuggaaagcucccuagccagugagcuccuagaacccaccugugcccacccuccaauggcggggucacagcaaugcagucaggccuggcuuuggggauuggcccuggggaucagaaugagguccucacgcuugcaugccaagagcucuugcucacugaaccacccccagcccucuauuacauguucuaucuuagcauaccccaaaacccugugauucuucaaaguacagcuuuaaaaaugaguaugacuuuaacucauucauguuuaaacauauuaugaauugagaaccagacaaaucugucugauggaaaaugacccuaaaguuaauugcuugaagaaucagauuucaaagacugguggauuuugacauugucaucaguaagcucauaauucuaguggaacgaaggcauacccaaauaaaagaacuguggauugauagucuuuaaagagggcugccucaaagauaaaucuugaccaaagcuuuggaaguaugaaggugauauguauaaauguauaacuucucaguuaaaaauuaccuuuaaacagccaggcgaucguagcacgcgccuugggagcacucgggaggcagaggcaggaggauuucugaguucgaggccagccuggucuacaaagucaguuccaggacagccagagcuacacagagaaacccugucucgaaaaacccaauuaccuugaagacaauccaauccccacugugcccuuccuggaacaguugagcucuuagucccucuaacuucugcccugcacucugugagcccaggcaguacacacugcuguuuucuugcugcugggcucuucccagaggcagcccacacuuccucagucuucucucgccucucucucacuuuaccugcuaaagagaauguggaggcgaaauacuugcuacuuuguugaaaaugauuucuaauuucauuugauauuacccuucugcagauucugagucgcugagcaaaaucgaagucaaaguaccaacuguuagucaauauuauaccaaaauuugguggaaaauuuaaauauaaaaccaaauaauuuuucagccaaagagaacaaugaacagauucuuacagauuuaaaacuauuauuuugcuuuuaugucacuaaaaugaauaguuaccauuucuuuuauacaaauguaacuuagacgcuaaagaguugauaugauaaaucuuuauuaaggcugauaaguuauuauagagcuuaaugugaggcuauucugaagcuucauuauaacucugacuuuaggaacauggcuaucaauuguuacacauagacuaagaucucuaucagugaaaaaccaagauucuuugaauaggauucagauuaaggcuauguuguaccaagaugguuucugucauaaagcauuaugugauauuauaaauaugguagcuauuauuacauuuuuacaguaaacaaauguucuuagacaaaacaaaauccaguacuacacaagacuauuagcgcuucauuucuuuuaaacgauuccuuccuucuaccucgcaucaucuucuuccuagccacaagagucuagucuacuacuggcucuuuuuucucagauugccaacagccaaaaaccaagcaaacagaaucgauccuauuaccuaagcacgcagcagccccaaccauggcauacagcccgggagugaugcagucagccccaaccucacaccacuccuugaagauaaaccagucguggugauaguaggcaagcugcuccacagcgauccccacaauucucccugcaauggcuccaauggccaugcuggggauaaacaagccugacgggaccugugacagcaaggaaagaacuuuuaaugagguaacaguucucuaaucacgugacugaaaacuagauccuaugaauuuuuuuuucuaacaauaggcuccauucguaucuuaaugaaacgcuaaaguccuuacacagaguaaacuaccacaaaauccuguuauaucaaauaguuuguuaguaauucuuagauuucaguaacaaaggaauaaagcagcuucucuaagucaaagagaaauagcucaaaauuuaucauccuuuauccuaaaacauccuuagucucuaacaaaguuuucaguaguccacaguaaaauggaaggggguaggggagaaagacagguauuucccauaaaaccaaauuuguuccaucugaagcaguaagcucccaagauugucccuccguuuuacuuucacaaaugguagaaacagcagauguuacuucuccuaaagagcuacagcauaugucaggugauguuuccagaauucccaauauucuaaauggaauauacaugugaaucaacuaaaaaagaaaaaucuuuauuggaagagauucuuaaaaaauaaggacagaacaaauuggcauguucugggacaguuaaagggauauacaacacaaaggauuaaaauacacuucacaaucuucagcuauaauccuucagccagagaccaggacuuaacaagggccugccaccugccuccagcuucuucaguguuggccaacuacagccaaugagacucuuuggcguaauucuacuguuaacauaggcaguuauuggggaaaacaacccuuagacgggacaacucuaaggccucuuuaacucugguaggaaaaauaagaguaaaacuaagauuuuuuuucuguuuuuuuuuuuuuuuuaaguuugauauucaaugcacuaaaaaaggcaaaauaaaagcaaucuuaaaacuaucaaccuucuaaccucacagaaauaaagcuguugcacucgcuacaugagcucagucugugaaaguaugccaucgcuuauaaucaucaacuccaaaggaacuacagguggcaugacugacuuugugauugauucugcuucucuauguggguauuccuaagaaagcuguaguuagugaguccaagagaagcaauguuccagggcucacagcucuaaggcccugauggauugaguccuauuagagaucuagcaacuugauucugagaccacagugccaauuuaagcuaacauacuacagugguacagagaagguaguauaaugguuucuccuggauuguuagccagcuaacuuuuaaaacaagagauuauccuguauuaucuggguggauuaaaaguaauccuagaguuuuuuuuuuucauucgaaagugggauuucuaagaauuaaacaagagaaagaucuggccaaccaggacuggcuuugaguugcaagaaagggaacauaagcaaaggaagggaugcagccucucgaaucuagaaaguucagaaaaauagacucugucccacagacuccagaaguuacuagaaaccucuugauaucagaccaauaaguccuuuucagauucuggucucagaagugcaaucauuuggaugaaauuucauuucuuauuacacauaaggucuuggagauaucauuauuccaguaucaucucacaugagcacuuaccuugauaccaaaagugaauacugucauuauuauuuuaaauaugagcgcuaggcacaacugccagauagcugaauauacuccaacgccugcuggacggucaggaauaucgucaacaauuuuacuggcauucaugucauuucuguagucacagagagaggaggauuccaacggcccacaaucuguaaacagcucuuuaaucaguucacugguguugagccuuguguauggguuggggaaggcuaucacagcaguaauggcugcaacaauaaugacuucgagaacaggauacuuuccaaauuugguggacuugcgucgacgacaccaggcaauauuugcccuaauaaaaaaagcuccccaaagcccuccaaauaccccuaggagaauaaaaggaaacaguucaaaaagguaccaugguguaugauacuccacauaaaagaggaccagacggcuguuaccaaauggauugauggaucucaaaacaaaugcugccaccaaagcagcaaaaaaugaucuccauaaaguuuugagaggaaaauaauagcuaaccuaaaaacagaaaagaaaaauuagugcuaucaccuauuucagaguaacuauaacuugaguaaauauaaaauuuaccuuaaguaacucaagcuucguugcaguuugaauuuaugugauuuguccuaauuaaaaagggaugcuuugacuaucauaacuacaaauucacaauaacugauaaugaaugucuaauaaucaucuagacuaccaagaacuguuuaguuuuccaagaguuucauaucuaauacaauuauguuagcuauaaauaucucuauaguaacucuuguuaacuauuaaagauggagcucacuugucucuucuauaaaaaaauacagauuccaugaagcaaugaaauuaucuccuuagacaucaguaacuguuuaagaaauaaucauacaaaaagagaaaagaaacaaucauacaaacuucaaacacgcaaaucauaaaacuuuauuaaaacucagcuuacagacugauuuaaaauaguaaaaauaaaaacgcagcuguaauugagccagcagauagauagauagauagguuucagaggcuuccacugagugaaauucacauuuugccaguuuuaaauaugugaaauucagcuagaaacaauuaccacuaucuaaacaugagcaaaagguuuaaagcagaaggcaggaggagaagugggucagcaauaaagugcagauacugcuccuauagaaaauucaagcuuggcacccagcaccuccacccagaggcucacaacagccugcaacugcagcuccaggggaugugaugcccuccucugacuucuguggucacuugcaacucacccgcauauaacucaaacacauauccauacacagaauuaaaaacaaaucuuaacaaaaauaaaacauuaauaaaaauuaaguaauaaaaaauaaaacaauuuucugaaguuagcaguuuuguauaaaacauuuuuuauggagaacuacuuugaaacuguauacaaaauaaaguuaaaaucguaaguucuauuacacuagcaauaaaaauaaagugugcaccaagauacaguuuuaaugcgauucuuuuuuacguaccuccuccaagcuaaaaagaacuccuccgaucggugcaccaaaagccacagaaaccccagcagcugaggcggcugacagcaccuagggagaggaugcaguuuguuucuaaaguucccuuaccaaucaaacaaccaaacaagcuuuuguauuccaugcuaucccagggccauuucagaccuuaaccuacaugucccccuugcaaagcaaggaaggcaaguacucauuucucuaaagaguuauuuuuucuuuucugcuuuaauuuaaaacucauuugcacuuuuucuauacugucaaaacauuaaugccaaacauacaaugaguguacuauaaagagaaaacaaugaauacaggcaaccuucaauacuuaauguugguacaaagaggggagagagaggaaacuguggaauggggguacacguuuacuuauuuuuaaguaggacaucauuucuccagauuuuggagcuaacugcuucacucauuacucuaacccuuaugaaagacgcugcaguccauuaaacaguuucuauuauaacuccccuaaacccucugaaguauagucuaaaaguacaaacaacagccccuuugagucacuaacuacgugguaaagacaguuucaaggaagaacaaacuccacacacucuugcagcacuccugggcagcugucugugcccugaucacugcugccuucccaccuggaaagugauuggauuauuauuaagacucuacuccuuucacuacugugaucccgugaauaucugaggguacucuaaucacuuccucaaaucaucucauuuuacaaauuuucuggaagaaaagauagaggagauaagaaucaaguuguaaugcgcauaaauuguuugaagcugcaggcagaaguccugccucugccauacacuggcugugugaccauaguaaguaccucagucccccgugucucccuguucuugucuaagacgaucaugauguuacuuagugaacauauaugaagcacucagaauaccaucuagaaucccauaauacaggauuuggauaugucuuuuugcuuagcauaccuaaauacacacacacacacacacacacacacacacacacacacacacacacacagagagagagagagagacaggcagacagacagacagacagacauaauuauagcaauagcacaguaguuaaaagcauaacuuuuggaaucagaaaaaauuuaaauccauauucugcuauaacuuguaugcuaucuaaagcacgucugcuggcguuuuaaguccuaguuuccuaacuucuaacugauggugguagugccacaguaggauuacuauggaaucaauuuuacaacguaagcagauacuuccagaguaccagaaacauagcaaaguauaucuuuugaauuuucaucaaggacgaaacuaauauacuuuuaaauguuucacuuugggaauaucuaaauacaaaacaagaacaauacuuuaaugcuaauauuacaaaguacgauauaccuuguacauaguauauaacuuguauaacguaccuuguaucuaccuuguauaauauacaagguacuauaauuauuuauauuaaagaaacugauaaaaauguguguguguguguggggggggggggagguuacacuaguaacaacaggaugaaaggcuagggccugcguuccgucuuugaugcaauggaaaagccacacauuaacaacugaagaucucuguaccacacaaggcugcccaggucuggauuacggaaacauaagguaagacucccagagacaaugaggcuaaggaagcucagacugcagucgugcucaggaugcugcuucccuucagagacacccacagcaacagagaaagcuagcuaaagcuggaguuuacuuuaaucaccugcuaggaaaaugcauguugcucugcaacaguaaaagaggaguguaagguaccugaguaaacaucucccacacucccuguaaauuccugacuuaaacuuucaaaguccugaaggcccucagaacuucgccauggugcuuucaagaaagguuucuguguauuauacagaauuuccauggcauuagacucuaucuccaggaggacaauacagcccauuucccaagccugaaaaugcaguaaugucaaaaauccagggaauaaaaacagcaaagaucuuugaagaaaugaaagggguucuugcuagucugacuaaagcagcagcagcagcugcagcacucaacuccagaaaggugaacguuacgaaagaaaaaggaagcacacgcuaaucucaaauuuuaaucugaauccauggcuuauguaagaguuauaggaaucuuuauaccaggaagucauucaauggacaucaaguugcuuuaacauucaucccucuguuaaaucaacuacaaauaccacuuaccucccucuuuuuagcuucauuggugcuauacuuuggaaagagguaggaaaagauguuuccacagcagcaggcaacauguaccaggggaccuucuuuuccuaaacucaaaccugaugccacagccagcacuaacgugauaguuuuaaucauuaaaguccauuuucccaaguauccucugaugauaaauccacucaaaauaguuuuaaucuacaaaggaaugaagaaggcaauucaauuuccuuuaggaaacuugagaacuuaacuucgcuaaaagucucauguuucacucacaaaacaucuacgaaacuuugaccaaguauaaaacaauucauaauuuuuaaaacaaacuuuaucauauaucauaaauauguaucacauaauuaaauauaauuaaauuugaaauuuucaguuguaggaguaagcccaagcauuuagauacauuucagucugucaggaauaaagacuguaugcuuucuuaccacacuggaauuguguggaauucuuacuuauaccauggacgaugaacagcaacugauaacaacuguagguauugguuaauuucuaaauauuucuuuaccuacacagcuuuuaaaagucacuauaauuuauuuuuuuuuuuuuuaaaauaugagauggcucagagguaaaagcacugucuguucuuccagagguccugaguucaggucccagccaccacauaguggcucauaaccaucuguaaucagaucuggugcccucuucuggccuacagacauacaugcaggcagaaugcuguauaaauaauaaauaaauaaguguacuuuuuaaaaaaguuagaaaaaacccuaauuuuuaaaaaguacaaaauagcaguaaaugaguucaagccuaaauuacuacugaaaccaacaagcaagcaagcaucuauacuacucaccuacugugggcaauuuuuuccuuagaauauaaaaucaccaaguuuauaagucauuuacuauuuauaagacuauuuacuauagucaaugguuuuagaaagaaaagaauauauuaccauaagacucaaacagcaaaacaucaacuaagccaucaaagaacuuaaggcaacaaaacauuucugaaguuuuuguuguuuaaacuuaauuuucuuacuuauaagcuauguauuaguggugagaagguguguauguguguguguuugugugugugagagagagagagagagagagagagagagagagagagagagagagagagagagacugaugaucucucuaguugaaacaucucucuagcccccaguuuuauguuuuaaauuuucuuuuucauguuaacaaccaaaaaaagaaacuauuuucuaaaaaaagugcaguuccuaaagauaaaaaguagcauacaauuaucauucaauaauauuauauggcuuaccucuggaauuccagagccacaggcauauggagcaaauacuuucaccaaagaaacugcaagaaaggcaaaacucaaagcccaaaagauguacaugauguaguucaugauauaagauccagggcccuaaaaagcaaaacagcucauagugugaacaugcucuacagcgcagcacgaauucaagcagcuggcacauaaggaacggauggagaacuuaccaguacugcucuuuguaccugcaggguuccauucagauaugcuguccagacugaguucacacuucuaagcucaaaacauccucuuacuucagcuuccuucccaaguagcugggacuacauaagcacgugccaccacaugcacacaucuggguaaaagcucuaaaagccucuugguuuauuucuacuauaauaaaagcucuaugugaacaagguauuuaaguaggauccaaaagcuaaccacuguacauacuaaguaagaagccuuauuuccgcuugguaaauuucccaguuuucuugaugccuaaagucuuguuauauagacacauuaauuacacacugacauaugcuuacccacaaauguuucacaaacuguuaguggagguaaaagucuguuagcacuuagauuuuccuuuuuuuguugucuuuuguuuuguuugggguuuuuuuguaauuuguuuguuuaauguguauauguguuuggcuguguaguucacugaaccacaugcagaagccaacaacaugcauuucaggaguuccgaaaagggcaaugugauucccuggaaacucaacuacagcuaagagcuuccauguagugcugaaaacugaacucuggucccucugcaaaagcagcgaacacucuuuuuuuuuuuuuaaauuagauauuuucuuuauuuacauuucaaauauuaucccauuuccuaguuuccccucugaaaauccccuauccucucccaccucaaccugcuccccaacccacccacucccauuccugguccuagcauuccccuacacuggagcauagaaccuucacaggaccuagagccuccucccacugaugaccagucggccauccucugcuacauguacagcuagagucacaaguucuaccuugugcuuuuuuuucauuggugguuuagucacagggagcucugggguuacugguuaguucauauugauguuucuccucuggggcugcaaaccccuucagcuccuuggauacuuucucuagcuccuucauuggggaccuuaugcuucguccaauggaugacugugagcauccacuuauaucugccaggcacuggcagagccucccaggagacagcuauaucggcuccugucagcaggcagcagugaacacucuaaaccagugaaccagcuccccagccccagaaugacuucauucuguuacaguucuccugaaggucuuuaaacugacugcaacuaaagguaagaaacaacauauggaacauaauaccaaaaaauauucuuucaaucuaaacuauaacaaugguuuuuuaauauauccauaugugaauauaaaauacauccaauaacuuagcauuucuaaguucugcccuuagcauuucuaggcaugcaugaaauugcugaugaggagaaaucugaaaaagaagaguguaauauguggacugaaguguggcaggaaaauguacuuggcuccuuuggagguauucgauuguaccugcaggaauugauuacuauuuaagcuuuauuuaagcuuuauuugagaauaucauugcaauaauauuaaauauuuuuuaauggaggcggagagugauucuacuuuaaaaaaaaaugaucuuccaccaucugcaaauacagcuuauuuccaguuccuuuuucuuugggaggcuccauuccugacaaauaaacuccauuucagaaagcaggacauaaugagcauaucaacagauuauggggagcccagccccacuggauacaucacaccuccuguaucuauuauagcucagggaaaggaggagcgcuggagugggcacacucauagaaagauuuuuaagaagcaaaaauaccaagaaguuuaacuuaaaacaguaucuuuuagaaaaaggcagauaagcaagaccuaagaguggcaguuaucaguagauccacuaauguggaaaaggaggacaggucccaggaucccaccucuagacaaagaguuauaggaaccaaggagagcaggaaaagggaauaucagccucuucuaaggauccgauacaaaaugaccagccgugaaaauauauacaaacaaaaauggacuccgaaagauguacucauauauuuaugugugugggcucggcacacacgcacucgcacccccauacacacguaauaaugauuuaagauaaggagagcacagggggaguuggaaggaaggugccugggagggcauagagggaggaacgggaagagagaaaggauguauucuauuuuaauuaaguuaaaaauguacaaauuucuuuaaguaucucaacuuagaagcugauuuuauaaauuauaaaauauaucucacacuuccauaauucauauuccaacauuagugacauaauguauuaauccacauuaauaacuuucuaucaacuucgcacagcuccuguugcaagaacuauacuucugucacaccuugcccuaaacccacauccugaccaugccacucaugugauuaugcaguaaguaccacgcaggcugcuggagaccaucugcacuugcucucacuaugcauaucuuccauuccucugcuacggagguuugcuuuuuuuacuuauaccuagcagaaacuaacuccagcaaagacuuaccucugcuuggccaaugauuaacucugcccauguuuuccacuguggacauuuaucccucucuucaaacguugucucauuagagccccaacaacacuguucaugguuguaccacaaugcacugaggcagaugcccuccuucaggucagucauccagucagcagcaaugucuaucaauccagcuagugccccuguaagaauacaauggaaaugguucaaaauauggcuggcuauguagagagaguugaaacuaucuaguuaaggauuaaugaaaagcaaaaaucaucccauagauaaagagucaguuaggaacuguuuucuaaguaauuggaauucuuuguuuggaauuaaaaccaacucacaucauuaaaauuaauuacaacuuaaaacgagaaaagguuauuuuaaaaguacugaaauacacaucacaacucuagcaacugcaaucaggacuuuugguuagcauguuuccaucuagucaguagacuagagcucauuaaaauguaaugcuuguagagagccaugguggcacacaccuuuaauauuagcacuugggaggccgaggaaggcagaauuagaucucaguguguuuaaggccagccuuugucuauguaucauguuccaguauagccagaguuacauauugagauugucucaauacaaaagaauagaguaaaauguucauuauguauaauuaaggaaguucauaucauucacugaauuauucauguaaguuugaaauuuuucuuaauuaacagaaagcuauacauauaaagauuaucuuaaugacaaaauauugaaaauauauaaaguuaugaucaaauuagaucauucuuaucacaagaaaucaauaggucagacagacugagcacaacauucuuaacgcaugccacuuaucaauacuucucucucucuggucuucacaaauaucuuacuuuuuccuguuuucugucuugccugauggaggcggagagugauucuacuaccccuagugggauucacacugucagcugcuaguaguucaacuucucucucuaggacuaggcagucacaguggacagccaaauugauaagacaaagcgcccagucaaucagacucagucgccugaucucauauuuacuuuuuucuaagaaacguaagcacucuaaaaaauucuaauguacccaaaaaggaggaggggguuauccaguuaacuuaaaagcaaagccaagcaagauaaagcaaaaguuucccuuaagccuuccccuuaccugaugccagucccgucaguguaacaacaagccauccugaccaggcgucauacagacuuuuugucauuucccaugcugauucuuuuuuuuuacuguugaucugaaauuacaaauauguuucauuucuuaaacuguauuucuacaaugcuugagucuacuuaauuuucucaagucucauaacacagaaaguaccuuguaaacuaaagaauaacaaagcaaauuugggauaaaaaucacucugcagggcagcuguaccuaauagccagaggccacacaucaagcaaagaucuauuuguuuuuuaaauaagaacaucuggauuugacuguuagggcccacgggccacauggaagucuaaucuacacuguuucaaaccuuaucugcuacacacagauaguuuacacaucacaaguuagauaauauagcuguaaaagucuggcuucaguacuuuaguaacauauaauuauguuuaaaaguugaaauuaaugaacaaaaacugcucaaaaauauaauaccugagucacaccagcagagugauccccccaaguuacagaacugugaauacauagguguagagcucuaauccuacuuguaacagccaaagacuucccugcaagccagaagaaaacuguccucgacugauugacugcaugcagcuaagagauuaacaagaagaaagcggauuugaugcaaaucuccccucauuaacaauagcaguaugcuauuguaauagcaugcuugucuccccaagaaugcacuucuaaacccauuccaaacuagcuucuuuugucuugcucacagcuuagcuuuaagaagcucuauuguccaucuagggccacaaugcucaacuagccuguagaaaaguacagcaagaauucaaugaccugaucuauuuugaguggaucaucuauucaaaagccacaggaccaauuaaaaagacccagugaauaagaaaaucauaucccuuucaaauagaagcauccaaacacagauaucaaccacuuuuuagaaagucuuacaaguggucacuaaguuccacuuuguuuuuccuugauaaaaaauaagcauauuuuuaaaagauaguauuaagucauuuucagacagucucugccauucuucuuauucuucuguuuguacacagcagauguucaauaaacucuuacugguccauuuucaguacaagaacacuguguguaaaauaguguugauucaucaccaagcuacaaaaauauagauaucaccuaaauguuuaacaauauaguaucaguuaaauaagcugcacugcuuucuuaaaacaacaacaacaaaaaccaaaauacccacugguaauaguaccugucacuuuguaaacaaauuaaaaacaaaacaaaacaaaaaaacaaaaacaguauucuuacucaguggaaauuuucugauacuuguauuaugauacuaucuuauaaaaaguaucaauaugagauaaaauaguucucaaagaaaacuccacagacaacagaaggccaugaaacucaggaagcucugcaugagaaaccauguccagcuuagucagauuguauaugccuugaguuaaagucccaggacccacccaaccaauuaaccgaccuagcaaccaaccaaccaauuaaccaaccgcugucuacaucugacaauccacauagaucagcaaacuaguaucuucuacaugauaauuucauguuaagaaaauguauucucaaaguucaagguaaagcaauggauuuuaauuuaacaaagcuggaguuaagacaauucaaaaugcacguaagagcucaucuuuuacaagcugcuacgaugaaaagcagauaugagaauguaucggucuuuuauuaagccaggcaaucaugaagacuacuaaaaaaaaucacucugcaaauacuuuuuaauuuugaaaaauguauuauuuuuauauuaguuacauuuaaaauagugaguuuacaguuacaauuuuuaagugaauuaguuuuuuguuuuugguuuuuuucuagacagguuuucucuguuuugaaaaagugcauuuuagaugauaccagugugcauucacuauacugugggauuuggagucaggauuguucugcuuugagauagggucuuguuauuuagccuauacuggauuccugcaacucagccucuugauugcugaaauuauagacaugcacuacuaugccucaauuuucuuucuggcuucccuuuggggggaaaaaaaaucaaaaacuuaauccaggauacuugagaaauacuucagcauuuauuaccaguaaaaugguaaggaacuacaaaauccuacaaagugauaucuucuuuguuucugguacauuaucguccuuucauauuagacuuggcaacaacguuccuuuugcauuagcuacugagaugcugaaagcaaguaucuuggugaccucauuaagcuuggccagucuuuacccaguuccuaagcugcauuucucccuuucuauccuaaugugucuaacuguguuuuuguugcuguuguuuuuaaacuaccucaaacccuauacagaagaacacagaauacaaaggagcuacagaggaaacaucaagacaaagcagagaaaaauguaucacaugucgaaauauauuuuaauguauaauguuuuaguggccugcaaucaguggcagaaauacaauuguaaacgauccaucuugcacuauuuuuauaaaaugcugaaaguacucacccgucugugccuuucucuguccuuacacuucucucgcacccagucaauaguauggaaaucaucguagguaccgacaccugggauaggcucauccaaaagauccagcaaguguguagagcuauuaaugcugccuccauuugucauuguauaaugaguuccuacaggacaaaaaaagucuauuuuauaagcugacagugaguuuugcaacuucuuuagaaauugguaaguugcaaaugucaucacaaaucacugaaaaguagaagaaacauugacuacccaaaauuagaaauaaggcaaaaauaauacucaugaccucacacaguucuauuagcaaucaaccuaacggucaucugauacucaaucaaccuaacggucaccugauacucuggccaagagaauuuuguaugaauuucuacaaauuuuuuuuuaccacugguaauaaaauuuuuuucuacaaaauuuuuuuaccacugguaauaaaauagacuccaucaaguuagaagacaacuuuugaagacugauaaacugaaaaugauuuucaucuaguaaaauguaaguuguugcuuucuaguaggaaagauaacucucagaauuguaaacuuuuuuguuguucuuuguuguuuuaugucuuaaaauaauuuucuuugcuucacagacuacacacaugucugccucacagguucucugaaucaguuuuaucaucaagcugguuccuucauuaggguuaaauaaaucuuagucaccuauuuacuauauauuuuauaugauuaaacaaacuuaaagaagguccuggaaugcuaaaagacaacuggggaauugaagaaauacaggcagcuuuuaauuaugauaauaaguucaaucuaagacaugaaauaaaaugcaaauuuuuaaguauguaacugcacugagcuguuaguuuuguggagaggccuugacaaaaaguccauauauuaaauacaaacccuuugggaagagaaagcuaucacaucuaauauauacuguaguagucugaacaugaaugcuuuuauaggcucauauaccugcauacuuaguccccaucagaacuauuuggaaagauuaggagguguguccuuguuggaguagguguguccuuauuggaggagaugugucuguggggugggcuuugugauuuccaaaacccauccaagcccagugucugucuccgugcgucugucucuccucccuuuguacucccucuccccugcacugugccuacuaccuauggaacucucagcuacugcuccagugccaugccugucugcuucuucccaugauaauggcccuaacucuaugaaaccguaaacaaauccccaauuaaaugcuucuuuuaaaauaagaggugcccuggugucucuucagaacaacagaacagaaaccaggauauacauacaugaucucaaaccagcaaguuuacuaguuggaauuuuucuuuuaagauucuaucuguacaaucuuagaacaaauuaaaacugagcauagugugggcagaauuuccuaaaacguguuauagaaaacaaaagcaguuaacagcaagagggcaaguauuuuagacaugaaagccaauucugccacuguacuacaaaguaagguacggaaauauauuacuggacagauauggaagcacucuaacaaaaguuuuaaaaccaggugaaaacuugccuuuaaaaaaaacaaaagaaaggagcuugagagauggcucaucaguuaugagcacuaucugcucuuccagagguccugaguucaauucccagcaaccacagggcagcucacaaccaucuauaauguggucuggugcccucuuguggcuugcagguguacaugcaaauaacgcacucauacauaaaauaaauaaaccuaaaucaaaaagaaagaaagaaagaaagaaagaaagaaagaaagaaagaaagaaagagagaaagagagagauaugaagguaagaguugucauguggccacaguuuuccaagccuuaauguacagacuuugugccaaaagcaaauuuaaaauaaauuuaaauuuaaaaugagaccuauuuuuuucccugauuuuuaaggacuaagcaaauuuccuagacgaccuuugcucggcugucuuucuguuuuaaauggacacauucccuuuuauguagagauaaagaaauaauaacaucaaaaaagcuauucuauggcaaggucagaagcagaagucuucacuagaccgagaaacuuuagcacugcuaagauauaagcuaaugaaauacacuguggguuacaaacccuuuccucauaauucaaaugccuagaaacaagguaugaaauguuuauuugaaaugucuaauaugaguguccauuuccuuuuccuuuaaagauauaaucccugcauuguaauguuuacauucauuacauaaaacacauucauacuacauuuaaagcuuuaaacacauuuucaagaagaaaaugucauuuaucaaauuauaaaggcauuuagauaucuuggcaaauguaagaguaucuacuuugcuuucuaucugguaacauugaaacugguauuuggaggaaagugucaagaacccugugucuuuauggaauguugcgugaugcuuuauaguauuuauagcaaaagaaaaaggauccucucacaagaacaaaccaaauacacccaaguaaaggaaguuuugcaaaauaaagaguuguuuuauuccucaaacuguuagcuaggcgugguggcacauacguuuacucucagcacuaggaaggcagaggcaguuggauaugaaguugaggccagccuggauacacagagagaacuugucucaaaaauaaagaaugagcaaugaacuguccugaauuaaaagagacaugacaucuaacuauaaaaugugccuuacugaucuagacuaccgagcuagaucaaguaaaaauguuauaccaaugucaauucugauuuuuaaaaaucauaauauaguuauauacagauauccuuuuuugaggaagacguacuuuuucugaauuuuacucuuauaauuaaaaauauaguauauucauaaugcauuaucuauagaaaaugucacauuuuaccuggaauauuuaauacaaaggcaaagaacaaaagacagaauaaacuaaugugguaaacugcuaauauuuuaggaauucagauaaaauauagaggacucuguauuaauuuucacuucuauaaaucugaaaauuuguuucuucaaugcugaagaccauuaaaacuauauccucagcccugaaauuauuguaaagaauuuacuacagacauaaaaguggcucauucaguaaagugcuugcuauuauauaagcaugaaaauuugaguucagaccuuagaacucauaaaacuccaggugcagccaugaaauauuaggggagcacagauaagaggaccccuagggcuugcuggcuagucaaucuacccaguuagaaagcuccaaguucagugagagacccugccuuccacaaaaaaaaaggggggggggaaggaaaagaaugaggggggggggcuagagagaugguacaaagguacaaaaacacuugcugcucuuccaaaggacccaaguuccauucccagcaaaagaccugcaacucuagaaucacaggauccaaugcugagugacugagaaagacaccaugcuuccacaugcagcugugugcgcagacacacacacacacacacacacacacacacacacacacacacacacacacacacacacacacagagcaaccacaucucacacaggcacaaaucaacuacuaaaggcucuagagauucuaguacuauucuuaccuauguugcucuuaucugaacggagcuaaagagcuacguagucuucugauuucacgacuuuucuauguaaaacucagaacuuguauacccuucaacauaccuguacaauaauacauuacuagaaccaagaaaagcauuucuagacugugucauaaagauauacauauagaauaucuauuucuccuauacaguugugaacugagaagcaggaaaagauugcuauucuuacuuuuaugaacuaggaaaacaggagcacagcaaacacuuauauuuaucauucauguaucuugaauauagugacugugaaguaacuacccuacgaaaacuauuccaacaugucaauucacaaaacugcagcaaauuaagauuuccgaaaaucaaaaauuuccaacaauuuuaauauuucguuaguauagaacgccuguaaaugguuuuauauacuuuguuccaccaaauaacacacaaaaacuaaguuguaacaaagagaaagaaaagacagacgcuucagucuucucuaauuuaucauagagaugcauacauaugcaaguggagugacuuuaaagguauaacuguguaacuguaauaacagccaucaaguaucucaaauacaucucuguauacaguucacagcauguagauauguauaaggauucaguuacauaugcgaaaaugagguaaacugaagucaauuacauguggauuaaaguuuuuaguaagcaacaaauuaauaaacaucacccuucaaugccuuaaaguacacaaguuuuaauuauuacccaaacacaaguugaaguucucggacauguaggguauucucuuguacgagcugguuaguauauaaauuauaauacaguuuuucuaaaauugauauauaaaaauaagcuuuggaaaacgaaggucuucaaggauaaaauagaggcagucaggccacugcuuccuugauuaguaugccuuucuuugccuucagcaucucuuacaauugguuuaauaaccuaaacugacaggaugucauuucuaaugcaaaugcugcccucauuugcuuaucuguagagacauuaaugacaaguaggcgaguaccuuuuggaacuaagaaugaaguuccaugaccuuauuauuuuuauccugcccacaaacucccacugaccaucaaauauaugcauuaccagguaaaagaguagaacauaaaauuucaguauuacuggagcuggagagauggcucagcagugaaaagcacucgcuauucuugcagagaacccaggcucauuuccaagcagcaacaugagagcucacagccaucuauaacuccagguuuacgauggucucugcuggccuccacaggcauugcacacauguggugcacaaccauacaugcauacaaacacauauauaaaauaaggauaaguuaauuaagaauucugaaacccauacaaaaaagaaaaucauaaaagcaaauacuuuugaucacaagagaugauauucuagauuucaaaacucugugaggaaaggggcuuagaauuucuggaagccauaugaaacaccauuuugccauauuccuugagauaugcuguacaaagacuagaagagaaccaaguaaagaagaaaguuauagacuaaagauaggcuucaacuguucccauuuccuggaugugaaauacauagagcagacuuacucauaagcuggccauauuuguuuagauguugagcuauucauucauacuuuaugaaaguucugucauuaaauguacacauaucacuuugaugaauauauuuucuaggauacacuauaacuuaaaaauuuagaucacuagaccauugcaaacauuaucugaauuauauauuuuucuuagucaucuuuuauaauuaauuucaacuuuuucuugucccauuuuucaaagcccacuacuaaauauucauuacuaauaaucagguauaucuccaaacuuaaaaugauaaaauaauaaaacuguauccucaucaaagggguauuaguuaugcaagagguccauauugauucugcccauuuggugucccuuugcuucuagcaacaugucucagcgcuuaagagcacuggcugcucuucuggagguccugaguucaaaucccagccaucacaagguggcucauaacaucuguaaugagaucugaugcccucuucuggugugucugaagacagcuacaguguacucacauaauauaaauaaaucuuuaaaaaacaaaaaacuucugcccuauguaguaggaaaccuugaugagaucuauaagauacaugccucugccaagaaaaagaugaguaugaggcuggaaccaagcaccaggcacuggauuugaacucucuaugagggagagaagggagggagagaaaagagggagaaagggggagggggaugagagggaagaagggggggucuauaaaaaauagcugcuggcuauauaaaauucaaacauacaaauacaagaagugaaaccaauccauuuuaacaaccaucaaaaggauguaagcuggcucccacuacuuggaucccaagaauagcuggacaaauaucuuucuucagaggagccuagaaaagaacuuucaugaccuuaaugcacuuugguguuagaagguuugaaagucaaauuccagaucugcuaccuauuagcuuugugauccagcacauauuacuuauuaaccuuuuagcccauagguccauuuugucagcuacucuuagcuuagaagcaaguguauagacuagaagcaaguaaguaaugagaaagcuuaauacugacagguaagaggaaauaaaauacccacaaacuuuaaccuauuuaaauauuuugugucuaagacaucaucaaauuaaaucauauuaugacauucaucaaugaucaaaucauuuaguauuaaucuuaaccccaaacauggacaacaugcaaaagagaaugggagaaaaagcuauguucuucauuuagacaagaaguucuucaacuuuagagaugguggaggggguucucaaauuuuuaacuaaucauaauuauacuaauauguauacaaagguaaaucacuuagaaaugaucaauaauguaauuagugacaauuucacaguucaaauaucaaaaauacggaaagaucugacuuagaaaaacuacucagcuaaugaacuauguacacagacuggcuugcauguacacagacuuggccuccuacuuacuauacaaagaagacuuuuuagcuucauuuuguucuuuuauagccacagaacuuuauaacgcucagacaacuauggaaauaaaaugcauuuaucuguagaaaaauuaagguacauaaauauauuaaaaauauauuucuaauagagaaaaauaaucuuuucuuuuuuuaaaaaaauuuauuuuauguaaaugagugcucuaucuguauguacagcugcauggcagaagagagcaucauauccuaagauagauggcuaagagccaucacgugguuucugcgaacugaacucaggaccucuggaagcgcagacagugcucuaaaccacugagccauuucuccagccccaagaauaaugcuuugaacaaaugaugcugaggaacgcuaucuaugcaaaaggaugaaacuagaugcccaacucacacauacaugaacaaaaacucaaauguuuugauccaaaauuagaauuagcuaaaacugcaaaacccuaagaagaaaacguaagaguuuugugaccuugaauuagucaaguagauuuaucaacaaaggauacaugauaaaugagaaaaguauaucaagugggccacaucagaauuaaaguagcuuuuccaugcaaaggcuagaucuauuaacuagcucacaucugaaaacauuaaaaacuacuaacacuuguggaauaucuauugugcaauagacaugauucuuaguacagcucacucaauacaucauuauaaggcaagacuuauuaucuauuuuauaaauuugaaaaacaaagaaagaauacaaugaaauaauaucaagaccauaauguaaguaaguaguggaauaaacacccaaaccuaugcauuuauuccaaaguuacugccacuguauuaauaauagggucaaaaaacauaauuucaugauuggaagauauauauuuaggucaagucucaagaguagguucagaauaauuagucaaaaaccucaaaaacaaaagaggagaaaauguuguauucccacccuugggcaguguuuugcucacagauuauacacuguaaaacugcuaugcuaacaguacagccccucuuucacccucaggguguucaagacucauuacaccauggagagccuaccuuugcucaucaaacugaaccaugccucuagguggacacuuagaaacuaguuuuuaagcccuuagacuguagccuacagcaucccuaacugauacagcuuacagauauguaccuaaauaaaaucaaaguuuaguaaaugaaacuguuuaguaaguagugauuuuuucaauuuucauuuucuucaucuuuugaaaaauacugguaaauuucuuucugaccaacauuuuaaaccuaaaagguugacacaaaacuagagaaaaauaaauaucaagauuaucuacuuuuccauaaauuaaaaaucuuuauguaccuccuacuaagcuucaauguauaguugaugaucuguacuaaaugaaaacaggauucaguaauaaaucccauaguuauacaaacagcaaacuaaugguuuucucacagacaaacacucaaacaccuauuuucaaauagaacaggcauaccacugcuuaaugagauugucauuuauuaccuccaggccaaguuccaaagacacaagggugaacuugccauuuccaguguuacugcuaucacagcagauaaacuuaagcacacacugaacacuagggaagaaggagccagaaacccauguguaacagucuccugacacaguuaugucugucucgagagcaacagaugcagccacguauguguucuccucuaggagcuuaguaguaaggaucgucauccuaguaaggggaggaagggugaauguagguugauaacagaagucccagagucuggguaaauuaaaaaggguugcgaugugacucaucugguagcuaaucaccuaguauguacaaaaucuaaucccagcacuugggagguagaagcaggaagaucagacaaucaagaucaucuucaacuacauuucaagguugcagccuggaccacguaaaacugcuugaaaacacaaaacgggguaggaguggggguugucaaauauauaaaguucuauaugagugcucuaucuguauguacagcugcaguuaguaagugaucaguugauaguggcuagaucaaugacaguauaaaugaaauauaacaguauguacucugaaaaauuguucagucauccagucauauuuaacuacuuaaaccacaaagaccuagaagcuaauacaaaaaucccaaagaaggcaugcaauuaaccaguacccacugcugagcccacugccuacuucaaugugcuguuuaguuuuauguucuguugucaccucaauauaaauagcagccuuagacaagguagcuacaagcuccuaugcauacugaacgcagguucaaacuucacuucucaucucugcauaugcaaugaugcagauacagcaucaaaacaauuuacaaaaaaagaaguuaaaguaaauuuuguuuuggucugaguuauaaaggaagaaaugcacacucaugcacuuggacacauacaaaggacaaaaacacccuacauauuaagcacaguaauuaaaaauaaaaaacaaaauuguaaaguacaauuuaggucacuaguguccuauguaagcacaaaacuugcugcaagaaaaaaaaucaacauugcaaauuuaguaaaugugguaagaggugugcucaucuccugagauuugaauauacaaagcauuucugauguaggauaagucaugagaugauuuaaaauaaaucauaguaaagugucuguuuaaaauguuuaggauuuuuauuaaaaauguaaauauaaugggaaguauaaauuugaccacagaucuguuuuauaacaaaugaagacaaauaauacuauaaaacaagcauuaguaauaucaaauaauuuuuuauuauuuuaaucagaagccuauaggauauccuuuugacaacaagaaugcauuuaacaucuggauuuguacaaguggaaagcuacuacaauuucaggaggaaagaaaaauguguuuacauuauaggguagggaaaagauuuaaaucaucgccuucacugcugccucuacuccucacaaugaaacuugcugacagauaugaugcagcagagcucaucauucucuggccagcucucuacucccugacacugcacuuaguccauuuucuccaccacagacaccuggcaaauuccccuguucacagaaaaauggccuacuuaguaccaccugccaaaacacuugucucucucuuccucuccuaaagggccauggaacgcucagucuaacagcagcuucaggagacuagcauccuccaugguuuguuuucaacaucagaagccuuaagcccccagcagacugaaggaccagucguuugaggcuuguacgcaaugagaaaaugaucaaaugaugagaagggucaaauuaugugaaucaauucuauucaauuuuagcuauuaguauuacuccuguagcugucaucgcucuccacaguaccuaguuaggauuucuauaaacacagaguuccauaaguacuucaaauuaaaaaaaaaaaaaaaaacaaaccagguagucaaauaauguuuaaaggcuuuuuacauggaguaaauggaauauuaaaccuguuccuucuagguccaucaaaaaaaaaaaaaaaaaaaaaaaaaaaaaaagccagucuagggccuggggccuggugagaagguucaguagauuacaaacuuucuaccaagccugaugaccagaguugaacuccugggacccacaugacugaaggacaggaacugauuucuacaagugccacuguguaguugucaugugacacccaaguaacacacaaugaauaaaauaaauauaagaaaaacauuucuuuaaaaucaaaaccaugcaaagggauuaguagacgaaagaacucaaucccaaacuacuucaacuucacaaagaaagccaacauagugaaugaaaccagcaguacaaagaauuacccccaaagaaggcuauuucuaaaauaugauuuuaacuucuaauaaguaauauauaaaugacuucaacuuucagucuacuugcucuuucagaugcuauauuaugcacuaaaguaaaaagcuuaauuauuuagcauuccaccuugaaaaguggugauuaagccuaauuacccacagagcuaaucccuaccuccagcuuuacuuaccaacagccuuuacaauuuuauacuuugaauuucaccuuuuuucccuuuaccagccugaagaucuauuucuaauuacugcauuuugucuucacaggaaagcugaugcacuuugcuugauuuaagcuauuuuccuauauucauaucaccaguuccuuugugcugaccuaugguuucacagggucauaaauuauggaaagcaaaugcuuucucacacauagacacuaggacacuacccuauguucuuaaugauaugggacagucaaguaaggcaaauacauaacugagcaaacgcagugcuuccuaaaaccaccacuuguauuaacagagaaggucucaucagaaucaggaccacgucugagcuucugacaguggucaggccuucaagaugauuccagggaacuauuuaagaaaaugucccagaaauauuuuuuucaauuucucucuugguaaucuguacgugucauuugacauaaguuaugacauuucuuauuucuuguacauuuuuacacaggcagucuauaaauuugcacugccaagacuaucagauagugcugcccaacccuucuaguuaaucaguacuaacaaacggaugcuguuuucacucagagaaaguauggucugccugccuuugccauuucccauauuaguaaauaaugugacauuugaauaaucacuguucaauacgaauauuaccaggaaacggaugacagaaacacagggaaacucuaucaggaaaaggaaaaaaauaccagggaguaaaaauuuaggagaauuuauuccuuauacuuuuagauacacacacacacacacacacacguaugucagaacaucauuaggagaaauuauuuuuuguacuuuuuauacuuuuauaauguuagaagaaauguucuaaaaguacaaagaauaauuucuuuuauuuauuuuuuuacuaaauccuaauuuauacaugcacacauauacaauucauaaaggaaagcacaauauaugggacaugaucuuaguuuuuccucaaaauauaaaaagaaaccuuuuacuaagcacagaauucuacagaguaaaguugcaacuguuuagaauccaauuauuguuuugcaguuugcaacguaaucaguaucuguugaaugcauuauaauuccuaaauuccauacaacuuaaaauuauugucaggauacaaaauguauuuuaaaucuuccucauuuaguugggauuaaaccauaaacuuuauaacaucagcaaauaauaugacucauauaugaagucaucuagcuaaagaauguuucuugaaguuaauuucuagaacaacaaaugccaaccauuuuuuaaaaaauaaucaauuuaagaaaaugaacaaaagaucaguuuaauuaacaaacaccuaguuaguuuuaagacagagccugccgaaagauuuacaccauuacacuggcugcucaucuguucucuaacuaccgacuuccauucugcaaaauguauaaaaacgaaaccuacauuguuuuauccuaucaaguuguacaagaugccuaugggggacaauauaguaugucaauuagcuaagacauuacauuaaaaaaauguuaagccaaaagaauuguucuuuacuuuguaaauguuauaaaaugcagcuaagagcuuucacuauuacucuaugauacaaagucuacaugguaauuggcagcagucaaaacagaaugguauaugggcacuugauuucacuguguaaacuaaagaaaauauaaguuuccacagcaauaaaaacaccacuuugcaggugccaaccaacagaccacaggacuucagcuagcuggaaaagcagcuuauuuuuggaguuaaacagaaagcuguucacacagaagauggagucagagcccaaugugaucugaggcacugcuaaucgccacagagcaaacaaucagggagggccccagccugcugggaagguugcauucucccauaccaacaaggcagggcaaguaagcagcucacugcagcacggaggacaacagccagccuguucccagaaccgcccagccgcaugcacaacauaccaacagagaauucagagcaaggggauggcguuaccucuuuuauguaauucucucaagggaauacugucuccucccccgucauaaggcaaauagggaucagaagaagcauccaugaccagaauuuaaaaaaauaauaauuauaagaucgagaagcuugcuagauuaaaaagacuggcauuuucccuuccccugcuauagcaagcaaggaagaugccauauuugaugagguuagaacugcauaguucgacuggcugaagcaacuggguucuuccacaguggaugaugucaucaaagggaaauuauugcagccugguugcuaguggcuacaaucuagcccggcuuagaggcaggcagcgcagccuucuuaaucagguccugcuguguacgccgaugacuaagcgccaaguauaacagacgaaacugguuugagaaauuuaaagugcucacaacguaguuuuaauaguaagacaguagaaauauuuauuuuuaauuuaugaaaauauaagaaagaaaaagguaguucuagauccagagaaugaugcuuuucaugucuaauguagaaacgucagcacuaaaacggauguuuuauaaauguacuaauuuaugcaguaaauucguaugagucauaacagugaaaaacuaaaacauaccaacaaguucucgauaguauuagcuuuaagacuguccuuaacugucuuuuaauccucaaccuauuauggagaauuaaaaaccugagucacuggguugaugguauuuuaucucauuugcuaauccuccccccccccaccccccagcagcaucuuuuucuuuccuucaaacaacagcugggagacauucuaauuaggagaaaggugaauuaugcaaaaagauuuauuuuguaggagacuuucuauuuugcuguuuuccaucuuauagaagacugugcuaagaaagacuuugaguaaaaaaauauguaucaaaguuagcuacucccaucuuugcuuaaaaaaaaaaaaaaauuaaguuuaaaaauguaacuuuuuguuuuuaaaacagcuauuccaaacauaacuacugcagcacagugguggugcaggccuuuaaucccagcacuugggaggcagaggcaggcagauuucugaguucaagaccagccuggucuacagagugaguuacaggacagccagggcuacauagagaaacccugucucaaaaacacaaaaacaaaacaaaacaaaaaaaccaaacauaucuaguguucauaugugauaggaguacaaguuucacagauucuucugaguccucugacuggaacacucuucuaaaaugacuguuauacaguacacuaaacaggugauguccaccacagaaaauacuauggaacuugggcaaagaucuauaaaccguguuuuugucaaucuugaaugagacaaccucuaagguccgcucccacucugugugcaucugaaaacugaagguaaagggaauaaagggagaaagucuacucaauucgccuggucuauuuucaauuaucuguagucuucucucccaagaucauaaauuaaauagguuucuagauuucaaaagucuucaaacucaaauaaacagagcuuguuacaaaaguccauguggaaucuggaagugaggacuaggaaaagaauacaaaccagaauugaaauuaaaauaauaaagguuuuucaaguucucuuggaaaacuguauuuuaagcaagaaaagcuuugacaaagucauuuuuuuuuuguuuuuguuuuuguuuuucgagacagaguuucccuguauagcucuggcuguccuggaacucacucuguagaccaggcuggccucgaauucagaaauccgccugccucugccucccgagugccgguauuaaaggugugcgccaccacgccaggcuugacaaagucaauuuuaccaacaaauauagacuguauaacacuuauaagccauuucauuugaaugagacuauacucuuacauaccguaacaugagaagccucccuacaaacaccccguaucugggcacacucuccgaccuugcucauuaggaaugagaagcacaggagcagggggcauaucauaccugugaaaugcuaacaaugccaaguaaauuuuguagcaauagugauucaccuuucaagguaaaaaauaugugcauauaauauauauuauugugcugguauucagagagguaaguuuaguaugaaacaucaaguugaacagcugguaucacugagcaacgaggcagaagaguaaagugagcgcuuccucaguacuuacacaguacacaccagaugaggugaagggaaagguggacauugugugcuuuacaucuuagaccucucaguguuuguuuagugauaacacaauaagcugaaauacaaaacaguucuguaacagucauaccucagaaagucuuagaaccuugccugggcagauauguuagaaaaggacaagguacacuggagagagaagcaggacugugaccggguaauuaccacgcguuacacuuaggggugugguggaagggaagggaagaaaagauaaagccuaaccuguaagcaaggcaugcaugaaagucucaugggagaaccucugaggaaccaaaacccugaaaggcuagacagcacacacaggcccuggaagccucgcccuagccgaccacaauccuccauuccaaccucauacgcaagucagaauaugcagacucucuuuauaucgugauaucaugaugggccagcauccugguccuauauaacacuaaugauccaagaaagcuaccaucuuuaaaaggcauauuuagagacaaucaaaaguuugccuuuaggccugaccaacaaguuacaaaaaugacagaaagagagaaaaauguuaaacaacucaggaauuaaaucaggaaacccaaacugagcaacaaaugccauaaaacccaagaaaucugcugugagauuuugucuucuauagacagaaacuacacacauaaaaccucaacaauguagcugccuaaacaaggccugaccaauggcagcaccaguugccaugacaaugcagauggggaaaaccucacaggaccuuccucaccccuagauaaagagccauggcauaaccacaguacccuuuucuuuuauugguuauuuuauuuacauuucaaguguuauccccuucccaguuuccccuccacaagcccccacuccccuugccugccucuaugagagugcuucccccacccacccacccacccaccuacccacucccaccucacugcccuggcauuccccuaugaugggggggggcacugaaccuccacaagaccaagggccuccucucccacugaugccagacaaggccauccuaugcuacauaugcagcuggagccaugggccccucuguguguacuaagugcucccaaggacuaaaucaccaaccacaguacccuuuucuauacuuuugaaguuucuacaagaaaaaaacucuauuuuuaauuuuauaaauuaaagccacuugugugaaacaaacauugauaagaaguauccuucacuccuuaaacuaaaccaaucgcuucuagaaaccucagguuaacaacagccuauaauccauucacaucagacacucaacuuucauuuacaguuagugcucuucccuaagagaaagucaacgagggaaggacacacacagcaaagcuuccagagagcuacauuaaagcuacaccaauggcugccaaguuacaccaccacuaaacagacacugagaggucucagauguaaagcacacaguaaacugaauuacaaaacaguucugcaacagucauaccucagaaagucuuacagcuuaauauggcuuccugguuagccaaauaacauaccacaggauuaaaauaccaaacagacaauagcucaauuuaaguucccucuucucagguuugucaaggugaccuaaccauaacaguccucaacuauggauacuuaauuaaauguaaauggauuaaauucuucaauugaaagauaaucucuagcagcagaauuacaauguaggucugcaaccaguacuccagaugacacaggaagaugcugaauuaaagaccacacugaaguacagcuaccacccacuuaccagaaacaagacuauuagaaagaaaacaugaugucaacagacuaacacacauacaaagauucucucuaucucucucaugucaaguauugaauacuuuaaaaaaaaaccucauuuuuccuacgugacaacgcaaguuaaacacacugaaauuacaugccuauacugauuauaaugcaauaguaguauaggauuaauuagaaauacaaucagaaguucuccuauauguuuaaaaauuaugaauuacacuucuaaguaacccacagguuaagguaaauaccacugcagaaguuaaaaugacaaugaugauaauuaaugauaacauuaaaaauauaauaguaucuauagccuuaaauguagucaauugaaagaggaaguuaaaaggguaaccauuaauuaccauuuuaaaaauaauuacagaaaaauaauuacagaaaauagaagauaaaaccaagucaacaaagcaggaaaauacauaugagaaaaacaaaaagacagacuugucagaaagaauaauuauuaaaucuaugaugacacaaauuaguauaggaaggagggaaaaaguaguaagaagguugaggagaaagaaaagacaggaaaagaacaaaacuaagaaaagaugauagcacaaauauccauuaugagggggaaaauaagccaauaggacagaaaagagucuggaaagacuuccuucuauuuaugggcccucaucuacaaggaagcacaacauaagaguggguauuuuaaaacugguuuuaaaacacugucauuaauacuaaggcaacuauuuccauguuaaaauaaauaaaugcacacauacauauacccuaaauacacauguacaccaucauuuaggucuaaacggcaaacaaaguucuuuuuaaaauaauacaggaggacuaucuuuaugacuugaaaguacaaacauuuuucucaaaauacaagaguaugaacuauauagggggaaaaaaucacauagaacaaaauuauaauuaagaacaucuguuccugggcuggagagauggcucagagguuaaaagcacugacugcucuucugaagguccugaguucaaaucccagcaauaacaugguggcucacaaccauccauaaugagaucugacgcccucuucuggagucucugaagacagcuacaguguacuuacauauaauaaauaaauacaucuuaaaaaaaaaaucuguuccuaaaaugcccacuugaacaaugaaaugcaacccauggaguagaaaaaaaacuauggcacauuuuacccauuuaagaguuuauaggggcucgagaaauggcucagagguuaaaagcacugacugcucuuccagagguccucaguucaaaucccagcaaccacaugguggcucacaaccauccauaaugagaucugaugcccucuucuggugugucugaagacagcuacaguguacuuauauauaauaaauaaacacaucuuuaaaaaaaaagaguuuagagauaaaaaucucuaagauaggacaguagaguuaaaaaaaaaaaaggugugugugugugugugugugugugugugugugugguggggggcaaauaaccuguuauguacuucaaaggaaucccaaauagcuaccauauauaaaaaagaucuuuaaucucuuuggccaccaagaaaauuuaaauuacaauuacaacuuauaauaaacuacaugucuggcaaugucaagagguuuggugaaaguucaucaauggaaacucugauacaucccugaagccaguaaccuugaaccacaccuauggcaaaaagcuacuuauaauccaggaaguaggacaaauggaacuggugcacaaaugaaggcuuaacucugaaaguaacacuguucuuaaccaccaaaaccauaaagaucuagcaaaaauaaaauaagagaauuauagucaaguuagaaaaaggaugagggcuggugagauggcucaguggguaagagcacccgacugcucuuccgaaggucuggaguucaaaucccagcaaccauaugguggcucacaaccaucuguaacaagaucugacauccucuucuggagugucugaagacagcuacaguguacuuacauauaauaaauaaauaaaucuuuaaaaaaaaaaagaaagaaaaagaaagacacacuccaagggugauccuccccccccccaaaaaaaaaaaagaaaaagaaaaaggaugauuucauuacguggaguaaaaucaucaauagcuacuaccaacccacauggaugguuugggaaaccauaccauaggaaagagagaaaggcauauggagcaaauuauuccauuuuuaccuuucaaaaacaggcaauauuaaguccugcucuuaaggauguguguguguguguguguguguguguguguguguguguguguguguauauauauauuccagugaucaaaucacaaagugaagccagaaaagugacuagugaaaaacgcuacgccugggacaggaacagguaaugggacagcgugugcaugagguuuucuggaauaggcuaggcuuuguuucuuuaggggugggcuacaagauguuuguuguguaaugacaaagaaaguuguuuaauuauguuuuaugucacaauucaagugucagaguuaggaauuaaauaccucuaauucuauuaacaucuaaagcacauuuuaauacaguacuaacuaaaauuccuuuaguguaacaguauuuaccauuucaaauaagugguucuacucacuggggaaaaauuaguuuguuuugcucacuccuucaccccaacugagagaguagagagaaacacagacacacacacaccacacacacaggacucagugacuuagguuucucuagacuguuuuugcaagagcuaaggcaacauuugcagaugggauuuuagguacaaauagccagguccuggaguauaauaaaaagcaagcucccuucuuuccagugauaccaacucagaguuuuuaggauuucauugauacuucgaccucauuuuacccagguaggcaccaccaacaaaucaauaucaugaucuauuacaauaucauuuucuaguacacuuaagacauuccaaaucacaacacugcauaaauuuaagguguuuaauuuuuccuauaugcacugccuuauuuuuacauuaaggcaugaauuugggcgguccucuauuucuaauaaguagggugcucugcauaaauagccugggauacaggugcagaaaauguuuacaagggaacuggcaacagagugaaggcuaucaaaugcaugaagaacaugaccuugcuuagaauaaguaccagaugaacucuggaaucauuuauucuaaaaauaauucugaguagaccauuugaaagcaccuggacuuuucuccagcaggcagucauuaaauauagucacuagagucguuuuagggcaaaaacucaggccuagaaaucccaaagaaauaggauggaccauugugcuggcuaauuuuaagucuaguuggcaccugggaaaaaaggucucugaaagaaagacugggcuguaggcaggcguguaguagggcauuuucuuaauuaguguaggagggcucaacccauuguggguggugccaucccugguucucaaagaaagcaaggugagagcaaacaagcuagaaggcagcacuccuccacagccucugcagcagccccugccuccaggcuccugcccugccugaauuccuguccucccugcuuuugaugaugaacuguuauauaaacugugagugaaauaaaugcuuucgucccaaguggcuuuugauugucauguuucaucacaauaauagugacccuaaguaagacaccaccuauuacaacaggcugauuaaagacggacuaguggugcaaaacagggaaaggggacuuggccaugauaaaugcugaagggaccccacacuucuggcagccaugagcaucuacacucacacucacauagcaacaaaggcauauaaugaaacguaaagauaaaauuauuaaaaacgucuaaaccagccuuuaccaaggauuuccaacguaagacuugugacuuuauguugcaauuugacuuuagaauguuucguggucccaaacaucucccucaguagagcaguaccaccaaguacugggaaacgacaaguaaagcaaugcagcugaaagcuuagccuucaaacugccaaguaaaaugauucuagcucaaauuuguaucuuagauuccugagcaacaccaccacaucuccucccuuccccuccaccccacccccaucuacaauaaaaacuuuaacccuuaaccauaucacggggguagucaggucagcagcuuucuuuacuacacacccuuacaugcaucugguccauuuggggaaguggaguuuccucuggaucuaacaucaaccuaggauuuuuuucuagucuuuuuuuuuuuuuucacucacaguuuuauaagacuuuguuucagaauugagaaauccugcguacuucuugcuuucgaaacuguuaauauuuuacauuuccaugguauauuugucaaaauuaaaaacuaacauugguccaacuccagacuucagauuuucuguuuguguucucuuuauauuauagauaccaguugagaauaccauacuuuauuugguuauugucuuuugcuuuuaaucuuuuagauuuaacuuguuuccaugaccuuuacugguuagguaucccucagaaugucuccuauucuuuauuauuuuucuugaaaauagauuuauuugaguuacagaucuucagaaagaacacaaggacgacaucuucagggguauauaucaaucucaaauuauuugugacauuaauguucaucauuugaauaacaauauuugccaaguuuccccacuaaagcauuucuacuucuaccuaccccugacucuauucuucaaacaugaaucauuaagucaagcccaccuucaaggaagaaagauguuggaauuaagcugcuucuccaugaaguugcaaaagcuacaucaauuauuuggaauucuuccacaagcgagacaugccuuucucuccacuccccauuuauaucaguuuguaucauuuauagcacagaugugggcccauuucccacauggaacaauaauccacaugcuuuccuuuguggcuccucugaucguagcuuggcccaguagggacucuuucagguuccucugacauguucccagugguuuuuaaaagcauuuuuuuguuucugacacaguaagauacucuaugucauuuuauauuuuucuacagcaauccaaaucauuauugaaucucaaaaggaaucauaaaauacuuuuaugagucccaggauguaauccauuugauggcucagaaguuuaaacuuuggauacccaugacaaaauugccacaaaaaaaauuucagauacaauaaaacauuuccacaauuucuucuaccauguucucccccaacuucccccaaaccuaaucugaaccaggugcaguggcacauguccuuaacuccaacacucuaggagccucauuucucagauaaagaaaucaggaagcggaagugauaaugacagacaguaugagaaaccucauaauccagcccugcucugcuucccacggaaggcucaggucugucacuuuuucuccugaaugccacuaccauuuugguauaaguaacauacuacuucaaacccuucugaagagucuguccauuuuuuuaaguaucuaaguaagccaaaucuuuuuucaaucaauucauauugcacuaaugagcuccucuuacauguaccccaauaucagaugguguaaggaaacgaccaaaucaucagcauaaaugguuguccaugauauaucucucccacaaaguuuggagauaugaggaggaucaggagcugaaggccagccucagcuacauagaagagacaagagacccuguuacaaacacaaagcaaauaaauaaauaaauaaauaaauaaauaaauaaauaaauguuaauuaaaauguauccgcucuaagagaauuaugugcagaagaacauaaacuacuuacaaacgagagggaccaacuaggguuguuacagagaaaaaagcugcacagagagagagagagagagagacagagagagagagagagagagcgagcgagcaguggacagcacaaauaaggugaggaaagcagcugcuguggcagcagccaccaguaagaugaggcugucuagaagaucccaggagcuaacuuaagaagcaaacacacaaguucaaggucaguuuuauaauuccuuagcuaaauuguuacuauuuuuaaaaacacugaaaagcauaaagaaaaaaacaaacuccaagaccaaaauaaaagccuuuuucauguaauuuucucuaaccuugugcauauaaacaagagaguugggguauuauccagaguuuacacauaaaagccuugccuguaguuuuuaacaguuaggaagucacuuuauuuagcaacccaguuuguucugggcuguuagcuuaucuugaaacaaauucaguugucagguggggguccuuagacccagacccaggagauccaguaagaucucuuacaaaacaucugugaaauuaaaaccauuaauacugacacacaucagaauucuauggcuacuauaagaaacacucgagauacauuuacuagcuucaacauaaacuuagucacucacaguucuagagagcaaaagucgaagaucaaggugucagcuggaacgcauucuuucuguaacuuuaagaacaaaauuggcguccuugcuuuuuccagcuucaaaacgccuccuuuguccccgaguuguccucuucuuuaucacucuagccucucagcuuccucucuaccaacaacacugagccaccugccuuccucuuuuaaaguccucuaugauuacauuggcaccgcccagcuauuccaggcuaaccuccacaucugaagaucucccguccaaucaacaaagucccuuucaucacuugcuguaagaguuuuacagguaccaggaacuagguauggguggugugggaggggccauuagucagucaaauagaacacuuuucuuuguauugaccuuugcauaguuaauacaagaguacuaagaagcugucaucuagcgcaaaucaaagcugucacaccaacacguucuagacacucuuguguuucucacaauugugcccuuguaaaaacaccaagccgguuuucuuacagauaaaugccuuugacacaccagcaaauaauacucuuuauugaaucacaacucuuggcuacaugcucuauuuaauauucuguguguagaaacagaaaacuagaacccuuuguucacccuuccugcuccugcaguggcccaucugggaaagguaacugagcuaauguuugaguuggaacaaaucccacuuucugaaagaacaccaauuauacuuguuuagaacucagauucucgaaggcauaaucaaguaaaccugacucuucaagcaaaacaaauggugguauauguuggcaauaacagaguuacuuuuagguacaaaaauaaaaaugaagaaagacugaauccaugauccagagaacuucaagacuuccucuguacgucuguguguucuugacaugugcacaugaagauguacggacaucaacuguucgggacgggacuacauugugggcuccccaaaucuguaucuuaaagucuuuaccucuuaucuuagaaagugacuauuuggucauaagguccaaauuacccuuuaaaagaguaauucgggcuaaacaaagucauuacuuugaguucuaaugaagugugccuggucucuuaugacauaaauacacugagagaaaaauaacucaaagacacagugagaaaaucguuaccuacaagccaagacucacaagaacucaaccuggagccccagaaaaaugagaagauaaauuuguaguuuaagguacugagucuguaguauuuugucauagcuacacuaguaaaacaauuuaccaaugaauacacuguccagauuacucaugugugauucugugauacgcaugugaguaaaagauccauuaaaaguacaagacagacaaauggauuaaauuuuacagagcauaaaguagucauuaugguucuaacacgguaaaaaagaaauuaauacuuguuaaguucuaguauaauaucaaaggagaauauccacaguggcuuauaagaagcuauuaaauuauauucuuuucuaacuauguacuuucugagauggauuuucuaacaugucauaauaaaauagacacauuuuaggguuguagagguggcucagcgguuaagaucgcuggcugcuuggucuuccagagguacugaguucaauucccagcaacuacaugguaguaucccauuacagaugguagcucacaaccaucuguaauaggaucugaugcccucuugaagacagugacaguguacucauauaagugaaauaaaucuuuaaauaaacacauuuuagaaccugcccucuacauuagagaaaauauuagagauauuuuauaaauguaaaucaaugccagucuucucauuaaguuuauuuuaaaaauacauuuuuucauuaaugucaaaauauauuuuguaguuauaauuuuaaaugaauuaaaguuuuaaacucaucuuuaaaucauaaugcuaaauauuuguaacuuaaaguguuuuaaaagaugcuacuagggcuggugagauggcucagugguacccgacugcucuuccaaagguccggaauucaaaucccagcaaccacaugauggcucacaaccaucuguaacgagaucugacuccaucuucuggagugucugaagacagcuacaguguauuuacauauaauaaauaaauauaucuuaaaaaaaaaagaugcuacuaauuagguguggugagacaugcuuaucagaacucaucuugaagcaguguuuaaaggcuggggcuacacaguggcauucugucucucaaacacaggguuugcaaggcuguaucacuggcagagcuugccuagcaaguaccaggacacaacuccuaaucauguccuuaauaguauacuguuuuaggaauuaauccgugacuaauucuuacuaagaaaggggucuggggaagaccauaagguccuaccuagaagacauacuaagaagagauauaccucaaugauaaguauuuugugaaucacugguugaauuauuuauuucacuuuuuaagacuuucauggucacuauuuuguuuaaaacugugccugguggcgguggcacacaccuuuaaugccagcacaaguaaaucucugaguuugaggccagcugggucaacagagugaguugcaguauagucagggcuacacagagaaacccuguuccaaacaacaauaaaaucuaaucauaguuuaaauuauuauagcuuugucaauguuuacccaaaacuuuagggaccagaauauuuaaaauuugggcuuuuuuguuguuuguuguuuaaggauuugaggggauauuuugggguaagaucugaauuuaaacacaagacucauuuauguuuuauacauaucgcauacacaaggccuaaaaguaauguuagagaacauuaaaguaauuucauggccaagaacugucucuaugacagcgcagaggagcucaaagagcuucagauuuuggauucucagaaugggagggucaacuugggccacacagucacgauguccuugcaaaauuaggguuugaacacaacaggaaguaucagagaauguuauaccaaaagccauauacaaauguugauauuuaugccaaacauuuuacugaaaaccaccgucugggacucagacccaggucaccaugcuugcauagcaagaacuuuauuaucugagccauccugccagccacaaagaacaaacaaacaaagaaaaaccacaaaaaugaccuguuguuauaaacaucgagaccgauguauaguuccccuuagaaaguauuggggcaucaacacucuacuucaucauagacagaagaggggccuacaaugugccacuccccucugaggaauuaaugacaauaaaagauugcugggugaaggugucauuuuucucuuauggaguagccacugagaaguugucugugauccagugaucuccuuccacucacguucauggaaggaagccugacugaaucagugggucucacaaaaggcagaagugaaaguuggaggaaggcuacuugggagagaaggguuucaucaggaaagggaaggguacguaaggaaaaugacucauguuaauuauauacaugcuggaaauuauauacaugcuggaccauuuagaaguauuauuuuaaagcauauuuuugaguuauaaagcucaaauauugauauacagauagagcuuuccuuguuacaggauuuuuaacuauuguacauagaaacccuaauuguuaacaaaauauuaaaacuuaaauagauaucaaguucgucagaugcaguuagguguguccuuaagagaggcaguuugggugugccuccaaaagccuccagagaugagaaugguaaagaaugcuaaauuccugccuauuuuaaggcaaggugcucuggagaggucagguggucuuugcucuguaaccugaggcaaagucagcuggauagccuugagcuaccccaccauaaaggugaaaugauucagccccuacgacuuggagaacagccccacuacagugacaaggcucagccugccaacuggaccuuggaucucucccaccucccccaaccccgcccccuuccucuuuaaggaaggagcucugagcuuaggguaagagaagcagccagcaggauagguuaaaacuguauucaaggauaaggagcccucuuggguuuggaggagcucaagagaaagguagacuagcucuguagaaugacacagguagaaagagauuccuaaaggguuuagcuguaggauccaggcuuauaaauagauauuuuauauacaguucggaaacuaaaguuaccuugcugagcuaguagguuuuuaccuccugugucuuuauugguuuaaaaauuaaauaaucuaaacaguuagauauuauaauugcuaauccuuucugaaccaauaggaaacagaaucaggaaacucugcuuccugcuaaccauaggcagucacagccaaggcacaggcacacuguaaauacugcacacauugucuucagguuaaguauaaaaacaaauuguuuuuaaaugagucugugcccaaaaaauuucacuauauacaugcaaauacugaccccagccuagcuauaaaaaaaaacucuaaaauguggucuuaagcauuucgaguaaagacuucucaaccuggggaaaugauaauaccuguauuccaaucccagauagcauauguaccaagauauuucuacaauuaaaguaacuuacguuuauuuuaguguuucugaaauaccuuaacguuuaucaauacagaagaaauuaaggcaauuaggaguaagccuucucaacucuaacauucauucaguuuuacauaaucuuaaaaccuuagagauccugccagguaagcauuuaagacaagacaaaauauauacacaagcuuauuuuaagcaucauaauuacaucagcaacacaaaguaacagcuaaagauuaaucuccugaaacccaugguugcucauaguucccuccaucauucucagucacagacuucaucugaagacugcacuagcuaagaaugauucuaagguccuacugauggguaaguagccaugugcuucacuggcaaggaugcuagaaccacaugguuuucuuuaaugaauccaacucuggccacaaaaacuugcccauucuuccugcuucuugcaaugaaaauguuuccacuuuccaaagaguuuuaauuggcuaaagugauucacucacauuagcugcacuuauuauagauacagccuaauuuuuuggccuuucauucacauuuguuacagauacuaauagucaucauucuuaacgauauucguauuuuugaucacuauguguucuagauuacuuugguauuuacuuugggcagacuucaguuuugagauuaguaaauacauuucuuaaaggauuuauaaacucuacaaaaccagcuaucucacgaaugaaguucugaaguggguuuucucuuauaacuaaaagccuauugcacaucuuagaucuauauccuuuucacuagaaauacaggaacugcaacugauauuuuauuugcaugcucucaugaaaggaauucguucauauuaggaugaaagaguuuaacauauucaagcagaaggaacauacacacacauacauacacacacacacauacacacacacacacacacacacacagaaacagccacuauuaacugauucucuaucuggucagcuauucuuuuaaugacccaauuuacgccacuuguguaaagaucucuaaugcacucaauucucagaguacucuuccaaugguuauuauuuuuaauaagaaaacaugaggcaugcagaggcuaacuugccaaaaguuacagaauaaggugagccaggaaguaaacuuaaguuuccaaauugaagguucuugacaucaccaacaugcacgcuaaaacauuacugguacagcgauugguuuauauuuauguugcuuacguguuuggugggacuuugccuugggaaacuaaacaaauggucaugaaaaauuauuuauucucaauugcuuguucuaccauucgcuguggucauucuuuagacacacaacaaugagaccuucccucacguuugucugaauucaugaugguagauaaaagguuacugcuucuuccaaacacucccuuucugcuacuguugaagaucaucaacuacacugaacucacugccuuccaaaaggacauuuccuguuucagagauucuuacucuuauugcaguccuucaugcauuacuuccccuugggcaacaucuuagcaauucaaagauguauuaaaauaaaauucacugggacuggugagauggcucaguggguaacgcacuugucaccaagcaugaggaccugaguuacauucccucuaaccugcauggacagaacugcgucaccaaguuagccucugauucccaugcagcaacauggcacgcacauacacacacaauaaauacaugcuacaaaaugucuuuaaaaggaaacaaguuuauuuuugagacauagcauuuagaguauuuaauaucaagcuuaaaauaugcgauuaacuuugaggacagaaucuucagagaaaacaccagugucugcguccccuaaaggcauuccaacuucuuccuuaacacagucuucauuuuauuuggcuggugacauaccuaugugcaguaaaggaaucacgacuguucuaacuagucaguaaugucauuuccuuugccaguagccggacucaguuugggcauguugccagguucuggucaguggcauacaaagaagccuauugguggauucaguuugagaaaaaguauccucucuuuccacuuacuccucuuuuaagagucugagcaaaggccucacuagcacuugaggacagugggaagaugggaagugcuggguccuucucaugcuccuuccccuucccugaauuauuuuuagacuccacauaaagaaucaaagagcuaaagagagagaaaaagagaacgguguucauuucacccaauuucucaauuuaugaaugcauauauucuaguuuauaacuaacaauaaaugcuacuucuaaaguagacagaaaaaucagugacucuaagaaagcaaauggcuaauaaauaaugcaaaguacugucuuuuuucaucaaagaacaucauccgagaaggcagacuagagguggcccuguugugaaaagcaacggaacaaagaggagagccuaacagucccaaucauuugugcuugugccauuuacacacucauaaacagaguaacuggaaaaccagaaggugacugcugaugcuuaacaauuugaagggcucagaacucacacucugaaguacaaaagcaccacagcaaugugaauuuaaauggacugauaaccugcagaaaagagaugaagugguucacuguaccccacuuuauuccgaaaauguuugauucucgaaagaagcaaaagguaaauaggcagucauuauuacaaaaagcagagccaauagcuaucuuaaaaugcuaagaggcaaaaagcaggcaucagugccuaccacugaagacuuccaguacacagauaagcagcuuucugcaaaaagccucaagagcaaugcccuaagaauaaaaugauucuaagagaaacaaauaacagaaagucuuaaaaccauguuguaaauucucuuccaagauucuagaaugucuguuuccuggggagaaauuugaaaguucucuggugaagauauugccacccagaaaguccacaacuaucugcauacaguauccaguauccaguuaacaaucacaaacccugccaggaacuaaagccaagaaagauccaaaaagagaaggaagaaaauaaggagacaaauggaaccaaggaugguccagguacugaaauucucaggcacagaugucaaaaaugugaucaauauguucaaaaggcacauauaauaauauggagacuuuuucaaaacacugaaauauacuuaaacaaacuggaucucaggguagaauaacaaaguuacuuacugcaauacucuugugguuuacauaguggauaaacuccaaaacacugacacuaccaaauaaaugcugaugaggaagcaggcaccuggaacucucaaucaaaaugacggacacuuuggaagaacaguuuggccauuuccuauaauguuaaaucuaccuugaccauaagauucagcuauaaugcaccaaaauauuuacucuaguuagaugaaacauuuacaugaaaaggaaaaauaaaugaaaagaaggaaaauacagaaacuccuaagcaucccacagaauggggaaaggagacugcagaaauauuugugauggcucaucuucauuaucaaccugauacacccgggaagagaaacccucaauugaggaacugccuccaucagauuggccuguaagcaugucuguggggaaauuucuuucucuaauugacacagggcccaacccacugugggugauaagaaagguggcugaaagagucuggggagaguuaagucaaaaugcagcaccgcuccaugaucucugauucuguuucugcuucagcuccuguccugguuucucuacaugaaguuguaacaaacccuuuuccucaccaagguguuuugguuagcauuuuaucauagcaacagaaaacaaagcacaacagggagauacgaguaaaaacugccugaggaugaaacaucaagucacauucaagucuaggucucuuuaauaccucaaucaggguauuauuaacacuuaaaaaaagcacaccuaagcauaucaugcuuaagcaaauguaacuacaaaguguauacaugugcugagguuugacagggaaaggagcaaggacuucagaaauguaagggagugcaaaggccaggacacacacacagaaacagcugcucgguccacagaggugacacugcagggagacuccacugagaugcugaggcuuuucuguguuccauuguuuuauuggcuuuuuccucauuuucauguggauauuucaccuaacuggaguaaacauuuuggugcauuauuaauuaaccugacaguaaaugcucaguuaauauaggaaauggccaaacugucugccaaagugucugucauuuugaaugagaguuaccugccuugguacuggaccaaccaguuacucauaaaucaaaaaucaaaauuugaauucuuauugacauuacacacaguuaaaugcaagcaguuccagaucuaaaugugaaugacaugagaagaaaacagaauacuaucuuugauccccugaagucuuugacaucuuuauuuuuaaauaauacauuuggauauguaaacuuccaaguccuugccucaacaucugggauuauguaccgucacacccaguucagaagaaucauaaacgagaacacagaaaauaagacgaauaaagaaaauuacuaacaagauuucauuagaaucaaugacuucaccacaaggucuuaagaaaaugaagcgucacacuucagaguaagagaagcaacuugcaaugaauguaucugacaaaucagaguauauaaagcgcuucuauaaaauagaaagacuaaccugacacuucuggaagcaaccuaagaggccaagucaacauauauaaaugcaacucaacuccuaagccaucaaauauaagcucaaaaugagagacuucuguauccacagagcaguuaagaaguuucaaacuauuaacacuaaguuuugguaaagaaguacaacuaaacuuccacacacugcagacagacauaaggcagagcuuaucugacaguuccagaugaugcugaaacguggccucuagaucuaagcauuccauacuauagaguuacauacaguaccuuuacuaaaacauaugcacuuacauauuuucaaguaauacuaauaauaucuaaagucuacaaggaauugcacagaccuaagcggcaguguauuuauacaguggaaacuaccuggugauagaaauaagcacugccauaugcaaggauacagaaacaucagagacaaaaugucauacauugugaccccacuuacauaacauagaaauaccugcucaaccaaccuaaauggagaucaaauaauaguuauaucuuaggguaagaaaagaggauccuaggaaauguuucuuaacuaaaagauuauguaacuuguuuauuuugcagacauucauucucacaaguaugauguaaugaucccauagcucucugaauuauacuuaaaaguuuaaaaaguuuauacuuauaaaaagcuuauacuuaaaaaaauucaaaaauuuauuccaguguuugagacuuaggagguaauaaaaauauuuuagcauaauauuuauuguaaagaugcuaaagccacugaauguauacuuuuaaaugguuaagucacguaaauuuaccuuggcuuuaaaaagaaaaaaaaaaaaaaaagaaacucuauuuauugguauccucaugacuacaauucuuaguugucaugcugaacuuaccagcugcuguguccccgucuaacaaauugucaucuucagaagucugaaaguccauaauggcaccugcuccaucuaggagcuccucaucgcuacucgcgcugguuaugcuguuguagcuguuucuauaguagccucuauggaacagcugcucagacuccauuuagcugucugcuuaucuggaaaaaaggggaaaauggcuucaacauuuucccaacauuuaacaaaaaccauguauucugacaucacaaaauaaaagcuauuaucuuuguauuaaaaaauccuaaguccauccaguguaacagcuaccccuaugaugcuaaugguuaagggaugguuuaauucuuucuucucacuacgcagguguaaaaaagaaaagaaaaacuucuucaagcagugcuguaaaaccauguccaagaucugugaaauuaaaauggauccagugcagagaugccuucguagugugccgcuuacugcacaggauagggaaggacugcagcaugcagucacuugcagaugcagacuggacagggcuuugcaagaagaggcucacaggaauggcaacaaauggcugaaauaccaaguccuuuguggauuuuaccucaggcaagcacuaccuaaauuuuaaaaauugcauuguaacuuuaaaaaauuacaauuaacuuaaaauauuuaaguauuuagagcccagggucaaacauuaaucagggaaauugaaaauaguuuaaaaaaauuuauuuuuccaaagcagguaaaaccaaaugaugcuuucauuguuuugccucuuuguauaccaaaaauacuccucccuucuuuaauauaucuacucccaugcuuaccaucaaaaugagaaguuaauguauguuggcauuggcaacagagcugaaaaguacaugugugagauagaccaacugcaguugcacucaaaccagugaggcuuguaaagcaaggcuggugagaaagucacagagagcacacacagaccaugaaaaagaguucccacacgccaaccaagccucaagacggccuucaccgucucaccuaguugguacuuuucuuucugcacacaaaaacauagcaguguuuaacaacaaaagcauucaggaaguccaguuguuuuuuaaaaauuacuaaauaauagcuaucuuuuuaaaacuaauguauaauucccuuaaagaugauuucauguaaggugacauucugagagcggcuugagagcacgagucucuuguccgcaucuagcacaauggccggaaccgagcaugggcaguaaauacccagcuucucauuccgcugagaucaaagagaagccgcgcagucaguuuuccacaugcgcacaccccucagcaacagcagugagcuaggcuuggaaucugcaacuuuguuuuauuaucccuucugccaaaacaaccuauuuuaauacucuaagaguauuaauauauuacuuaaagcacauucauaggggcuggagagauggcucagugguuuagagcacugacugcucuuccaaagguucugaguucaauucccagcaaccacaugguggcucacaaccaucuguaaugagaucugaugcccucuucuagaaugucuuaagacagguacaguauacuuacauauaauaaaucgauuuaaaaaaaaaaaaaaaagcaaguucauagaguauaugguagaaguucuggagaccagacucacagagauaaagccuaggguacuauuagaaauuucuaaugaucucagcauaagcacauugucuccccuaacuucaucuuuguacugcagugagccccuuguaaagucugauuaguaaucuaucccuaauguguauauuaaaauauuucauuuuuuuuucacaguuuuuagaggacaaacuucuuaacaaaauagaaacagcgguuggcuggcagucccugccuaguucccaguuucacuuuguaauguguacuucuuugagacucuagaccgcugauuuuuccaacucuccaucccaucaggauccuuccugccuccuggcccaaggccuucaguguacuuucuaucuggaacauucccucucuucuucaccuaacuuugcuacucauucuucagcuuucacaucaaguagcuauuaauuagcugggcauauggcacauucuuguagccucagcuacucagaaaccuuaaacaggauuaucuggaguucaaggccaaucaggaacuuacaccaucucaaaacaucaacaacuaacaaacaaaauuacuucuuugguuaauaaauacaucucucuagcacuauauuacacaaaaguacauguauuaaauaugagucaauaauaugguuugagagcuaaucucucuauugaagaugagaaauuuaagacacaaaauguuuaaauaaccaacaucaugcagguaguuuuuuuaaaagaaaaaaaaaauaaaggcuaccauaaaacuugagucaaauuuugccucuaucaaauuuuccuaauaguucuuacagcucccucuguauagcacuguauaagcgauucuauuaauuugcuaaucuucugaucuagaauguauguuguguccuagcucuguucauuuuuuguuuuucauuacauagucaaugguuagcaaaguaugugacauauguauucaguuugaggguuguuguuguuugucaaauggucucauucuauagcccaggauggucuaccacauaauaaaaauauuuaauuuuuauaaaguucaguucaucaauuuuuccucuauggauaucacuuuuguugauaaaacacauacuuuccuagaacuauuucccaaagacccugcaagcuaauaacuuaaaaggcuuuuaugguucucaauaaaguuuuguuucuccuauaaaagugucuaggcagaacugaagcuaauggcuaaacgccaaugguaugucagucaccugcaugucugacuaguaaguuaaacagagaaaaaguaggucacaaucuguugagagaaguaaaugaaaacacuccacgucaccaagcagaaaagaggaacgcaagucuccagaacaaugagggcagagucggggaagcccaacuucuagccaucuauagguaagacacauuuuucauucaacauuuuucuuacaguuuuuacuagcaaggcauggaauaccuuucuacgacuuauugggcagggaagccacagagguuuccagaacacagguacugccacugcccucaguuucccacccuaacuacaagauucuauugcugaagacagcauacacuuuggcuacagaacacagagaaauuaaucucaaccugaccaguaaauuuccucccugaugacuagcuuucaaaguguuggaaggugcuaagcaaguuacuaaaguagagaagacaucaauggucuuacccagcacuggacacugcacugguagagaagauaucaaugauuuuacccagcacuuuaugcugcaaaaccagcuuacuagccaaaauaugcucucuugaacacuauuucucugcauaguccuggcuguccuagaacuugcucuguagagcagguuggucucaaacucagagaucugccuguguuuaaagccagcauucaggaaacagaggcagauaaaucucugugaauuugagacaagccuguucuauaguaaguuccaggccagcuaguguugcauaccuucucuaaaaaaauaaaauagaacuauuuaucuuuuuucaaauacagugacucuccauagacagacaugcugagcauuuaaaagcuacauuauaauaauugauuucuaucggaaauauaaguaaauuuuuaaguauucucauuuuaauaaaauaaaaaggcaaaaauuuuauucuugcaaagucauuuuucaauacauuauuaaaguccaccaacuuccaagaguaauguaaaucaucacaguagaaaaacaccacaaggggcuggagagauggcugaccaguuaauacuggcugcucuuccagaacucagaaguccugaguucauucaauucccagcacucacaugguggcucacaacugucugacaccuucuucuggugugcagacauacaugcagagcaucuauauacguaaaauaaauuguuaugaaguuaaaaguuuaaaaagcacacagaaacaguaagauuuuuuucuaaagguugggggcaaagagcaagaacaauggggcaggguguuuguuauccauuagauccacuggguuacuuuuuaaaguuccaagauaaaacaauaaucuaacugguuucucccaaaaguaacauuacuuccuauuuuaucauuauuguucauuuagcacgucaaaacugcaccuuauauuuuucuucaaagaacaaaaaacuaaguaauuaguuccaugaagaauauuucuuuugguuuuuucgagacaggguuucucuguaauagcccuggcugccuuggaacucaguuugaagaccaggcuggccucgaacuuagaaauccgccugccucugccucccgagugcugggauuaaaggcgugcgccaccaugcccagcccaugaagaauauuucuuaaauuuacaaguucuuuuaggcuuaauacuauuauucgcuagagcaaaguuaugaaaaccuaaguguccaucauagauacaguaaaaaaaaaaaaaaaaaaaagcacagaacacugcauggucucaugugggaucuaacgguccaauucaaaagcagaguugcaacagugguucucagggauggaaggcugggaaugggggugggaguagugggucuagucagggguagagguuucaguuaccaagugaccuacuuaauguacagugcaacggcccuagcuacagaugagcugugugcuaccucaaauacaaguguuucuaucucuagcacacacaugaaagacaaacggaucuaugugggguugacuuaaugcuuccacaauauacacuuuuaucaaaguaucacuuuguaccucaaauauauacacacaauuacaguuugcaaauuaaaacaaaaacaagcauccaggaaaaggaaaauuaaacacugcauaauuuuuaaaaggcuaagagggaaaacacacauacagaugaauauaaggcucauugauaagaaaaaaaagauaaaacaauaauccaauuuaaaagcugcuauagaagacugagaaaagacaacauauucaacugcuccugaaagaauggggagaucugguugauugacuugguucccucccggcugcagcaaaucucugacagugagacagugggggggggggggggggucuuccuucacuuuacaccuaaccaagcacacuuaucuuuaggaaucaaaaggaauuguagccacaaugcuuauuaacaaauaugaaugugcgcauaaagacauaaaaauguacuaaggugauaguacuggaugcucuuuuuaacaacaacacuuggaagaguuucugcaauugggcacuccuuuuacaaauuacaaauguauggaacuauggcgccaugacucucacuccaacuuuucaguagaaugucaccuaguagugcuugcaagacccuguagccauugaggauugaaagcaaaaguucugggaugacacugcugagcucagucugacacuuauugcugugagaccuuaggaaugauaguucaacucuuucucaaguuuccacacuuguuaauuggaaaaaagucaauguauuuacuuuauggaauuaaugaaaaauaaauugagagagaauguauucuauuuacauguauuauaucauauauuuuggaagugucugcuaacaauuuugacuacaaagcaaguagaaauucuacaaagcagaaucaguggucaaaccccacaggaugcugcuuugauauaugacccaccacagagaucaaaucuggcuuccugagaagucugaaaauuauuaccaacuugucacaacaggaaacagaaagccuaucaccaacaugaccuggacauuugccauuuuucuaccaaaaagcccagaacuuuaacaaaucuguucuucugaacuccauauauucagaaucagaauaauucuuuaaaguuuucauaagguacauagacggcacuauuuccaagcaaugaccuuaguuauuuauacugaccucuuaaaauaauuugagcugccacucaaagagaggcuuugaaguaaguagcaaagggagaggaaggggcagggguugaacaguaucugugauaaauucugucaacaccauauaaacauucaaugugagaaaauacccauacgucauacacuuaaauuuaaagccauauuuaaaaaacaacaaacaacacaucagcagaaacagcaccucucaaaacugcucaacaacauccacauaagcauuggacuucuuguauauacucccgaacugaaaaaccauuuuuuuuuuuuguaauuuacagagguauguaaaacugacccaaggaaaauaaucuaaauuuuucauggguaaaaaguacaucuacaaaguaucaguuauauauaagccacagugaucgugcaggaacugaauacacggcucaaaaaaaguuugcagaacugaacuuuuuaaauuuuauacucgcacacgcggagagguauuaaaagguuugguccaauugucuuaaagagucauccuuuucaaaggaaaucgaaaucucggccuagaauuagaacacacccgaugaauaugcaauuaacuuccuuguggucuaauuuuaaaacgccauacuuuaaauaaagcacacaggacgaaaaguucucuaaaguaacuucuguuucaacaaguuuacuaccaaaacgcaaauauccacacaaaaaaugauuugauaugcauaagucuaaagaccaaauaagauaaaauaaaaaaaccuaaacguuuuuaaacuugagcaaacuguaaauucaagacuaauucugugcugguuccuaguuuuuaauucuacguauagguccuucgaagguuccgggagggaacaggagagauuuuaaugggcuggacagcagguaggugggcaccucggccagagcccggccucgcgguccaccgucaaggcgugaagcugacagcuggcgacucaccuugcagcucagaggcauagcaagcugggcggcugguggcugcgcugccuguggaccccgcaucugcuugcgaucgcgcgccagccgccccgggagcuucaccgggacaccgcugccggguggccaccccggcggacuuuacugcuaccggccuuucaggagagguuacguaaaggcggccaggugggaccggcggaggcugguuucagggugaaguucaauccuccggcuccagcgggcccucaaaccaacccgccucugccccgacuggaggcucacugcgcucuccaaggacuacaggagcagucgcgcuccaccucgggaggaaaguaacgcgguucucacgccuccgcccacuccagccucauccuccggacagacggacggacggcccgccccgagcgcaccggcaacgagcuggcgaggugacagccgagcgauuccgcgaccagcccugacccgcugaacuggaagagaagcugcaggagucggagcccgacaggugcgucgcacgcgcgugacgucagcgcguugacgug

SEQ ID NO: 4450 - RNA, 138159 nt, Mus musculus
cgucacacgccagcgacagugacgcgagggccguuccccucuccucagcaguagcucuaugguuucagggcggcaacgugcagcguccuuaccuugagccugugcaguugcccucaccccggaauccauagucacugugacgaggcgggaggacuugggcgacagguagccucccagucccacacgcugcggguccgcgccuggccaagccaccucgaccugugaaguugggggcgguacccagcaacucccccugugcagccgccguuuccaaggggucaggaaccgcuguguuuguuucguccgcguagccagggcgggucgcggaguacugugccugacccgacgguggcaagucugacgcgucagccagagaccggugcccgguguaggagucgcagccugggcugugagcggcugcuggguagacagacuugcuuucucuuacagcaugucauuuccaaaaugcaucguggugcuucugccuuaaguccuauaggaagacacugccgccacuagaccggugcuuauggucgccacuguuauucugacucaggucccgugucauugaggugaguugcgcgugggaaagcagugacaggcagacaagcagaauggugaacucaccgggagugaggagaccuguauagaucuguggagugcauggauacucgccuuaaguguuugcgccuaaagcaccuucuccuuaaguuguuaauggggaggacuuguguauggcucaaggcaauucuuugguauucuaaaaagauaacgcucucuuaagagacgauaaacuaaucuaaguagaugauaagucacuuaaauagauuagauuagaugccuguauauuuuaaugagaaaaauagcaguuaacugguuacccuaaagcuuuccaugguuugacacaauuuccacguguaaaguauuaaaaguuuugccacuuuaauaauucaguguaacuuugggaaggggucuuggggauuggaugacaggaacucauuuuugcuaggcaggugaucugccacugaguuauauacccugcccaauguuuuauucuucccuguaagaucucccuagaagcagaaauauuuuuacugccuacauaaaucacaucggaaauguuugugaaggcuuaaaagcccuaguccaucugagcuuucacggugaugggcuuugcuuaugcugcaguaaguggaggugaugggcagcagccagauggaaaaagaagcaguucuuuguuucuaguuucuaggaucuagaggucuacauuuaaaauggccucuuguucuggugaaaccagaguaacagauuuuguggggaaacugguuuuuacacugaaaaagaaagucugucagaaaucugaugaaggcugugggacuuaaccacaguucuuuugaggucguguuacuaaugcauuggcacuguauuccaaguagguuuuacccuucuagaaucguggacaugauagcuuuucaacagaggaaguuucuuuuugcuuguugauaguuucuacuauaaacuccuuggguauugucuaaauauauuuaccaagaagaaaacacauacuuaaaaaauauuagcaauucuuuauuuuuuuucuagagauuccucauaaugaaaaaaauagagaauuuuccuuucuuggaaaacacauugaccguuuucuacaauucagguugucucuauuguuuuggaagaaccguguguauagauuuugccugcagacaguaccagaagaccucuuggcaucuguuagaaguaggccucaccuauuccuaauguuucccuuuggaauaaccuauccaucaaauaucugaaagagcuaaugcuuaaucucugucaguguuuuccuaacugauggagaugcaguuuaaaauuccuguacucugaaacuuuuaauaugugguucauguuauuuaucaagcacuacuuacuugaaacaguucuuagaaaauuagaaagguaccuaucuaauuugacuggaauugaggaauauuuuucuggagcauaguugauauacuuaaaaagaaacaagauauuguaguagcaugaauuuaaauguuaaggugaaguguuuggaaauggaaaauuguucaaggaugccuggugaauaguaggcagaugcuucugccuccaaccuguaaccccauccuguucaaaauuuaaauagggacauugagauggaccagcagauaaagacacuugccaccaagccugaugccugaaugaccguaguucaguccccuugaccuacuuacaugguggaagaacaagcucccacaagucuucuuaguguagagacacacaaacacacacacacacggucucucuccauauaaacuugguuauuuuuguuuucuuuuaauuuauguaggagaaacugauuugcucuguauucuuauaucaguauacauggcugauuaacauuuaauuuuguuguuuugacuaguuaauucuaauacaaaagauuguagacuucucaacucuuaauuuucauucuuuggaagcaauauuauuaguuuauuuuguguccuuacagagguauuauauauuuguggguuuguguacacauaaauauguauauaaauaaguggagcuauaaauauauacauauguuuuucuuuugccaccaaauagaguguuuguuauuugccaaccugauacaaauccagauauaucuuagaaugggauucucaauugaaagaauaucuccaucaggcuaucuguccuuguggacaugucugugagcauuuucuugguaacugguucuagagagagagcucagucuaauaagaaugaugccauccuucggcagguggccuugaguuguauaaaaaagccagcugaugcagaagguaucucuauuaucuuuuauuucauuucaugugaaauaguucucuaguauaacaauuuauuuguagucucacaggucugaaguugguagcucauguacuccuugugaugagcaaagauuaacugcagaaaaggaaagacuuuuguuuuuuguuguguguucuaaaacucauuaaccaugaaucuuugguugcucagaaaaauaccuguguuuaucauuaucugaugguauuuagaauuaucuuucuucaucuuucuucuuaccaagggcaguagauuaggccuuacugaguuacaaccauagagcuuaguauggggauggcaguaggaugaaauacuaggcacacugauagcuuccaccuuggugaagucccuagaauggaauuggcaauuaaauuuggaugaagagccaaacugacaaauuuuguuuuuuucucucuugccaaaaaagucccaaaacaaugacaauugugaaauaaacucauuaugugguuauuauuuaauguaauuuuauuuauggaguugaguuuuuaagaugaauuuaucaugauuugcucucuaaguagcucaguaauaugauacauugagcuuucauguucuggagauaacauuaaauuuuggcuggcuuccagauagccauuacacugugccaguuaauucaauguagaccauguuuuccucucugacucacuguugauggcuggaacuuuacguaugauaacguuauaauuccucuuucucguaagguugcuaauaucauucucaauauggaaauugaaaugggaucugauuauguuuuuuaaaguugaggaagguucuuugucaugaaauuucauaaacacuaauuacuaaucuuacuacaggcuggauauuaaccuuuaguuuucaggacuauauuaagaauucuguaauuuaagaaaaucgaaucuuuuuaaaagaaaaauuggcugucaucagaugggagggcaaagaaucuaguaguucuauucagaaggcugcucugcaguccugaaggaguagguucuaaaguaguagguucuaauggcagugaaagagugccucagcaguaggauggaugcacuuaggagagagggugagcaggcaaagaacaaaagcuuccaucuuccauuuauguggaccgucaccagaagggguagcccagauuuaggaugggucuuccuaucucaagugauccagaucuggagugggucuucccacuucaaaugcucaaaucaaggaaaaucccucacaggugugcccugcuucguggauuuuucaguugauuuaguuaucaaguugacaaccaagauuagccaagucacuaacaacuuaaucuugguuggauaaucuuugaaguaugauaaucauaccaguucauauuaagauggucauggagguacacacuuguaaucccaacauucagaaugaggaguuugaggaaggcaugacauuaauagccugccucaaaaauaaagucuuuaucuuuauaacagauaaggaucucauuaaguaaugagguuuuccauacuaaugaaaaagacuaugcaaguagaaaugggcaaagcaaauagagaaaauacaaauguucaauaaauguagauuuuucagaaaaagaauugaaaugcaacacuauuugucucaucaaacaucagcaacaagaagaaugugacacaugccucaaguagucaguauaagcuucaguuguuccucacaguguuuaauuacauacucuaucuacauuguugggugaauaacagacacagaucucaauagugcaaggcagugcuucucaaccuuccuaaugcugcgacccuauaauauaaucucauguugugaugacccugaccauaaaaguauuuucauugguacuucaauuuucaauuacugcaauuuuguuacuguuaugaaucauaauguaaaugucugauaugcaaccaguuugaaaggggccuugguugagacuaacacuguguaaggucaugugaccaguaaaugaacccucuguguuaguguuauauugcuaugaagagacaccaugaccaagacaacucuuauaaagaaagcauuuaggugggggcuugcuugugguuucagaggguuagucauuaucauaaagggagcacugcagcaggugcgaagacauagcaugauaccagaguguuugcugacaccuuugcauccugauccaucagcaggcuuucaaggggugggauauucgacuuggaaugggcuuuugaaaucucaacgccuacuuccagugaugcaccucuucaaauuaagccauaccuccuccaacaaggucaucccucguccagcaaaaacacaccucccagccuucuaaagaguucuuugggggcuguucucauuuaagccaucacaaucuccaagguucuacugcucuuuuuaaaaaaccaaaguuuauuauaauuguguguauauguacauaugguguauuugaguacaggcauguaugccaugcucaaguguggagguccgacaacuuuguggaguuuccuucuuccaaggaucaaacucuugucuccaggcuugccuggcucaugccuuuaacccagugagccagucaucuugcuggcccugaucuuuuuaacuuuuuuuugcuccucugauuuuauuuuuauaaagaauagccacugcuaauaagaaucucuaagaaucagcauuuuauacaauauugguuaacagugguagauauuuaccauucuagcuggcagcaugaaccugggagagcaagggcuaaaaaugaggcaaacuuuauucagggcaucaaauaauuucuacuuugaggguuaagaguaauaugaguaaaguauacaaucacaaggacaagccacacguggcaaaagcauguuuuucuauagaggcacaugaacaacaacagcugaagucagcucccuccuauacguuaucuuaauagcguucucacgcccggccaggaaagacgcaacagaccagaaucuucugcggcaaaacuuuauugcuuacaucuuugggagccaggagggcaagcgcccagcgcccagccccaaaaacgaaagccccuucaauaaugaaaccgaaaccccuucccuauuuaggagaguuauauuucgccuaggacgcaucacucccugauuggcugcagcccauggccgagcugacguucacgggaaagguagaguacaaguagucauaaaauacccuuggcacaugcgcagauuauuuguuuaccacuuagaacacaggaugucagcgccaucuugugacggcgaaugugggggcggcucccaacaucucccccuuuccuuuuaauaagagcaaauaggccacccaacuaaugagaguggagauagaggucaaauccccaguguguagguaaaggagccauguacaggauuagcucuuaggcucacaggcuuuuacccagagcaacccugaccugcucccgugucguuuugccuggagagaaggacacuuggacacucaaccuucuugaaagaugacaugucucccuagaauaggcucauauaugccgcagagccuuucuacugcagugcuuagccgugcaacucucucgggcugcugaagcacacucacucuaucccgugcaaugagacuagccucgugagauguaagagcugaguggccagcgaccuauugccuaagcauagauaaccauauaucagggggagcaccauguucuagagcugcaagcgccugggcaauaaccaccuugucucuccuaguuuaggccuuaagcuuacagaccaaccaaagaagcaacacuaauccacagcaaaguguaucuccaaauaauaucaaucccacccauucuuuaaagaaagaaaaugcugaggagauccaauuggguaauccuuuggucagggacagguccaagcgcguggaguugaccugaagucucaauucccgaaggaucuguucaaauucagccguccaauucuguaacauauacugaaaaagacuuuuugacaaauuagcuguccuaguaaauuucucauucugaauggaaguaacacacaaucucggaaacuuuuguuuacaccccagcugaguuauuugucauaauacaucuaguuguaucuggacaagaucuaugaguugauuaaccagcaugagaccucucuguaucuugacauuagcugaggccuguucaucuaugacuguagucacugaggcugacaaaguguuaauggugucagucgucuggaccuguccagacagagccaaggcugucugaaucaaggccaaacccaguucccaguuagugguaaaaaagcaggagaauacuugagcauuauacaucaccgucauugggaguggaaauaucgacauuaucccccaacgcugcucucuuuuuauuauugacgcccuggacaucaccaagacgagggacauuaguauucccuuggucagucuggauuuuucgggugagucuuucugguauccaaaauggguugucuucauucugugggaaaacacagauagcuccccuggaucuuaucaaaauaggauccgggccauaccauuuauuaucaaggacauuuuuccauuuaaccaucucauugggccuaucuggcucuguacaaugacguucagccgcaguauggccaugagcaucaauauuuaaaaaauugaguguaaagagugccaaagacacagacacucuuggugcucgggguaaaaucucuucaauuccccucuucuguuuuauaagauagguuuugagggugcgaugcgcacgcucaacaauacccuguccuugaggguuguauggaaguccagucaggugggucacguccaucugacggcagaacuguuggaauuuuugagacguauaagcugguccauuaucagucuuaaggagucuggguuucccccaagcacuccaugccucaagacaauguugaaucacaugugaggcuuuuucuccaguuaacggagaggcaaacaugaugccagaacaugugucaauggacacauggagauauugaaguuuuccaaaggaagaaacauguguaacauccauuugccagaccuguagaggucgaauaccgcguggguuaauucccacaugaggaacuggcaagaacucacagcagcuuugacauugaguaacaaugucacgggcuucuuuucuugucaaggagaaacgacugcauaauguuucagccgucacaugaaaauuguuaugaaaauuucuugcagccucuaccggggaugauagggcagcagccaccacuuuaguggccuuaucugccaaaucauuucccagagccauggggccagguaggccugaaugggcucuaacaugaguaauauaaacaggaaaucuucuagauaacaaaacuaauuguauuugcugaaaaauauuggcaacucuacuggaaggcuuaaucacuccagccacuucuaaaagauuuacugcauuaaccacauaacaggaaucugacacaauauuaagggguucuaaaaagguuuuuaaaacuucuaagaccacuaaacauucuaccacuugaggugaauuuucauuauauuguuuggauaccacuuuaccauuagccacauaggcaccuaugccaguuuuugauccaucaguauauaccacaaucccauuuuuaaguggguuucuuacuguuauuuguggaaacacaacagauugauuuugggcaaacugugcaauugcaucaggauaccaaucuauuauuuuagcuggggauacguuuggauggauccacaacaauggcccauucugccacaaaacugcaguuggcaauugugcugucuuaaagacacacaaacugaaaggcugcgaauccucaauacguuguaauugugcauucuguaaggcuuuuuccacuuuuuguaaggccugguuagcagcuagaguaagaguccuaggggaggagauaugaggaucuccuucuaaaauaccaaacaaaggccuuaacucagcggaaggaaucuuuaaaaaaggucugagccaauuaauaucucccaacagcuuuugaaaaucauuuaagguauggaggugaucucuucuuaucucuaccuuuuggggcacaaucuuaucuggggacaccacagagcccaagaauuguccuguaucagaaauuuggaccuuuucuguggcuaucuguaaaccccacugacuuaaaguuuuaaguagaaaaggauaugccuuuuguagcaugguaaggucuuuauggcacaggaggaugucauccauguaaaggagcaaaauuaaagaggggaauuguucccucacuggcaaaagagcuucuugcacauaaaguuggcacauuguaggacuauuggacauucccugugguaagaccuuccauugauaccucuuaucagguuccaugugauuaauagaggggaugguaaaggcaaaucugggccuaucccuuggacacaaagguauagaaaagaaacaaucuuuaauaucuauaauaauuaaauuccagccacgugguaaggcggaaaguacagggagaccccucuguacugggccaaauaaguucauuugcucauuaauggcucugaggucauggagcagucuccacuuuccugacuuuuucuuaauuacaaaaauuggaguauuccaaggugagguagauggcucaauauggccuaguuuuaauuguuccucuaccaguugaaucacagcuuccaguuuuucagaggauaggggccauugaggaacccacacuggauuccccguuuuccaugguaugggccgugcugccccaauggccgcuauggaaaacccagacccugucugucuugguuuccauuagguaagauaggcucuauccuucccuguucuugauguccuaacccuuuuccuucuuuauaacccaucuuugccaugauauuuuuugcuuuaguugaauacccucccgaugggguguuuucauuggacaaaauaaggcccaaaugcugcauaauaucccuuccccagagguuaaccgggagugggagcacauaagguaugaauuucccuugcuguccuucagaggauucccacgucaaggcaacggagcuuauagugggacaugauugauauccuaggcccuguaaugaaugagaugacucuguggugggccaugcuuugggccaccaauguguagaaauuauacuuuuaucugcuccgguaucaaggaugccuucaaacucuuuuccauuaaucuuagggcagagcuuaggucuaucauuuaaagauacaaccaaauaggcagaaucauuuccugaggagcccaucuucuuuaucucagguccugcagauuuuucccugguauuaucagggaggagcagcagcugagcuauccuaucuccuuuacuaauagaaaaaacgcccuuagggcuugagcacaggaccuguauuucaggggaauguugacaauccauaacuccaggguggacuacuaagcccugcaaggugagugaaccccggccgagaauaaggcccaugguucccgggggcaaggaugguauaggcuccaccggcaccggcugaauacucauuugaggcauuaguaggaagucggaggcggcacgcagguccacccuugugggucuuccugggucgccucucugacugcuuccuggguccugacaaaccgguucccauaucuuugagggcccugggaccgagggcccgaugacccguuuuuuggcacauaagcugauugacuaucaggugggggaagaauucugcccuuuauaucccucacagagcaacacuggucggcucuaugauaacccuugccacacuuagagcaaagagugagagucccucccuguuuaucuggagcucugcaaucuuucuuaaaaugcccaggcuuuccgcaguuaaaacauguccucugauuauuucugcccauggagcgguuuugggauugaaggauggcagccgcuaaaccugcauugcugagaggucccccaagcucucgacagacccugagccagucuuguaagccuuuguucuuucuuggggcuauggccgcucggcacuccuuuguggcuugcucauagaugagcuguucuaccagaggcgcagcuugcucugacucuccaaaaaugcgcucugcugccucugucauucuggccacaaaaucugagaaggauuccugaggucccuggauuaucuuuguuaacugcccaguggcuuccccugcucgggagagcgccuuccaggcccuaauagccguggaggaaauuugggcauaagcuccccaaugguaguuugucugaucagcagaauaagcucccugacccguuaacaagucaaaaguccaaucucucugcucuggagucaaagcagcugcguuugcucgggccugcgcuugugcaguuucaugccaaagagcucuccauuccauauauuugcccauacuagggagagcggcuuuuacaaccguuugccagucggcaggaguuagugccaugccggcaagccugucuaacugcaccaagguaaaauuagcauugguuccguauuuacggaccgacucggcgaguucuuuaauuuguaaguauucuaccggagcguggacacgcccacccucggcuccuucaaagacuggaaaugccuguuguauuuuccuuuguuccucucugggaaugaaugagucugcgcacugccucucugcgcacugccucucugcgcacugccucucugcgcaucucucugcgcauugccucucugcgcaucucucugcgcauugccucucugcgcaucucucugcgcauugccucucugcgcaucucucugcgcauugccucucugcgcaucucucugcgcauugccucucugcgcauugcugacgcacuacgcagggcgggggcuccgcauagggcggaccuugaaaccgacugccgggagguugaacaguacgcuggcuuucgccagccgcuuuuggcuuuuuucuugaccaauuagcuggcugguaaugggcugcuucuuccucccagucuguuuccucagaggagaauucuucaucugcuucagagcuacuaagagcuggcuuccugagcucaucuagugacgaguaucuccuagagaccuccgcuaaucgaucuuuuuucuuuucuuuuuucuuuuccuuccuucuaaucucuccccagguauucuuaccugaccuaaacuuuuccucggguucaagacccuuggaaaggccuguauacuuauuuuguguaccauauuuucucuuugcuccuacucucucuccccgcuuuacuucugauagauugcccugaauuucauccagaauuuucagcccuaucuuaaucaccugauaacaugugaaaaggaacaaaagggcuccuaacauuagaaaaaauucaaggccaaacauuuuccacuuuacuucugauagacugucuugaauuuccuuagaaaguucaaggccaggcguaccucguaaagcuguacucacugguacucucguuccccagcugaaaaguucugaauucaugcaguugaauccuucuuaacagucugcuuuacgggaaccuuuauuaccgcgacccgcaguucugguucuggaaugagggaucuuccuugugccggucccgaguuuucuuguauuuuuuucgucccgguuuuuuucucgucccggauuucagcaccaauucuuaauagcguucucacgcccggccaggaaagacgcaacagaccagaaucuucugcggcaaaacuuuauugcuuacaucuuugggagccaggagggcaagcguccagcgcccagccccaaaaacgaaagccccuucaauaaugaaaccgaaaccccuucccuauuuaggagaguuauauuucgccuaggacgcaucacucccugauuggcugcagcccauggccgagcugacguucacgggaaagguagaguacaaauagucauaaaauacccuuggcacaugcgcagauuauuuguuuaccacuuagaacacaggaugucagcgccaucuugugacggcgaaugugggggcagcucccaacaacguuacaccugggagaaagaagcacgaaaacccauuccaaguuuugaggaaacugauaucacaggacucuugucuuguuuucuggaguuuucuaacaagcucucagaauucucacaggacuccauucuugaacuguauuccagcagauauuucugcaugaugcuugaguaauauguuugcaagcuuuuaacauuugacuuuagauuucacccuaagaaaacccuuacaacaaauaauacaacaaagagcauuaaagcauaaguacaggaaauuuaccugaaauuguuuaauugcugaaacaacuuuaagaaauugugucuuauuuauccuguauucuuuuuauuaaacaaauacaaucaugcacugauucauguaggcaaaagauugccuuuauguguuuguacuguugguauguuaguacuggaugcuucaaaguacuauaauaaagcugaaaccgcucuuucuuuuuguuuuguucuaaguuuauuugacuuuuagucaagauguuagauaucuuuuuguuaaaacuugcuuaaucucugucaccucuuucuuuguguguagcauauguaugaaaaugccuuaggagggaaccauggagaaguaugugagacugcagaagauuggagaagguucauuuggaaaagcuguucuuguuaaaucgacagaggauggcagacauuaugucaucaaggaaauuaacaucucaagaguaaguaugauuucaguucaguugcacacguaacaaucugguuaugaggggacauuuuuauuacagaaauguguaaccuaaugagaaagagcuguaauuccacugaggaacacuaguuucugagggaucugugucuuuucagauuuuuuuccgauaugggucuguagcauuaugaauaaacauacuuacugucauguaacuuaaucuagauugggcacccuaaaagaguugcacuuacacauucacuucuuucuuguuuaacuuucagauuugagugucuguguguguguuauuguaccuuauuuuuaaccacugucuuauuggugggcuuucaaguuucuuauuagagguuuuacuaguuuacuuuuucuucccauuuaagaugucugauaaagaaaggcaagaaucaaggagagaaguugcuguauuggcaaacaugaagcauccaaauauuguccaauauaaagaaucauuugaaggucagauuuauuuugcaaauguuuauaagauacuuguaacuuuugaauauuuuccuuguaaggaauuauuuugugaauguauuuucaggaaaaaaaauguuuuuuuguuuuuuuuuggguuuuuuuuuguuucuuucuuuaauacauauaaauaaauguaaguggcaguuugauucuaggacagaauugacacuguuggaguccauuaaagacccucacucacaaagaccacugagaucaccaucgcuguaaaccacaagagauuuuuuuauugauccaacacauugggaauuccccucucagcaugcaggccagaagagagacccagaacaaacaaagaacacacuuuuuauacuguguaaggggcagauuuaggcgacagggcuagcuggcuuauucucauugguguggcaaguaaccuuuucaggcauuguuugcuuuuauagggugacuaccuuuggccuagucucacuuugccugcccuuaugguggguuauuaugauuuggucagcaaggcagcaguacuuuugaacuuaugggucagcuauuaaugucacagcuaucgacaagaaggucagggcguuuguggguuuuuucucagaauucaguguggggcgggguaggggaauuucucugggaacugcuaaucuuguuaugauuauuuuucugagaacaguuaauuuuguucuggcagcuguagacuuagucauuuugaccgcuauguuucugaaagucccuucagggggaaggggcuggguggucuugaacuaauuuuggauucuacaacaccaaacuguccccuuguagcuuaauacuggcucauuguuauuagugauuacuuaaaaagaagcagcagaguacaaaaauuuggaaggcaaaauuaacaauaacuaaucuuuuacuaaugcugagaaaauacucugauacugacuuugaaaaauaauuuccuuauuuugucaauuccuccauguauaauauaauuuaguuguauuucacacgcacaccacuuuguucuucuaacacucccucuuccuacucucacacccccaccuuuccuuuuuucuuuuuuuuugguuuuucaagacaggguuucucuguauagcccuggcuauccuggaacucacuuuguagaccaggcuguccucaaacucagaaauccgccugccucugccucccgagugcugggaucaaaggcgugcgccaccacgccuggcuagacccccaccuuucaauaagucacugacuuaauuaugguugcuuguaugugcaugggccuggguuuauuuauugaaucuuaggcagcuuaccagugauugcaccuuugaagaaaacuucugccucagcagccaguaacugccacuguuuuuucuaggggugagucuucaugugucccucuccuguccauccuagaauauuaacagacuaugucuuuaccuacaaauauuggaaugauuacaaggggaggcuuauucuuuaaauguggcuuugauguauuuuuguucuacuucauuuuaaaguaguaccuguuccuuauaacguuugaaacguauacgcauauguagcuacaagcucucaguuucucucauguuccccucguuugaacucccuaggaguuugcguguuugacagccuacuguuuauuccuauccuguuuucugugccuacacagcacauucugugguaggcaaacaaaguucuuguuucuucuuccccugcucugugacucaaaaggugugggagucuuugcaguugcaaacaagcaucacuuaguggauagcagcucaaagcccucuacuccaguucacaucugacacuuucccucuuucaaacccagcagcaaguccagaccucugaauuucugcuaacaagcugcaaaugggcuuuccuaugcccuccuuuaagaucugaugaauuugcuacagcagcucacagaacucuaggagacacuguacuuaacuuuauaauaaaugugaggcauguauguacuuacacacguaugucuuuuauacugagcacacguacacaccccaaacugguagaaaagagaaauuaaaacuucuggggcauuuugucuucuaaacgaagaagugguaaagaaaagagugcuagaacuagccacacagugcuuauacugagucuucugauucacaucccagucagguuucccuguccugcccucugauuuguucucugauucgucuuugucacuugucuugccugguuuugguuucuuguaugaaguugaaacuguaucaacuuauaguaguugcuuuggguuuuagagagucuuuaaaauccugugagccucuuagugauaaugggguuuuuauguaucuguagucuugggcaaaguaaucagacagacagguggaaauacgauauuagacaauacauuaugucucuaauagaaaauacuauucugauaauuauauauuuaaauaaguauugccuggguguucugcaggacaccugcaauacuagcacuagggagguaggagcaggaggauuguucgaggccagccuuggcaaagaauggagacuuugacaagcaugcaggcaguggguugauggaugggaggaaaagugggggagauuggaaggagagaagaaaugauaauuuuuaccugugaauaauagauaucugaguagcauaaaguagaacuaguucauguacuacauccccaacaauucucagaugucuuuguguacuauggaaccucccauacucccaccucccucuuuccccaugcuccaguacuggagaucagacuuggagcuuuauauguucugagcacucacuugcacuaaguuacaucuccaccuuugauacaagaucuugcagauccugauacagauuagccuccaacaugccuccugguuccacacuuagcuuacacaacauagaugguuugcuuucaacuaucuuugaaaggccaucauucuuuacuuggaguuaacucucguuacugcucuuuguucccucccagaaauagucuacauauuaauaaguauauaagugauaacacaccaugugcauuauucauagugucguuuuuaaggcuuauuuuuauuuuauguguguguuggccucuguaucuaaauguagugaauggugccuauuuggugcuccacuuggaggucauaucccaugaaacuggaguuaucgaugauugugagccaccaugugggugcugggaaccaaacucaggucucuacaagugcuuaaccacucagucuucuuuccagccccauucuauuugucauuucuagcaugaauauuuaauuaucucuucaucccagucauagucauacagauucuuuuuauuuuuauuuuauuuuuugagacaggguuucucuguguagcccgggcugugcuagaacucacucuauagaccaagcugaccucagacucagaaauccuccugccucugccucccaagugcugggauuaaagguaugugccacuacugccuggccucauacagauuccuaauugguuuaaucuagguaaguuucuagucucuaggcaguauaucacaagagcauauaagaacccucaauaagaaugccaccacaaaaugagagaaaugagccuuucuagaaauauagccuuugugcauauccuaaggccacgaggaguaggagcaccaccuucccggugugauagucuccuuagucauuguucagcaaaugguacuugugagauugaccacucuucuuuugugaaaaaaaguuggugguagaaggaaugauuguuuucuagaccuuucuccaugcauaaagauauaaaaauacaaagaauaugaaaauuauuauggcucuguaccaucuucaugccauuaacaaaauaugcaguuuauuuauuuguuuguuugcauagaauaaaaagaaacuccaagaugggagguagagacugucuauuugauuuugaauuguuagaguucauuauagcauuuauuguuguguuuguguuuagugaauaauuaauucaagugaguaguucaaagcugaaaacuaguggucauuucaaauagaagauaugggcucugaaaauuggugggaaaacaugauuuuauauauaacugucaacaucgagugcgucaauggggucccaccugaguguagccuuaaccaggacaggggguacacagccaagucagccagugcacacuuuauucagaguuucagcauguuuuauacagaaggcagaauacagaaagauucccauguuuucuccucaccaggugcuauuuaccuagcaauagcuuauuuugguuccaggugacccaaacguccuugcagacugagaaaucugucugcagucaacucuuagauguguugcuuaauuaaacuagaaacaaaguuccuuucucauaagaaaaggauggugaaggccacuucuucagguuugcagaagagaaagugugcguacucuuuuguuccagugugcugggauucucagauguccuuaggugccuagcagcuagcaagcugggagcagucugcucaugccuuuucucuacauauagaacauuuaaggaaauugaacaaaaguauauuguccuguauuuuauuuauacucucaguguauuaaggucaauaaggugaguaugaacaguucucuacucagaugguguguucuugggggaaguggucaauaacagaguugcaugaaucuuaaggcauuguauagccugucgaggcagaguaccuagaccuuaugcccuaacguuuugaagaugguguacucuuuguuuagcugauacuuuuuaacuuaauuucacugugcuuuugaugcaccauuuuaaaaauggaauuuaauguuuauauuuuguagaaaauggcucucucuacauaguaauggauuacugugaaggaggugauuuguuuaaacgaauaaaugcucagaaaggcgcucuguuucaagaagaccaggugaguuacggggaggagcuugauuccuacccaguuaccaagaagcaacucaaaguguaauucuggauguauucaucuggggggggggguuggggggagggguggggaguggagcaggggauagaggcucacauagcccaggcuggccugggacugccaaucaucccaccucuaccauuugagugcucagacuguagacuugugccaccacacccagcuggauauauucauucuuaccuauggaugcuaaugguaauugcuagggcaagcugguaucauaaaguaaauaaguagucaacuagagaacauuagcucagagaucuuuacuuuucuuaaaacagcagaaaaagaagaaucuauucaaucuacaugcuacauagcacuaaguccuuaaggugcacaccaaagcucaucagcaaauuuauaguuauaagaccagggcagucagguuucacaguggacacagaagcucaagcuuaacaauggccacugaaauccaguaacuuugguuauuagccuuugaucauuagccugccuccuguaggugaaucuagugagcccuuaguuaccuggcucuuuguucuauucucugacauuagcagaccauugauugaauaacuaagaauauguuuuucauguguguguuguacucuagguuuucugguacaaagcagcuggcaaaagauccugaccugauuuaauucauuguacuuuuauguaccuugaccuaaucuuuuacccacacauguuuuuuauuuuucucagaaaucuucacuaagucauuaaucugagugacauugcuuuuugggaaaccaccacuauuguuaugcauugugauugcauugcucagugagcacuuagaaacccccaccccaccccaaggauauucauacaagacaaaacacaaggaggccaaggcagcagcaagggcagcagcaagugcagcagcaagggagcuucugggucaggacucucgggcuuugccucucugagggaacucacugaggcuuuccugagauguuugcuucaggcuccaguacugaccucagcuccuccugcugugugccuaccgccaaucaauucuuuacauuuuucauagcugauuaucuuugcucuuuucugucuuuauucugacgcauuucucuuuaccacccaguuucaguuucuugcacguuuuuguauaggaggaugaagggugguauuuguucuuuuaacucuuaugacuuguuguauacggcccgcggccuauaugaaccaaguacaccuggaaggcagacuggggcugaaaaagacuuggacggcaagagagauuaauggagccaagauauucccuguucaagguucaauguuuaugaagagaccgugcuuauaagggggaaggcccauuccccacccccccagguccacucuuagugccuggagccauucuguugucagcacuugguugccaggcuucuugauguaugguugccaaguuguuagcacuagucugccaguuccauagguagucagcuaccucaggaacaucucaggaagacagguucagccucucugcagguagcagaagagcagagcaguugucacuucuaaaaggcaccagccaagucagaaagcugugccgcagguggccccaccucaguggcgacaagguuuguaccagcuucaggcagggggaggcuacaaugacuagauacuuuuucuuauuuaauagauaaggaaucuaagagaccuuaaauaacucuccccaaaucuuaucguagguuuugaaccuauuuauauuuaacuucgaaguuucucuuuuuaaaaagucccacuaugaagagcucagaaacagaaaggccuuuuucccugcugcucugucucucagauugcugcuuaguuugguguauguauucaccuuuuggcucuucuguaucuuuaagacuagagcaucaccucuggaguuauuaaguuacuugcuuuuucucuccuaccaucuuuauagccccaguugagcccucuaucuuuguuuguaaaugaaguagcauuccagcauaguuaaaucuauuugcuugcaaauaacuuauacuugcuuuauuacuuaugaaguugagguaagagaccauauggcuguuaagccuaaacuguguauucuaugcccccucuuuccuauuuuuguuguuguuguuguuuuguuucuugagacagcuauuuccuauguagcccugacaguacugaaacucacucuguagacccucuggccuuaaauuucagagagccaccugccugucucuugaaagcuaggaugaaaggugugugccaccacugaccacucucucuuacucuuuucauaaucaauuuccugaccccuaauuuaugaacucucuuaguaccuuugcaaagcuagcucuugcacauaucugacauugcugaguauaugugugucaaaaagaacagauaugagaaccaggcuagcaggagaagccugugaagugaagugaugcuggcgugguuuccguccuuguagcucucaccgcggguggacugccucagccuucucuucagcugugcuucucucugacccuccaugcuguuucugcacacaucucacuuagacacacacuucauugcagcuguggcugggucuccacgacucucuacucuugaagucauuuuucucuacucaaaaugcuuuugucauuacugagaaguacuuccaauuuuaugcuauucuuacucaguaaauaucaaaaaaaaagaaaaaaaauaagcagcuuuauuuagauuuaguauuuguuuuuguuuuucuuuuuucuuuuuuaagguuuauuuauguuuuuuaaagguuuaucucuggccuggaacaagugagccuucuguugccaccucaagugagggagauguucuaucagggaauuuauuuuaaaauuaauuuuauaugacuuuaaguguacuacuauuccuuaagaauaguaaaagaggggucgccggugcugcuuguuaccuuuuauuaucuucugucgacuacuuguauaauguuaagcccuacauacugguuuccuucucuucucucauuccuucugucuuucuuguacccauauaggcacacacacacuguaaggucaaaugcauaauuauauacaguuaagauuugauagaagccugugcuuuuuaaaaaauaguacaauguauauacuacuccgcaacuucuuguguugaguucauaauguuuagcuccauacauacagacuucauccucaguggcuucauagcacacaguugucaccguacaauuucucagucccacuaauggacguguagauuguuuaaguuaguauuuccucuguguuuauuguccuuuuuuccuuuguaucaucugucaccucuuguuuuagcgaccagcauuuccccagagauguaaaagaacuuuugcauguuggagauuagcaaauuaucaauuacauuuaagcauuuucucaaauuuuuauuaaaugugacucuauauuuugcuaugaagauguuuuaaauuuuauuuagcaaaguuaccuugagacuuuggagagggugauauuuucuuuguuguguuuuaaaaauugacccauauuuuauuugaucucuauacguuaaaauacugucuaauuggaauuacuuggucugaagagugagguagaaauuaaguuguuuuacuucuaaaugauaauucaagagaauguuuaugugugguaaauguguuuagagauauaugacauauguauucuaaauuucuauccugauacuuuuccuuuuguaacuucuauguauauugaaaaauuauagaaaaaagauaagcccaacaaacuuaucugccuauuaccaaucuauuagaaauuauguuauuuuuauuuuucauucuugagauuucuuuccauauuuauuuugcugugugugacacuuuuuaguauauguuuuauccauuuccguugucaguuggcuugaauaccuacuaguguuaguuucuguaaaauacaaagaaauuauaucuuaaacauuuuuaauccaauguuuuuucucuagauuuuggacugguuugugcagauauguuuggcucugaagcauguacaugauagaaaaauucuucaccgagacauaaagucacagguaugcucauuagagccuuuuugguuuuuggcacaggucucacaguuuuccucauuguauagcccaagcuggcuccaaacucucagugaugcucagauguuagcauccugagaacugggauuacagugugagccucuaugccaggcuguccugcucacucagauacccgaugucguaccccccccccccccccagcucucccacuuacucuuccaugcccuucuuucuggauugauuguuuggcuaugacagaauaaagaaauagauguauggaagcuaauuuuuuuugagauuuugcaugucugugguugacuuauuucucuaauuaaugguaauuuggauauuaauuucuguauaggagauuguuuuucuauagaauuagaagauaagauucauuuguuuugcgauauuaagaauugaauuaagauuuuuuuuuuuuuuuuuuuuuuuuuuuugguuuuuugagacaggguuucucuguguagcccuggcuguccuggaacuuacucuguagaccaggcuggccuugaacucagaaauccgccuuccucugccucccaagugcugggauuaaaggcaugcgccaccaugcccagcuugguugauuuucuugaaagauugcgugugcguuccucaugcugugccuugugugagaaucugugcauccuuugggggaguucuggagaccuuccuugucuggauuuucuuuuaaauggaucuuaagacaccacuucaaauguguuuuuuauucuuacauguuuuucucauuguuuuccuuauugaauauuaaaugaauuauuuuccccgauuaacugucugcacaucuuccuuuugcauuuuuauuccuaauagugauauugauauugauaguuuucuucuguagcuccuacuggucuuaaauucucccauucuugauuggaccucuggaauuagaggauuucaaacucauugccauaguuuuuuguuuuguuuucuuuuuuaaauuaauuuauuuaauguaugugaggacacuguccaaccuucagacacaccagaagagggcaucagaucccauuacaggugguuaugagccacccugugguugcugggaacugaacucaggaccucuggaagagcagucagugcucuuaaccucugagccaccucuccagcccucauugccaugguuaagcauguuuacaguuaauguuuugucauugccauuucaucaguuuuuauuuguuugagugucucacucuucagaccagacuggucuugaacuugcaucuuucuccuuaguguuggggauuauaggcauguacugccauccuaggcugaguugaauuuggagugaauucucacaucacuaaugauuuaauuggaugaugaugaugaugaugaugaugaugaugauaguucuuuaugucuagcugaauuuucccagguucuuuugugaaaaaugguuuuugguuuuucgagacaggguuucucuguguagcccuggcuguccuggaacucacuuuauagaccaggcuggccuugaacucagaaaucugccugccucugccuccugagugcugggauugugaaaaauguuuuaauucaaaacacaugccuauguaugcaagggccuacacacgugugugcgauuugaugcuggugaucaaggucugccccagccuuugcuuugcagucacucaguccagcccugucaguucccagcaaggguagagagaugagugagugcaguuaugucacagcccucccugacugugucuguccuuuuaccuuccuaggccugcagauggaggugcaguguaguguucccaggguacauggggaagagcuauuugggaccuucaugcuucaucucuucuacaucccgccccaucuucugcccccaaaucuguuuccccucauuuuacuaauucuagucaaccuaucucaucuuggcauuaaucgugugccugaugcaagucucaggacugauagggaauuucauuccuguuaccccauuaaauucuugcuuuuuacucuuucaaagaguauagaaauccgggggaaaaaggcuucuuuuuccuugcuaggaauauguuaauccuuaauacaugugcaugauagaccccagcagcacugaaguacuguaauuauaaagaaaauaucgccgggcgugguggcgcacgccuuuaaucccagcacucaggaagcagaggcagaugaauuucugaguuugaggucagccuggucuacggaaugaguuccaggacagccagggcuacacagagaaacccugucaugaaaaaaaaaaagaaagaaagaaagaaagaaaaaaaaaagaaaaugucauugaguaaacaguuuaaacuggaaggguguuucagacaccuuuaauuguauugcauuuacauauuauaaaauugaccuauuuaaaguguacagggauagauagcucauuggauagaaauauuugcugcuaagcuagauuaacugagucacucucuaggacccacacuguauaggaacagaacagauacccauaaguuguccucugacuuucagacagugccacgacaaaaacacacaugugcacacacacccccuaggaaguuuagcguuuacugacuuuaguguuuauacagaagugggaaaauauugucucuaauucacagaauauuuuucucuucaaauaagaacugcucaugcgcagucccaccucuuucuccuccacguagcuuuaguaaacacugaccuucugucuggauagcuguauuuaagugaacugcuaguaugugcuuuuaguuauaaaagauggauuauuugcugggucugguauuccacaccuuuaaucccagaacuagagagacaaaggcagcugaaucucuggguuccaggccagccuggucuacauaaguaaguuucaagccagcuaaggcuacauaguuugacucugucucaaaauuaacaacgaaauggauuauuuuucccuuuggaguuggguauugagacugucucuuguaggccagcauggccuugaacuuuacauaucacugaggggaucugaacuuuagaucucuuuccuuuuuuucccccauucuuuucaccauguggaucuagaagguuagacuuagauuguugucagacuggggcaauagguaccuuacccagcugagccaugucacuggccucauauuuauuuuauugacaguguuauaugauacacaaaaauauuuagguuuaacaaagucaauuuuuucuuuccuucucuuuaguuuuguuugaugucuaagaaaccauugccugacucaaaagcaggacaauuuauuccuguuuuuaggauuuuuauaguuuuaguuuauauaucuuauaauucauuuugaguuaauuuuugcacauagugagguagguaggaggauacauuuauucuuuuucauggggauauccagcuauuccagcauaauuuuuauuuguauuauuuuuucugaaaaacaauguugucuaauagagguaacuggacugaaacaauauuucuguuuguuuauucuuucuuuuucuuauagaacauauuucuaaccaaagaugggacagugcagcuuggagauuuuggaauugcucgaguucuuaauagguaacaacagcuuuaagcuuuguucugauuuaauguccucagugaaacugagucuuuuguaguguaauaugaaauaacuuauaauaucucugucuuaagcuucuuuaacaauuuuuuuguucuaguacuguagagcuggcucgaacuugcauaggcacuccauacuacuugucaccugaaaucugugaaaacaagccuuauaacaauaaaagguauuuaaagugauugcucaacauaugaucuguuucaaaccuuucugucauacgcuauauaguagccuugagaacaccacugaaaaaucaguaauguaugguuaguauaugaugaaggaauuguaaaaacacucuuccuaucucacugacagaacucaaggcagaaucacgccaugguuugguguaguuaggaagagaguacucagucccuuugguccuucucuuugucauaaucacuuccuacagaacuacagcuaaaaguauagaaugcugaguaguacugcauuguguagauguaccacauuuucuuuauccauuccucuguugagggacaucugggcucuuuccagcuucuggcuauuuuaauaaggcugcuaugaacauaguggaucauguguccuucuuaccaguuggaacaucuucuggguauaugcccaggagagguauggagugcuacucagcuauuaaaaacaaugaauuuaugaaauuccuaggcaaauggauggaucuggaggguaucauccugagugagguaacccaaucacaaaagaacacacaugauaugcacucacugauaaguggguauuagcccagaaacuuagaauagccaagauacaauuugcaaaacacaugaaacucaagaagaaagaagaccaaaguguggauacuuuguuccuccuuagaauugggaacaauacacccauggaaggaguuacagagacaaacuuuggagcugagaugaaaggauggacaaucuagagacugccccacccagggauccaucccauaaucagcuaccaaacgcagacacuauugcauaugcuagcaagauuuugcuggaaggacccugauauagcugucucuugugaggccgugccagugccuggcaaauacagaaguggaugcucacggccagcuacuaaauggaacacagagccccaguggaggaacuagagaaaguacccaaggagcugaaggggucugcaacccuauagguggaacaacaauaugaacuaaccaguacccccagagcucgugucucuagcugcauauguagcagaagauggccuuaucggccaucauggggaagagaggccccuuggucuugcaaacuuuauaugccccaguacaggggaacaccagggccaagaagugggagguggggggggggggagcagggcggggggaggguauaaggaacuuuugggauagcauuugaaauguaaaugaagaaaauaucuaauaaaaaaauugggaaaaaaguauagaaugcaugcuagaugcucaauaacgaagccaaaaucagagagagagagagagagagagccaucaauuucuuugaagugcugcagccaccuagcuuagauguaagcugcuaguggcuuauguggucugauauugaggacaguccccauaacuguacuccagugaccuuuuccucuuucccaagggaaagcuggcaaccaagaaacacuguuuaguuugcuguuguccuugauuguaguaaauuaaguuucucauuuugucauacuuuuuaaauugaguaaagcauguggaauuuuucaaaauaaaaauaaauguagccgggcaugguggcgcacgccuuugaucccagcacucgggaggcagaggcaggcggauuucugaguucgaggccagccuggucuacaaagugaguuccaggacagccagggcuauacagagaaaccuugucucgaaaaaccaaaauaaauaaauaaauaagugaguuccaggacagccagggcuauacagagaaaccuugucucgaaaaaccaaaauaaauaaauaaauaaauaacauaaaauaaauguaaugaauuuuauaccauucuuuuaaauauuaaauuucuuuaauaacauuucaagauaauuguuuaggcagauguuacuuuucuauuuaaaauagcuacuuuuuuaaucuaguuugaaauuuaaagguaaaauauacuuuauagaguauauauguucccccaaguucuuccauacuguuuguuuacuuuaaacgaguaaauaaauaaauaauuauauucugauuuuaagaggaaauuucucacuuuugucuucacagugacauuugggcuuugggcuguguccuuuaugaguuguguacacuuaaacaugcaguaaguauaaguugugaugcuuuuaaaguuguggugucuuuuuagauaacucagaaguuugauuuucuaaaguucaauuuuaaacugcuuuauucuuauuauauauuugcuguuauuauauuuugugcuuuuuccacaaacauuuuucuuuuuucuuuuuuuaauauuaauauuuguuuuuaauuuauuuauauuucggguguuauccccuuacccaguuugccccccucccggaacccccucccuauuccauccccccucucccucccucugugaggguguuccuccagccacucacccacuccgggccucccacccucaguuccccuacacugcagcauauauugagccuucauaggauccaggaccuguccucccauuaauccuaacaaggccauccacugauucauaugcagcuggagccauguguacuugcuugguggcuuagucccugggagcucuggggaggucugguugguugauauugcacaagcauuuuucuaugccagaaacaucucauucuucuucauguaaauucauuuacugugaauuuguauuuuacuucaauauuauuuauuuauuuauuuauuuauuuauuuugguuuuucgagacaggguuucucuguauagugcuaacuguccuggaacucacuuuguaguuaguuuuguuuuaguaaguucuuccaaaacacccguauuuagcugggugugauagaguugccuguaaucccaguccuuggaagucuaagggcagaugaacuguagguuacggccugucugugcuucauagcaagagucuggcugaaaaacaaagcaaaaaacuaaaggaaaagcauugaaauucuuugaguuuguugcuggaaguuauuuaaagaauuuuauuuacugugacaaccagaguuguuuuuauuaaaaaauaagcugucaagagaaaaaguaacaguguguguguguguguuugugugugugugugugcgugugugugugguauuggaagugaugcgugugcuucacaaugugggagugugcacaugugcugugugugagguugaagguccccaagguacuccauggucaauguguagagccuuugcuugauugcucauugucuucauuuuuugagacagguucagagaaccuuuuugugaacuuuagggaucuaccugccuguacccauauccuaccacauaccuauucuccagggagagaguacagaaccagccaucuuugauguguguucugugguucugaacucacaucucuauguuuauacggccugcacucuaccaacugaauaucuucucagccucuuaucuaggcauucugucacguuaaguauacuuauuuauaauuuucaccauuagcacauuuuuuaaauaguauaaaauauaccaagagggagauuucucucaaaauauauuuauuuguaauaacuuuuucauuuuuugucuucuuuuuaaagcauguuuccuuccugaugaaacaauacuguauuuucaucucagagaaaacuuuagaaaauacguaaaauuauaaagcagggaauaaguaccauacgcaauacuaacaagaaacaacugcuuauauuugauacuuucuucuaagcuuuauucuaacuuaauuuacaaauugaauuacucuucuucaagaauuugcuuauauuauguaacuuacuguucaauauuauucgaagucugucuuuauuauugcuuguugauaucuucucauauuuguauaaauguguaugcuuagaggucagaagagugcauuagaugguccugagcuaccugauauggaugcccagaaccaaacuaagguucucuggaagaacagaaagaaagcccuuaacuugccaaaccuccucucuugcuucuucuuuuuuuuuuuuaaauaucugcccgcaugaacuucuacuauauuguguuaauuuuuuccccuaauauguuucuacaagauugaauggacuuacauuuuuacaaacagaaugaaauaacuuucaaauguucuaggagagcuuaacauuuauuuaggagugcauuuuuuauaauuaucauaacuuaucguagauguuuuguuuucuucauguguauauugagaacauaccaagauucguacagcuuuccuguuauuuuaacagaaauaucaaagcuaauucuuuuccuaauauaaaaucuauaaucauauuuguguauaucauugcauacaguuaauggauuucuaaugacauuucaucuuuuuuucuuuugcuucuauuuauuugugugcaaaaugcauaacaugguauuuacuauauaagugaacucaugcacauuaaauacaugaauaaaagauauaugugauugcaugucuaaugucauuuuaugugaaaauaguaucaguauaaaugugaaauuaaagauaauauauuauuuccauuuaacuuuaaauuuuaaauauuaaauauuuaagauacauacaagauacuuaaugcaaugguagaaacauggauuuaaguaagcugauagauugccauauauauuccagauauuacuugauaaaaauaauacgauguugcagauauagcuaagacccuacuuccuauuauuucuuucuucuuuacagaaacaagcacuauucugaagucagggugucaccauaucaaguaauauauguaaauauuacuuauauuucccagccccccucucuguauauaugcguguguguauauauguauauauacacacacauacaugauauauauguauguauguauauauauauaugauauauauauauauauauauauauacccucauauguuaaacuaucacuuuauaauucaagauacugguuuuuauaucuguaaugaugauacaugaaauccugguacuuuuguuaaauuuaguuuucuacauagcagaguggguggguuggagagcagggggaggggggaggauaggguauuuuuggaagggaaacuaggaaaggggauaacauuugaaauauaaauaaagaaaauaucuaauuaaaaaaaaagaaaaaaaccuaauggaacuuaaaaagaugcuucuucccucaaauaauuaguaccuugcaaguuaaaaguaaugauguauuauuuuauguacuaucaacuaauaaaaucaagauggaguagaaagcuaaaagaaaaacacuuuuucuaguaggagcaaaaguugguaccaaaauuugcaaagcgauuucuuagacuccagcagaguuucagagacuuauuuuuguuuguuuguuuuguuuuguuuuguuuuguuuuguuuuucgagacagggucucucuguguagcccuggcuguccuggaacucacuuuguagaccaggcuggccuggaacucagagauccaccugccucugccucccgagugcugggauuaaaggcgugcgccaccuugcccagcuaucagagaccuauucuuguguuagacauuugaaaccauugauauaugucuaacuuccauaggaaaaaucauucuuuaaauagguaguugaagaaucauuuaauuuuuuuaauaggaaaaaaaugaaaacaaucuaccugaauaucccuccacagggcaauguauaaguacauaaaguuaacucauaaaauggcauuuuaucuuaauggcacacacauauaaucucagcccuugagaaacagagacauggggauuacuucaagauuuuuacuaguuugaucuucaaauugaguucaaucccaugcaggccuacauaggccucuaaaacagacauuuuauccaaguagaauaugauuuaccuuggccauacucacccucccuuaccugcccucuuccuucuuccccacccagcuaguccucuaacuucccaguuuugcaucagcugcucuguguguguguguguguguguguguguguguguguguguguguauguauguauguguguguguauaagagagagacagagacaaggaaagagacagagaaaucuaguuugugcuuguggaaaaaaauacaguauuugucuuuugaguuuugcuuauuuuacuuaauauaccagucuccacuugcauauauuuucuuucagauuauauaauuuccuuauaccugaaugaaauguguuguguauuuguuuuaaauauaauuuaugcuuugagaaucccauacauccgugcaguguauuuugauuguguuugcuccccacucccuccaugauuccucccaaauccacuucucaauuucccucccaacuucaggcccucuuauuuucuuuucauuuuaauuaacuuacgaaguccaauuagugaugcauucguccauauaugugaggccacucacugcagcuugauugaccuaccacaggggcauacauagcccuauagaaaacugacuuucugccuuucagcagccaccaacuggcagugauucuucagcuaggcuggggcuuugugaucuccuuccuuuauguacauauucuuuuuuuaaaaauuaauuuaauuuuuuaauuagauuuuuuaaauuuacauuucaaauguuauccccuuuucugguuucccuuccuaaaagccccuauccccuccaccugcucaccaacccacccacucccacuuccugacccuggcauuccucuacacuggggcauagagccaucauaggaccaagggccucuccucccauugaugaccuacaaggcaauccucugcuacauaugcagcuggagcuaugggucccaccauguguuuucuuugguuggugguuuagucccugagagcucugggguuacugguuaguucauauuguuguucauccuauggggcuacaaaccccuucagcuccuuggguccuuucucuagcuccuccauuggggacccuaugcucaguccaaugguuggcagagagcauccuguauuugucaggcacuggcagagccucucaagagacagcuauaucaggcuucugucagcaaaaucuuguugguauaugcaauagugucuggguuuggugacuguauaugggauggauccccagauggggcagucucuguauggccuuuccuucagucucugcuccacacuuugucucuguaacuccuuccauggguauuuuguucucucuucuaagagggaccgaaguauccacacuuuaguguuccuucuucuugagcuucauguggucugugaauugucucuugggcauucugagcuucugggcuaauauccacuuaucagugaguacacaccauguguguccuuuugugaugggguuaccucacucaggaugauauuuucuaguuccauucauuugccuaagaauuuuaugaauucauuguuuuuaauagcugaguaguacuccauugugugaauguacuacauuuucuguauccauuccccuguugagggacaucuguugacauacacuaaggcuaauuccagaguuucacuuuugaugaauaaguaugucuguaauaugccuaaguagauuauuugagguauauucccaggguuauuuuugcuaaacuauauguuaauugcauuuuuauuuuuuuaggaaacugugauauccauggaggcuagacuuaauugacauuccuaccaauagcauaugagaguucuuggccuaacagcauuuguuguuuucucacugauagccauucucacuaggauugaaaucccaauauacuuuugauuugcauuucccuggugcuaauaguauuaaacauguuuaaucuuuaguggccauugguacauacucuuuugagaacuauugguucauugcauuuucccauuucaugaagucuuuagauuuuaaacugucccaccuguguauucuuuuuauuucaguuacaguuuauuuuguguuuaauccuaaaacacauaccuucuuauuaauauugcucaccccugacccccguuggaucgauuauucuuugggaagccucaccuccugcaauaaugauggacauggccuaagaacuaaguaguuaggaguucucuuacgucuuuccuuguuucauucaaauguuuuuugcucaguaguuuauuuuuugcuucuuguuguuagagcagaggcagagaaagcuaggucuuaaaugaagacuacuugguugcauaacuguuuaucaucuggauuauuguuacaucuuguaaaauauuaauauuuacaccuuaccucuuggcauguugcauaaacacuuagauuuuacuuuuauaauaaauuauauuauuuuacuuuugugaaggcagucuuuuaaaauuauagguaauuaaguaaaguuuacaaaaagcauacuaauugcauuacuuaggagaggguuguauuucuauucuguauuaaugaaaaagcacuguugcucauuacugauauuccccauuccuguuuccuaucuguuuuauaaaugugcguucacuuucuggauuuuaguuugaagcuggaaacaugaaaaaccugguacugaagauaaucuccggauccuuuccuccagugucuccacauuacuccuaugaucuccgcagcuugcugucucaguuauuuaaaagaaauccuagggauagaccaucagucaacuccauauuggagaaagguuuuauagcuaaacgaaucgaaaaguuucucuccccucagguaugugucacauuaccccuaacguuaaacuguaagguucugguaccuaagacaaggacuguggugaucaccacagagccugggcugggaugcucuccuuagccugcauuggcagugcccuuuccuuucccacuguuuauaacggaaguuauuaaaccuuccugugcuucacguuucuuaccucuuaccuguaagcuaugagcucagggcuguaccaguauuguagaguggcggcaagaauuaaacaauaauguacuacagugcuuucugucuaauacauacugcucaaaguccuuaauaugcacuaucaacauauaauugguuacacuagguacauauaucaacaaaauuuacaugauuaugguugucuuugacaaggugauuggaaacuaugguuauaguuauauggcaaauauagucuaguaugguuauaguauauggcaaauauaaaugcauauacuauauugcuguaucgcauaauuuuuccucuaguguucaacauaggugcaaaacaaauauuuguggaaauaauuuauuugguagguuuuauaaaaaaauuugucagaucaaaugccaucaauuacucaaaugugaucaccuaaaauuggaauuauuugacuuucauguuuaugguagccuauauuaauuuaauccgcauuuaauucuuuuguaaguacgauagguagcaagagcauaaugauauagcuuauaugugcuucugguuuaacagaacauuccagagaacaaaugcuauucagaaaacaagacauguucaguuagcuaacuaaacuuuggaaguccaagauuacuuguauaaaacauggcaacaaucucugaaaugugguguuuuacaauacuucuuuguuaaaaauaauucuuucaaaggcuguuuagauguaauguacuguuauuuuuuggcagcaaccagauaagaaacaaaagcuucauuuaaucuuauugaagcugccuccuugccagugucguuagaccguagucucaagacuacaacacugcaauucaccuuccuagcaaugaaagggagauguugaagccuuaguuaccaaacauacugugcaaaagggagacagauuaugguuaauaacaaauagaguaucugauaacauguguuugguauauuucgccccuuccuuacugguauuuaagcacuacuuggauuuacaaaaucuugcauuuuguuccaaagaaagaaagagagagagagagagagagagagagagagagagagagagagagagauagcacaaauuuauguuuucucaccauggagcccagcucacugcaagcuuaugauccuucugcuucaggcuuaugaauuucuggauuacaagacaacuuuuauuuucaauacaauagcuuuuguuuccauuagccaaaauucguggggcccaguucuuauccuuguauacccuaauagcaguuuccugcauguggcuucacaaauuagggguaggcuuugacucauuaggaguacaguuuuuguccauuauagcugucugugaggaagucugccauaucugaauaguccaacaucacagcuuuuggucaccuguugaacacuuggaaugugacugcugugacuacagaacuaaguuuuaagcuuucaaugauaaguaagcuuuuaauucagauagccacaugcugguaauggacaacauucacaugguauuccaggaucuucuugagcgcuguauauuccaucucucaauuuauauaaacauuuacauagaaaagaaagauccauauuugaagaacugaagauuuacucauauugagggcaaauuggagaucauaaaauacccauugaccaggccuaggauccuauaaaaauccuauaaucucggcugcucgggaggucuugaggcaggaaagaucccgcguuuaaggcaagcuccaauuuauggaguccguaucucaaaagugguguuugcaggcugugaagagugcucaggauguagguuauugguagagcacuuccccgaguauguggagccaggagucaggaguuucgcaggacacagaacagaugccucuguuucucuaaaaagugggaaaaugccuguguucagaagagaccuuguucucacauacgugcccugaauugucuuugaaccagacuucugcucauguuugucuucugccgcacuaagucucaaacacagaacacgcaguccuagaagacuuugcuggguucauucacuaccuucucagccucagugacugaggcagagccagaaaauguauguguaccuauaggauugauggugugggcuugagacuucaguccugucauaggagaucuucaguaggaagaaaauaaucuucucagguuggagaguugugccuauuggaugucuuuucuacuguugaauauucuuucuacugagcucuacuucucuggaaaaguugagaaaauucauuuagcauuuccaccaauaagauaaaaaauagcucagauugaguuaaaucuuugauaucauaauuugauugucauacugaaaaauguaggugaaagagaaaauuacuuguggaaaguguaaaugcuuguuucacaaaauaugaaugcuaaauagugaguaauaaaauauuuguaauguuaaaagagacagacacugaaaaugucuauccagugacauguuugcagaugagugucacucaugucaggugguaaguugauucacaguaaauuuaaauggcauuuccaagagagcaucuuuugaagugacacgugagaacuuuugacauaaaugaggccauggaugcauauagaacucagcggucccuccacagauaaaguuuuuguuaaguugcuaagauacaaaaaaggcaaguaacaugcacuguguauuagucuagcuugagaaugaaagacuggagaaguaauaaaaaugcguuaguaagauuagcgggguaagcaguuagcaagagaagaguuuacuggcugcauuacuggauuuuaaucaguuuauuuagcgacguuuaugauuggaagaaaaauacacaaauacauugugacugaugggcagcuuuuuucuuuguuuaggaaacagauuucauuuauuuuuauuuucuuuuauuuauugauuuuuaaaauuauuguaaugaacuaucuuuuuuaaauuucuuuuuuucauuuauucacuuuauauaucaauuauugcccucaucccuagucacucucucucacaauuccuccucccucucaguuucccccucccccaguccuuuccucauccccccuuucuccucugagaugguggaggccccacccccaccccgcccccagguaucuccccacccuggcaugucaagucucuacaaggcuagaugcauccucuccuacugccagacaaggcagcccaucuagaagaacauuuccuacaaaaggcaauagcuuuugggcuagcccccacuccauuuguucgggacccacacgaagacaaagcugcacaucuacuacauaugugcugggagaccuagguccagccccugcaugcucuucaguuuuuggcucagucucuaagagcccccaagggcccagguuaagcugacucuguuggucuuucuguggaguuccuauuuccuuggagggcccucaguccuucccccaucuguuccaugagaguccccaagcuccauccaguguuugugggucucuguauccuucucagucagcuguuggguggagcaucucagaggacagcuuugcuagacuccuggcuguaagcauaagaguaucacuaguagugucagggauuggugcuuguucaugggauggaucucuaguuggcccacuuauugcuuggccacucucccaguaucugcucugucuccuguuccuacaugucuuguagacaggauagauuuugaguugaaaguuuuauggaugggucaguguaccuauugcuccacugugguuuuugccuugcuucuggggguggcaucuucaaauucuacauccccaugcuuugaauaacagcuaaggucgcccccauugauucuugggugccuccccuuuuucaggucucuggcauguccucgaguugcucccuuccuccccacccccaccaguugcagauuuccauucauucucauggccauuugcccaucucuucugucccuccccacaccugauccugaaacaccccccauccccgcucccagccaguucccuccuucccucugccuccuaugacuauuuuauucucccuucuaagugggauucaagcauccucgcuuaggccuuccuucuuguuuagcuucuuagggucucuggaguaugcaugguaccuguaguuuauggcuaauguccacucauaagugaguacauaccaugcaugucuauuuaggucuggguuaccuuacucaggaugauauccucaaguuuuauccauuugccugcaaaauucauaauuuguuuuaaauagcugaauaguaucccauuguguagauguaccacauuuucuuuauccauucuuuuauugagggacaucuagguuguuucuacuugcuggcuauuacgaauaaagcagcuaugaacauaguugaccaagugucccugugauaaaguggggcaucuuuuggguauaugacaagcaaugguauaacuagaucuugagguagaaguauucuuaguuuucugagaaauaaccaaauugauuucaaaaguuguacaaguuuucacucccacuagcaauggaagaguguuccccuuguuccacauccuugucagcaugugcuaucauuuauuuuuuaucguagccauucuacguggaaucucagaguuguuuugauuugcauuucucugaugacuaaggacuuugaacauuucuuuaaguguuucuuggccauucaagauuccucuguugagaauucuuuguuuagcuuuguacuuccuuuuuaauuuauuuauuugguuguuguuuuguuuauuuuguuguugcuuuugguuuuuguuguuuuuauuuuuuucaaggcaggaucuaacgauauagcacugguuguucuggaacucgauguacuaggcuggccucgaacucacagagcucugucuacccgcucuuccuccauaguucugugacuaaaggugugcaucaccgcacucagagugauaucuuuucuaacauuuucuucucuuucaaucuaagcuuauugcagaagaauuuugucuaaaaacacuuucaaaguuuggaccacagccucucccagguaaauuacauuucacaugaaacuuuucaucugguuguaauacucaagacuagauaugcuacuauaaauagagaaaacaaauugggaugguuuuagaauaaauuuaaucuaaaguaaauauuaaauauaguguuguacaauauaagaguuuaaaaaguuuuuauuugcugucuuauuuagaugaaaucugacuugaaaaucuuuaccaaaguuuaguugaauuuugagaacauugucuaaaauauaaaugucucacuaagguguaaauuguuauguaaaacauuuuucuuuaagaaauauuuuauauucuaaauuuuuaaaaguaaauuauugagaggucaacuauuuuacuacagguaaguuuuauuucaauuuugaccauuugauuggucaugcuccuacuguaucuagagaacucauuuuuuaaauauauucacagauagcugcuacuaugcuuuauagaggugugggugugcgugcucaugugugagagggugcauguaugggcacauugcuugcccacagcccagucuugugggagcauuuauuucaguugagguucccuuucccaaaacgacucuaguuugugucaagguggcauaaaacuagccacauaaaaaaacacaguuucauaaaaguugacuacauuguaugacuaaugugugguuauaaagaauuuuuuagaagaaacauuauuccaauuuuaauaaguacuuucauguuuugauauauuuucuugucauaacaugcucaaugaguuugaauaagacuauauuauaaacaguuuuuauacccaacauaauauagugaacauuuucuaauaaauuuuucuuucaagaugaauuuaauguuagcuuuucauugugaucuaccauuuaauuuuuucuuucuccuugugaaaaugaaugcuuuuugaaagagauugauuuaaauuauauuaguacauacuaaaaauccugaguuauagagggggcuggaaaauaaagaaagcagcuccucgggcuguggggagcuuaaccagagggaccuuuacagaaguggaaaacaggaggcgggaaaggguuggauuagccauggggguacaggcuauuugacuuggagguuuuuaauugaaguuuaucuauuuucuggaacuuugggggggucuuagauuauucaguucuugugacagcuucauaggaugcauuuuacauauauauauauauguguguguguguguguguguguguguguauauauauauauauuuuacuguacaauuuauccagagaacucaauuuuuuaauauauuuacagauaguugcuacugugucccacagaggagugugcgugugugugugucuguguguaugugugugucugugugugugugugugugucuguguguguguguguguguguguguaugcuuauguaugugaaagggugcaggucuggguacauagugagccuauguguaugccaaagaacaacuuuaggaaucauccucagaaauauccuuccuuguuguagagcuaaccauuagguuauacuggcugaccagcaugccccagggcucugacugucucugcuuccccauuaaugagacuauaaugucaugccacaacucacaguuuuauauggcaguuuuauauguguguuaaggagcccucaugccugugaagcaagagcuugccuauggagcuaucuucccaaaagcauuagcuuagaauaguuagucuuauuuuuuuuuaaaaaauugauauuugcuaaaaugaaaaugaaaauguaccauccuugaagacuuuggcacuaaagauucaaugaaaagaauuacuagaaaagaauugcuugucuuuucauguagguaaaagaccagcaucaggacaaggugucaguucuuuugucccugcucagaaaaucacaaagccugcugcuaaauacggagugccuuuaacauauaagaaguauggagauaaaaaguuacuugagaaaaaaccacccccaaaacauaaacagguaagauccuuuuacaaacugcuugguaucaaguucaucaugaccccguucaauaacagcuccaugaguuaucuugauacucagaguagucuuuauuuccuuccuaaggaaaguuguucuacuucauccauccucucuacuuaggagccuuacagaagcauuggacagccauuaaguaaauacauugaguaaacaaccaguguaauaaaauguagcauuauaaaugaaggccuucuugaacauuugauugcauagaaguaagaauaauaaguaaguaacaauaccuuugguauuguuguaaaauaguagaacauuuguguaucucagaauucacagucaaauaaaucaaaaucuuaaagcagauuggacaccaacagauaugugaaggaagcugucuuuguggcacugcugaaauucagcuggaaacugacaggguauagguacaacuuuugcaagguaccugcaggagugagugacacagugucuucccacaugcuucacuaacagacaagaagcacugggcaggagagacacucguuccuucuguagugucuccuucauuaucugcuuaugugcagugagcaaaggaaaauuguuagcacgccuggcugugguaguggaagcagggcuguauacaaggguaauguaacuggcaugcuggcuuuaucuguuuuauuuuuccuacuauggaccagugccaucacauccuuuucucucuuuggucaucaaaagaaagccaggacugaagaccuuccuauuucuugaucuuuaaauucucuaaggcucugaucauacccuaaucgucacaccucaauauuacugauagaucugaucugaucugauccuccccuccucuccucuuuuguuuucuuuccuguuuuguuuuuuaaaagaauuucucuguguaacccuggcuguccuugaacuccucuguagaccauucugggcuugaacucacagagaugcaccugccucggccuagaaugcuggaguuaaagacacauauucacuacugccagacaggucuuugguaguuuuuaaguucuucaacuacguaguuucuuauaugccaaaccuuuaaagauaauacucgcucauuuuucuuuggaacuuggcuugucccuaaacucucuagcauucucauguggugucuuuuuucuaaaacuggaucuagguagugugguaaugcucuccuuauugacaguagacccuuccugcuccaguguucaugauuuccuucuagacucugcauuaccugcuucugagcuguagaagggucaucugcagacccauguucuuuuuacagaguuuaacaucugacucacucacaguuuucuuuauauuaucauaauuuuagauggcuucaggacccccaaaagaugauauaaugcauacauuuuauauuuuugcucauucucauuuauuuaccuuguuucucaccuuacuguugagcauucagggaauauccuuacuccuguaaacaugaacucuauccuuccauuuguuccaaaacuccugguagucaucacugacugcucuuuugguacugugugcucuuagcaaugcuuucacaauauagugaguuguuucuuaucacuucuucugauuuaguucuagccacuuugguucucacauagguaauaaugucuuaacugguuuucugcuuccaugguuugagggcugagaagacugaaccacuguguuagagugaagcucaguuuuucaccucagucaacggccucuuggcaaugggaugcuccucagagcccucugacagccuucugaccucucagagccugauuuccuacuucuuccaugcugguggacggcagcccugagcgaaaccauuuuuuuuuuauuaucaacaugcucagugcugcuugaaaaaucauggauuuuuuuucuugcuguuuucuuccugugauaauuugaauaagaauggcuaccauaggcacauauaugugaauucuguccgcgguggggaggacugcuuggaaaggauuaggauggauggccuuguuggaagaggugugucucugggggcagguuuugaaguuucaaaagucucaugugauuuccaguguucucucucugccucaagguuaugcaccaagaugugagcucucuguuguuucugcacucuacucuguccaugccauuguggacucacacccucugaaaccauuacccaaauuagacacuuucuaagaugcccuguucaugguguuuuaucacacuaauagaaaagaauaauaaaagauaacuaaagacaauaucuguauucacaauucacuuugugauuauaccguaucaauaauagccaccucuuucccacauuuguaaucuauguugggaaucuacugugcuuuguuugucuccacauuauuaucaaaugcuuguuuguuuaguaauaguguuucuccuaucucuguguauaaaccucaggaguaugaagguuuuauuauauuggucaccaaaaauugccacugaaaauauauucugaccuguaauaagcuuucuauacauauuuauugaauaagugaauaaaugagugguaacuuaggcaucacgucacuuugagaccuuaguuuuuucaaagaacugauauccaacaucuuagugaaacucauguuagaaaaaucaucuucucuuuauuuguacuuuuaguaagauuuuguuuuuacuuuuauguguaugauuguuuugccugcauguacguuugugcacugcugcauuugcagugcccaugaaaaccagaagacugcauuggaucuccugagacuagaauuacaaaugguugugagccaccaugugggugaugggacuugaaagaagguccuauggaagagcaucaaaugugcucuuaacuacugggcugucucuccuguccuuccuaucauuuguagcaaguucaugaguacugagaaacaacuggagacaaaaugauaauaguagacuuccuuaaucacaccagagaauguuaugauaaaaucaaucauaaaaaaaauucucauuauuuauuuauuuauuuguuuauuuauuuauuuauuaguuaguuagaaaagacccauagcuugcuaggaucauuaguagcuaaacacacuaaaacuuaauaaaaucucuuuaacuuccuauuauaaucuaaaaauugaaauuauuagauuagaaacaggcucuuggaaguaaaaauguauauacuagauccauguccaaaguacugcuguguaaauuccgugcucgcacuuaggugauguggaacucucaggauuccaccuuuuccugcuccuagauucagcauagcagcuaagugggccucucaccaguuacugaccaugcccuguaagcacguuguccucucuuuuguuugaucuguucccuccccuccuuuugaguguuuuuuuuugccuuuuguaggcccaagucccuucaguaucgcacuguuuucuuauaagcccuugccggguaaaauacuuauguucucaucgcuuaucauuuaacuauggaaacaauaaaaucccuugagggaacaaaaaccuacaggagccacuuguuuacgaugagugcucuagcuuuaccuucuagauuaacaaauaggaugcuggcaucauagccaaggacacugucacauuggcagcaguggcauuuauguuuaaaguuucccagugaucaaagggauagaaauguuauaaauaugcuaauacucuuuaccacagaccuuuuucauuuuuuuccucauggucuucugccccugccaauggacaauaggacaaaucuccuuaucagaacuucuucaggaccuuauguauauucuucuaaugccauguuuauuagaaugucaucuuuugggcaguuuuauacauguuugcacaaaauggcaaguuucucaguuuuuuuaaaugaauaaacgauugaaugaauuaaauuccuauuaggaaagcaauccccuuuauuuucuaacuauacuaaauaggaugaaaggacaaauaaaaccccuacuuuuaggcacaacuaaaccaguguucuuugagauguuccuucguggguaugguauauaauguauguguguaugugcuguguauaauauauguguguaugugguagccagccaucaacuucagguaccuucugucccucuacacuuuauuucuugagacagggucucucaggaagccagaaacucacuauuuugacuagguuacuggcccacagcuucuaagguuacggauaaacaucagaaagccuggcuuuuguguggauaaugauuuagaguaaguauuucagcaucuaguaauaaauaaaaaacaacuuuugaaauagauucuuugcauacauagauaauuugggugauaacaacuugguuucuugugaagcacauugguauuugaaguuauuuuaauauaaucaugucauuuuuuuccaugaaguauuuggauaaaucugaaauugacuuacugugcuuuugacaacuuugaaaaauaaaagaagggagaaacacauuuucaguauccaaacaaugccuuucuuuaagcaaauucuauguauuucacuuguugucaucaaaauugcauuauagucuauugcuaugaaaucaguuaaguugacuucacugcuacaaauaugcuuuuaaaaaauuuuauguuccauaccaaaauuucuuuacaaacauguuucauuuuuuauagauuuuuaaaaaaauauuaauuaaaaguaaauuuauuucauagauauuuucaagaccuauuuauuccaaauaguauuuacacaugcaaccuauguuuaacaguuguaauauagacaugcauagcuugucugauuucuuggggauaaaacucauauuggccauggguaaaagagggcagacauacuugugucuuuaaaucaauaagaaauacacacuugugugaaccuguagaaauagacuuguuuuaccucuuggccacacacuagucuguaaaaaagaaggaaaugggggcugaauuaauaauaugguaaaggucccuuauugaccaggacugaaaccaugugguuuuuuguauagcugauggacucaaauaaaguguuuuuauuaaugcuuccuucauuuucaguuaguauuccauguacacaagcugcaugcaguggaaauuuuguauuccuaguacuaauauucagaauaauagauuccaccugucauaaccugagugauggagaaacuggcucagaugauaaaggcuaccuacuggcuuugggguuuuaggcaagguuaucacuuuuuaaauuguuuuuugguucuguuauuuuugggaccgggucuuucuguguaauagccuuggcuguccuagaacucaccuuguagaccagccuugccuggaacucauagaaaucuucuugccucugucucccagguguugggacuaaaggcaugugccaccaaguccaccacuuucugaauuuuuuuaagcaaauaagccugauuuuucuaagccaacccauugaaaacuaaauaguaaccaacacuugagaugugccauaacuuguuuguaaaagauguaaccuaacacaaauucacuguacaacagagacuauuugcuugaugacacagaacauacacuugcagugguaaaaaggauuuuauucuguauauuuuacuacaacaaaagagaaucgaaguaaaguuaugaaaauuuuaaagaauuauagaaacaaaacauagcaaccaaauagauaggaaaccugucaagcgucauaccacagauauagacugaggaagcagcaaguuuugcgguauuuuaguuuucugaagcaggcuuccacagccuccucaucucccagaacccuugcucuuucuuucuuccugaagagcugagguggugucagcuaguagcacacugccugacugggagauaguaagugccuauugcucacuuuucuugaaugauuccuuuuuaaauuaguuuucuuaaaaaaggccacuucccugaaaaacuaugaaacaucuuuuauauugagauuugcaguaguuuaugggagguuggcauauuuucacuggaggugcaggcauuucuuuaaggcugcugacacuaagccaccagagggagcugcaggagcauguguuagcagugggcucacuuucauuuguuuuuguuuuguaggugacagaaaccagaacaauuuccuuaguaugguauuucuguguaucucuucaguguagaaauagcauucugaaaguaaucagaugaucucagagggccagcuuggcauuuuaucccauaaauacucucuauguaagacaauagagaagaucaaauaauuuauaacccaucgauaauaugcagccaucuugaacaccuucuucuugggcuagucgacucacgacaaagucugacaaccugaauuugauugcugcuggaggaggggagucacuuuucuuugggugugugcccuuaauauguugcuggugauucauuggcuagacccccccccacacacacaugggcauauauggguuauuagacucaguuauaaaaacaaaaaagagaggaaauugaaauagguauguguguugauggggacccaggaggaauugguggggagagauaagaaagaauguacauggcucaaaaucauguuggggcuuggugauacaaaaaguguuagaggugagaauuugggaguauacaugauaaaaauguacugaauacauguuaaaaauuuaaauauugaauaaaauaauuauauauauauaauuauauauugguuuuucaagacaguguuucucuguguagcccuggcuguccuggaacucacucuguagaccaggcuggccucgaacucagaaauccaccugccucugccuccugagugcugggauuaaaaguguacaccaccacuaaauuguuuuuaaauaaaucauuaaauauuuuaaaaauauguugugaaaacaaaacuaguuugaugauaaggagcccauuuucaugauuucuuugagggucauauuccaguuucuuuagugaaaggcauaucaaaagguaguacaacaaauuuugaaacauuuaugaccguauuggcuuuaacuuuuccuacuuuaaacuuccacaaauuuguaauuuccaaaugagugucuugccuaauuuaucuaauucguagcuuuauuuuauuuuauuuguccaggcccaucaaauucccgugaagaaaaugaauucuggagaagaaaggaagaaaaugucugagguauaaagacacauguguguuuauuuuaaagcuuuucaaaauaguucuuaagacaacagcaaacccacuaauguuauagagcagugcuucucaaccuaauugcuuugacccuuuaauacaguuccucauguuguggugacgcccaaccauaaaauuauuuucacugcuacuuucuuacuguaauuuugcuacuguuaugaaccguaacguaauaucugauaugugaccccugugaaaaugucauuuuaucuucccaggggucacgacccauagguugagaaucacuguuacagagccucuaacccuuuccaccuuguuucuuucaaauauuuacaauaucuugcuuucuucauuucacaucuccuuauuucuuuuggugucacucucguguugauauauuuucuugaugaaaauauaaaaaguagagauuauuaauagagcugggcaguaguggcgcacaucuuuaauuucagcccucuggaugcagaguccagcagaccucagucugacgccagccuguucuacaaagcaaguucaggacaaucaaggcuacacagaaaaacccugucuuuaaaaaaauauauauguauauauugauauaaauauucuccuuuuguuuaaggaagcagcaaaaaaaagaagguuggaauuuauugagaaagaaaagaagcaaaaggaucagguaguuguuugccuuguguuucucccuuugccuggcuguaggggauaagaaccggguucugagaaaaugucugaaacuguuacagauuagguuccugaaggcugagcagaugaagcggcaagagaagcagcggguaagagaugucuccacagugcaucugccccuccccacacgugccuuauuuaaggaagcacacugacuuguauguuauugcuaaauguauucuauauguuuuauauuaaguaguugaaaugguauuuuguuuauuuuucuuuccccaaaaguuggagaggauaaauagggccagggaacaaggauggaggaauguuuuaagggcugguggaagcggugaaguaaagguaggcauuugaucccaaucgaguaaacuguuguuugucuacagucuccucuucuguaaaauguguaugacuuucuucauguaccaauaacauuuaucuagaauucuguagcauuuauuaugcuuuauuccuuaucuguguauauuuaauauguaauguaauaauaaacaauaauucgugugugacauuuauaaaaucgguuaaaacuuucaugugguggcuguaauacagauuuuacccccaagggaauuucacaaaucaaauacaaaaucaaauaugcucauuagaacuuuucacauaaccuugaaaauuaauucucagaagauuuccuuaacuggccacugcuagacucuccaggauagcuguccccaccucuauggugcucuucugccccacuucugcugagcagcaggacugacuuccuaagugugugcacugcaccugcugauucuccugucuuccacuuacucuccuuucuccauugccagcuccccucuuuguccacugccucucugccuccauucuuuuaccuggauagccagucaccucaacagccauuuaccuaguuucuuugguucacauguucccuuuaggcaaaugugacucuggaaccuuggagaacuuaacuguuuugaguuuauuuucaaagcccagagcuucccugcuuucucagaaaugucuucagccauccuuguucugucagcugccuucucccccuuugcuuucagaaguacaggccuguauucgauacucauaagcuuaauccugaaccagucccagggauucccuucccuaggaugugcacccugcguucccuccccuuggguucugaguagaacuugcugaugguagcuccuguuacuagauuacauuaugugauaaaggggcacucccgugauuacacugacagagcgacuccuuuauaggagacuggaaagggaaaagaagcguaggaacaugugucugcugaccuggacgguagccaccagcauggauguggcaagaaagcauagcuggcuucuggauuauaacugaucucuagccaguaacuaaggagaaacgacucuccuagagccagagagcucugagaugcugagccucagauaugaauguagcccccucugacuuagagcuuaauauaccuaccuaaaucauauaccugccuaaaccagggaauuagauaauaaaccgauauuguuuuaagcugcuuaguuuggagugaguuuuugcacagcuguaggaacggaugcauauccuuuguacugucauuuuucucuugacagugagccagcuguugcucagcuugcaguuaaacugucaauucacaugucuguugcucgcacuagccucucaguguugaaguagacaagaggugguuuucaaaauggacugcuaaccauucuuguuucuucucucagaguuaugauguggacaaaaguauguuuuguuucuuucaccuguauguauagauaugcauauauauacuguccucaauuuguguuguuuccugucuuucaagauguuucagaaauucaauucgaaucuuuuuuuacaagucaguacuuagguaaacgugauauagcacuguaaguacuucaauuuuauaugaguaguacuuauuacuuccuggucaauaagcaguaacucaggauuuggugcaugguuuugcuuuuguuuguugauugguugcuuuuucuuuucuuuuuuuuuuaagacaaaaauuuaucuauuuuaugaaugugaguauacuguuucugucuucagacacaccagaagagggcauuggauucuauugcagaugguugugagccaccauguggcuguugagaauugaacucaggaccucugaaagagcaaucagugcucuuaaccccugagccaucuaucucuccagcccccaguuucuuagcuuuuuaagacagacuuucucucuguuacucugacuaucuuggaacucucucuguagaccuuggugcccuugaacacaaagagaucugacagccucuaccucccaagugcugggauuaaaggugugugcuaccuggcugaauuugguccaugguuaaaaauuagcuuauucugaauugaacuguaggccaggacucuuauccagcauuugugccaaauucaccaacacuauugagaauuugcugguugcuuccuuacuccuuuaaaaacauuuuuuaagguuuauuuuauuuuauaugugugaguauuuugccugcauguauguaugugcaucacagcaaucuauuggucucaaagguccgaagagggugucacauccucugggacugguguuaugagcuaccauaugagagaugaacugaacccauguuaugugcaagagacauuauuuuuggauaguuagguacugugucuuuaauaacacuagcuucauuuuauagaauucuguuaugcuucuaugauaagaaguaaauucuauuaauguuuauaccuauuccuaaguuuaaaauauuuacuaugucagacucuuugauuucugcauaguugccaaggacauggaguuacaguguaauaugagucaaagaaauucccaaaguagagauagaugaaaacugaaaaugaagauaauucaauguuuuauuauguauagacauuguugcucaaaaguauaaauagcugacuuuauuggacaguugcaaaguccaagauuucuuggcuaggugccacugugccuggcugguugauguuuucaauguguugcuuauagauucuuuuuuuaaaaaaaaaaauacauaauuuguaccaaguuuuaucuagugaucaugauacguaagaaguguaccucuuguuagaagauacaguguaguguuauucauuaguaaaaaccuguuuauacauaaaauaacauggaucagcccauaaacaugcugaguuaagaaaaauagacagaagaguacauauuguaugauuguauucauauguaauuuuagaaaagacaaauccacaccauagcaauagaaaggucagugcuuugucauugacuaaagagacaugagggcucuaucuugaaguaauugugauaauggcagggauuacaugaauaaguauguucaucaguaccaucaacuuggugccuaagagguugcucagugugugaaggugcuuaccaccaaucccggugaccugucugggaucccgaggaucacauacuggaaggagagagcugacuccuguguguugucuucugacugccacacaugccccguagcauccagcagcacaaauguauaaacacaaaugaaaugcuaagaauguccaucagcccaugcuuguaauugggaagauuuaauuguguacaagcuaggccucuguaaaggugaguuuuagaagauuguguugcuucagcauucugacacaguauuuuuaacauuuuguauaaacaucuuuaaagaugcuuacuuauguucacuuuacuagaaagaaauauaagaauuauuuaaagucaaggucuuaccaucgaacagaguaaucaguuguguagaugugacuaccuuuuagcagaauucuaacucuaaaaugaauauuuuuuaauuucaauuuuauaucuguguaugugcauguggagguaagucuguggguggagaccagaagaagguaucagaucuccuagcacugcaguuagaggucaucgguaguggugagccacugaguauguacugugaagcaccucuuacccacugacccaucucuccagccccacagugcauguucugaggaugugugugugagaagaccacugggauggagcguccacuugguuaucuuccugauuucugccaacuuauauccugucacuucaauaucuguuuuguucauuuguuugguuguuuucucuguuucuguuuguuuuaugaggcagguuuucucuguauaauagccuuggcuguccuagaacuuauagaccagaauggcuucagacucagagguccaccuuaccuuugccucucacaugacacagugcccagcuugaacugauuuuuaaaguagacuuucucauaaaauuuuauauauaguaucaagauguuaagacaaauuuacucucauuggacuuggcagaauuuuuuuuauuugauucuaaaauugguuguuuuauuuuguuuaguuuuguagagggagaguuuugagauaguauuucucuauguagcccuggcugucccagaacucacuuuguagaccaggauggccucaaacucaaagauccaccuggcucagccuucucagugcugggauuaacaguguccaccaacaccaccuagcuuuaaaagguaucacucaacuuacucagcucucucaacuuaaguacuaugagaucauugauuguuuuucuuucagugaacuucugcguuuaucauucagucauuucugcagaaaacacacuagucuguugagcauuugccucuucauugacaguagucauucauugcugucugucauagagcagccccuaguucugcuuuuguuucucacucccgcuuauguguguaguauugaugaucuuaaaauguuucagcauacuggaaaguuuauuucgugaaugcauucucccaggcucgauaucgcuuagcuuguaacaccuuuucuuuucauuguuuaaugcucugcuuaucuaccuuauaaguguguuuaugauggcacuuuccuccuccaccuauugaagcacacacaaaacauacauauagcuuauuuuaguuaccuugacucuuuccuugucuguuuuuuuaaaagauuguuaucaagacuagguuaaacaauaucuuucuccaacacuuuaaaaguaaaauauauuuuugccuauggccaucuuuuuuucuggugugugaaucuacuuacuacuucauaguacaccuacuucauuuauucauucacaguaugucuagaaugcugguuuacuuuuguggguuuuuuccaauuuguaugaaaaauaugaugaguaggaauguuuuuccucuucuauaugauauaaaauaaacuuaaaucauguauuuaccuucauaucuacuuggugaacagauuugaguauaucaaaagucauaugcauaguuaauuaaaauuuuagcuaugauauuaaauucugcuugacuucaaaaccacauauauuuaaacuucacaaaaguuauucaugaaauguaggauauuagcauauuuuaaaggcuucauaguuaagcuaagguuuuccacaguuaugugaauuuaguuugucacauugaguuauucuuuacuguuaguagccaagaauacuacugucugauugcuuauguaagaaaaccuuuuacuuucggccaugcguuuaccaauauguuaaaacuagguaauuauuauuuuuaaguuaagcauugaaacugacuuuuucuuuuaaggauggcucaggccucuuugguccucuagaugaacauggcaugugagagcucuuuguuuauucccaggcuuccuuuuuuggcauuggaggggcugucucuccaucaccguguucuccucgaggccaguaugaacauuaccaugccauuuuugaccaaaugcagcggcuaagagcagaagauaaugaagcaagauggaaggggggaaucuauggucgauggcucccagaaagguauggcugugcucugcucagguugccuaugcauugcuucagagaaagccaggaaagucacuguggcuauuugucugcagaggaguuccaccuggaguucguccaggauuucccagugaggcuucaggucacuaccauuccccugaugcuggugcuauuaggaaaacucugaaaagacugaaggccgugucuaagcaagccaguacaaacagguuggccugugaugauccaugauccauccugugugcuuuugucauuugucauaccuacacuuguagaagguuuuucccaaugucuaacugaacauuuuugcucucuggguauaaugaaucuucaugugcaaauuugacccuugauuuacacuauggcaaacguguagcucuuccauucagccugauuauuguggcuuauuuuaauguuuagacagaacauacuguuuagaagaucaugagauaacuaucugccaacauauaguuguaauaauuuuaucuacuugauuugaauaaaucauagcaugaauuuaaauagaaucacacuuuucauaaagcuccaaagcacauuuaucuuuugucuuuuccucauucccacuuuucucuugguucucuuaaaauguuuccucuucucauucaucucugauuuauaucucuuugugaucuuucaucagauuuuuuucacugaauuaauuugaugguaauugacaauagcuuauauguauguccuaauggcauaucaauuauauuagccucuuaccauugacaccuuaaacuguguacugcuacuuuuugaggagugauuugcuucucauuuguguuuuuacacugcuuuacuuucuaaauccucuccccucuacauuucauucuacaaggcauccuuaaguaggaaggagcuuaguggauacucuauugcuuucucaucccuagaagcccuuucacuguucuacugugccuguaaacauggugauucacuuucucaaacuuucuuugucauuuagacuacugccuauuuuuaugguauauccaccuugugaaauacuuguaaucaucuuucaaaauuuuuaaauuuuucuuaaaguaauaaauuugaacauggauauaguguauggugcuccaccaauaucuugcuaccucucaaugucuuuacaaaaagaaaggaaggauaaucauccaccucuuugcuaagguaaacgacaaggcuugacuuagagaacugacucccaauaaagagcaccaugacuguucuccaucccugucccucccuuagccauggcuguguuaguggucuuguuccuguucuaucacaauucuuaacccaucugaacuucuuuguauguuacuccccaaucuaauuuccuacuaucuauuugugggucgaaggccuauaauucuguuaaucucaggccauguuuuacugauucucggugcuuuaaaguaucuuuguaucugaacuuuuuuuuuugagacagggugucuuagucaguguucuguugauguuaaaagacaccuugaccaugacaacucuuauaaaggaaaacauuuaauugggguugacuuacaguuucagagguuuagucuaucauggcgggaaacaagaggucaaacagacuugguacuggagaaguacuagacaaauagcugagaguugaacauuuguaucugcaggaacagcaagagagagccacugggccuggcuugggcccuugaaacuucaaaucuaccuccagugacacacuuccuccuacaaggccacaucuucuaauccuuucuaauagugccacucacuaugggcuuguaggggccauuuucuuucaaaccaccacagagggcuucucuacauagcccuagcuguucugaaacucacucuguagaccaggcuguucucagacuuagagagaucagccugccucagccuccucuaagagcuggguuuaaagaugugugccacaaugcuuggcgacuuuaucugaauucuuaauagaguuuaauggagaaaaugaauaguaaguaaauuauuuucuccucauccccaugagccuucuacaaaagaugauaacuuauguuaaguaccagaguuaaucaaacucugauuuucauuggauaaacuuuauuucccagaacuguguuucagcuauugucauaguuaggguuacuguugcuaugaugaaacuccugaccaaagcuuacacguccauagcauaguucaucaucaaaaggaaggcaggacaggaauucagacaggacaggcaccuagaggcagaacugaggcagaggucaugaagggaugcaacuuacauacuugcucagccugcuuuguuauagaacccagguuuagucccacccacaaugggcuggguccuccccaaucaaucacuaagaaaguaccuuacagccagauuuuuuucccaauauuuuuuaaauuuaauuuuauuuuguacuuauucucuuuacaucuagcucaucgccaccaucccagucacccacuuucacaaugcuuuccccauccccuccuccccuucuccucugaguagguguggggagagggggauaccuggcacuucaagucucugcaaggcucucccacuguggccagacaaugcagcacagcuagaagaacauauucuacauauaggcaacagcuuuuaguguagcuccuauuccaguuguuaggggacccacaugaagaccaagcugaacaucuucuacauauguguagggaggcuuagguccucuuugguuucugguucagacucuugagagccccaagaguucaggucaguugauucuguuggucuuucuguggaguuccuauccccuuugguauagucaucuuuacaucuuccaaaguacacuuuuaaacauauuaggcagauagugucauguguacacaaucagugugaaaaaucuaagucaaggcugcuauacauguuuuuagugagguacuguucaauaauucuaguaguguaugcuaauugguguguuuuacuggcaaacacugcacauagaccacaaugauaaauauauuuuacuucuaugauaguugaugucagugucaucaugaugcugagagaucggagguuuuaucuaaugacagauagugguguauacuccaagacucucagaaagaaccuuaccaaguaguuauacauuucuaaugucaugucugagcauuguacuugauacuuuaucuacugucuuuggcucuagcuuacauacacagggagguucagggcauaaugccaucuuacguggguauaugcagaggcaugcugaguucagaccagcuccccuuaauugaucucaguuuuauaguguggaauaugucugcuaggggacagcauaugugcacuucagagacaugcacaaaucucuuguuauuaucaaccuacccaagcuagcauagcuuggguuucagaaaucucaugggggacuacaguaaccaucuggaauagcugaacaucagaguaauuggcucuuaaaccaguuacagauauuaccuaauccuagaaaauuccuaucaugggaauucuaaagaauuucucuuaaguaacaugugagaugaaggacuuuagaucacugucauucauagagauaaaauaucguagauuuuuuucuuucaaauauuuguguguguguguguauacacacguaaguguaggugccugugaaagucauguguguuacauccucuggaguuggaguuaguggagguguucagccaacucacauggguacagggaagagaacucagguccucuauaaauaaaguagcaagugcccuuagcuuuugagcgauaucuuuugcucugcauuucaaguuuuuacagcuacauuucuuacuuaaaauauuuuuuauguuucaguuuuuugcuuuaaaaaaguugaagaaaugauuauuuauggaaugaaaauuagaaauuuuaaaauguuuacugggaaacagaauaggcauuauuucaugauuucuuauuuuucagaauauagaucaguuaguuauuuuccaaaaaaaaaaaaaaaaaaagcuacaggaagguuauaugccauacuagccacaguccaaguauauagaacacagacagcaacuugcucaacuuucuuacucauccccaagucuaaccacguuugaucucgugcugugaccuccucucuccucacugggcuggguuacaucugugcacauuugugucuaucucccguguuucucacgcugacugacacagcauggggcagauguucagugaguguuuaucaccucuucauuugcugucuauauacucagcauauuuacauucuuucguaguagucaacgaaagaugcugaaaugaggugagaaaagacugaaggcaaugacugcugguacuuuccccuaccuuguccauuuuacugucuguaaguaagaugaaucauaucauuguaaaaugaaucuugucaagaguugaagugcuguuaagaacacacacacacacagacacuucuucacagagaauguauauuuuauuucugcuuucauauaauaauuacagguuuaauguggaauuuaaugcugaaaauugcugacucugugauuuguccaaauuaggcaaaaaggacacuuagcuguagagagagccaaccaaguggaagaauuccuacagcguaaacgagaagcuaugcagaauaaagcccgagccgaaggacacgugguaugauauuuuuucuugggauuuugaguuuaucaguauucagaguuaaggccuggaaugaugugaguguaaguaaaaagaauugugauguagcggucugugcacaauaaaagauauugaagauguucaaaagcaaaauauagcuuauguuuucucguauaucuuguucauuaaccuguuuucugauaucuuuuauugauaucuuauauaccaaaguaaaauuacaucaucauuuuacauuauguuuucuaaaaaggaagaaauggguauaaaaauauaaauauuaauauuagagauauuaaguucuuaaguugcuggaaaauuucccaauauacuguuugauuuaauauuucuaaguagcaaagaauuuuagggaaaaaagggauaaauaaauguuuaagugaauacacacacacacacacacacacacacacacacacacauuauaguauuuguugaaaagcauguuaaaaccaaaauaauuaaaccauccaguuaagcaaauuacaaaacuaacucauuuaucuaaaaauauuaaguugugaggaaguuggaagucucacuaguucuuagcugcagugcccaaguguguuuugguguucugucaaagcaacugaggauggcuucuguccucccaucuccccguggagcuucuauuccuguagaucaugcuucaagguauauuuuuagacuuaucacauguguauaaaaugccauaauugguaacugugaauuuauuaacaguuauuuaauauaaguuuuuucuuauauuuucuuaauuauauuauggaaaaauguuaguuuuuauuauucacucuauauuuuuaacacucauacuccaauuuacuuucuuaauaauguggaaugaaucuguauuugugaccuuccccuauaugggagaagauaauuucuugcuuucuccuuuucuucagucuuccuauuaauagcaucuaaauuucuuauugcuuuuuuaaaagggcuuuuaaacugcuguguagccagccuaggcuugccucaaacucaugauucucaugccugguugggcgcugggauuaauggugugcaugcccauucucggcucugguuguagguuauuauuaguuaaaauaguuaccgggagcuggagagauagcucagcaguuaagagugcuugcugcuccugcccaggcucugaguuagggucucagcacccacaucagguggcuuaggagcuccuggaacagcaccuccaggggcuccaacaccuuccucggccucugcagcacuguacucacuugcacauacccacagagacuggcacacacacucaacauugaaaauagaguuuaaagagucuuuuacauggugauagcuaguagaacaacagagacuuucccaccgcuguuuuuugcuuaauccugcgauuccaucaucaguuuauuuucuucauguuggagaauguucucuggcaauuuucuuuauaaagacauuuucuaaaaucuguugggaaaaugccuuuuuuuuucuggcacuugaacaauacauugugguaacuuuaaccugaauuuguaguucugaaaagcauuuggccugguuuuguuuuguuuuuguguuuuuauguguauguuuguguugugugccagugugggagcaugugugccugggcggcugggcgggaucacacucugguucuccugcauacaugguaagugcuuugacuguugagcucuccgcagccugguuugugagagauauuuugcuggggguauucuguaggcugaggacuguugaucugggaugccuccgccugauaccuuggguguaguauucgccuuucccucugacucuggaaagguuuucuucuuugugccuggaagcaguuugauuauuagcuaacuaauguagguuccaauuuuucaucuacuguuucuucaagacagaugucucuuauuuucuuccuuuaggcuguuaguauuagcgugcuugcgacugcgccacucauuggugcuuccauuuucucuguuuuauuuugagugguuucugcugcugugucaggaacauuaauccucuacaguauaaaugcugcucaucucaucuagacaugauagucuucaugucuuacuuccuguucuguuuuuccagagcuagagaugaaagcuggaucuucucauguaggccauugcugcacuacucagcccacauucuguuuuuuguuaaauagcucaguauuggcuuggguguuuuuauaguuuuaguuuccaucuuuauaacccuauacuugauucuaccuugaaaauacagaacgucauuauaauagcuguuuuaauuuucucacaaauucugucucugcuauuucugggucuuuguugauugaauaagauuuucuuauuuaaagaaaccuugcccuaguuuuacuguguuugcuguuaguaugccaagcacggugcacuuuaccucaggggguuauuaacuauuuaggggcuuuaguuaauuauuuggaaauaauuugacuugcugcaggcugacuuucaagguucccugagguuguaaagaacuguguucucucucaugcuaacuuggccccuuugauuacccuugccuuacugguucugcgguccuucuagucugccugcugcaaacaugagagucacagucugguuaggcccuggugucauuagcuuuugccacucagugagagacauaagacccucuucacauuuccagcacugcuucccugugcggcuuucucuccuuugcucucugaccacaaguaccagcagccugcagcuugcacaucccuaaugauguuuccucagcucagggacggaccuugcagcucuguuccagguuccggccggacaugaagugaggcagucacugggcucacccccuugcuucccuccccauuguuauugguguuugaaaacucacguuuuccuuguauauuaccuaaauuuuuaacauaauauuaguguagcuuuaaucacauuguucugucaaggcuauaggcauuuuuuuuuuuuuuuuuaguuuucuuuauuucucagaauuccauacauguacccaaugaaaugugaguggauuuaucccccaucuccccuauacauucccuagcacauacccucccaacuuugguuuuuuuuuuuuaguuuuuuuuuauuagcuauuuucuuuauauacauuucaaaugcuauccugaaaguuucccaugcccuccccccgcccugcuccccuacccacccacuuccauuucuuggcccugguauuccccuguacuggggcauauaaaguuugcaagaccaaggggccucucuucccagugauggcugacuaggccaucuucugcuacauacgcagcuagagacacgagcucuggggguacugguuaguucauauuguuguuccccuauaggguugcagaccccuucagcuccuugggugcuuucucuagcuucuccauugggggcccuguguuccaucuuauagaugacugugagcauccacuucuguauuuuccaagccucauaugagacagcuauaccagggucccuucagcaaaaucuugcuggcauaugcaauagugucuggguuuggugacugauuaugggauggauccuggguagggcagucucuggaugguccauccuuucgucucagcuccaaacuuugucucuguaacuccuuccauguguauuuuguucccuauucuaaggaggaacgaaguauuuucuuguguuuugcaaauuguaucuuggguguucuauguuucugggcuaauauccaguuaucagugagugcauaucuaaugacuucuuuugugauugaguuaccucacuaaggacgauauccuccagauacauccauuuguccaagaauuucauaaauucauuguuuuuaauagcugaguaguacuccauuguguaaauguaccacauuuucucuauccauucuucuguugagggacaucugaauucuuuucagcuuccggcuauuauaaauaaggcugcuuugaacauaguggagcauguguucuuauugccaguuggaacuucuucuggguauaugcccaggagagguauugcgggaucuuccuguaguaguauguccaauuuucugaggaaccuccagacugacuuccagagugguuguacaagccugcaaucccaccagcaauggaggaguguucuucuuucuccacauccucuccagcaucugcugucaccugaauuuuuaauauucgccauucugacuggugugagguguaaucucaggguuguuuugauuugcauuucccugaugauuaaggaugcugaacauuucuucaggugcuucuuagccauucuguauuccucaguugagaauucuuuguuuagcucugaagcccaauuuuuaaugggguuauuugaauuucuggaguccagcuucuugagcucuuuauauauauauuggauauuaguccccuaucugauuuaggauugguaaagauccuuucccaaucuguugguggccuuuuugucuuacugccaguagcaaucuacacauucaauacaauucccaucaaaauuccagcucaauucuucacugagauaaaaaaggacaauuugcaaauuuaucuggaauaauaaaaaaaccuaggauagcaaaaaguauucucaacaauaaaagaaccaacuuugcuuuuuauugacucacuaaauccaucuagcauugccccuaugugcccauguggggcccucuaguggagcaugggaaaccuagcuucaauaaagagucucuucaccugccaauaguuccucaccaagggguagaguagggccuggagagaucauuuaugccuacaugauuuuacaaagguauuguguggguagccacagcugcugugaguucaugaauucuacagccaugucaauccacagcagaggcuaaccaccucucuauugcugcaacccuuuaauacaguuccucauacaaguauuucuguugcuacuucauaacuguaauucugcuguuaugagucagaauauaauaucuguguuuuccaauggucuuaagugaccccauugaaagggccauuguacccacaaagggggucccaacccacauauugggaacugcuguucuagaagacagaugucacagcgcuuuucccguccugacucauucuuuccacugccucuucuaugauguucccugagccugugaccuguuguuguuguuguuuaaagauuuauuuauuuauuuacuuauuauauguaaguacacuguagcugucuuuagacaucucagaagagggcaucagaucucauuagggaugguuguaagucaucaugugguugcugggauuugaacucacgaccuucggaagagcagucagcacucuuaaccgcugagccaucucuccagcccccuauucuuauuuuuaauuaacugaauuuuaauuaaaauuuucuauuuauuuuuuucaaaacaggguuuccucuguguagcucuggcuguccuggaacuuacuauguagguuaagcuggccucgaccucacagagcuuggccugccgagugcuggaaucaaaggcaggcgccacuauuacccagcuauaaaauauauuuugaugacgguuuucuccucaccaccuucuucaccucccuacccauccaguuguagauguuucucucucuuucaaaaaaccaaaaacacuucuuucauaaagguucugcucugugaagaagcagacauuugaaggauuuguuuaacuuacauguucccuuguuucuuccccauuguucuguggggauucugcucugucaucuucucucacuguugauaauggggcgguguuuuuuggaucauacuccccuuuaagcagcuguuucucuuuucugauaauuccuaggacugcuguuuuaucccugaggcucugagauguaaccugauuaucauucacuugucaagucuuguuuuuuccuuggcaggauaccgguucucacugguguguggagaucucaguagagguguuuaccuucaguucucagaauauucucaacugacgaucacccuaaauacuguuucuuuaaaugcuuaucuuuccaggaaaacugcugucacccgagaguguagccugcgcauguaauaccuuccuuccguccuucuguucuguccuccccucauuucugcugcgcuccuccaggcuucuugauuuuccagcucacugauagacuuagcucgaagcucagcuagucaguuuguuuuuacuucaaaacuuguguuuauaugcuugugaauucuaacuuguuuucccuuccagcuucuuuauucccuucucauuuuccugcuacagucucauucuucgugcaugacucgcuguauguuacauugucuagaaugcuccuuugccaaugaaaauccauccuuucuaauucauuuuacucaaauuuuaaggacacaggcagaacgcagccagauuuuuugccaaacauagaaugauugccuucuagccuacuuccuacugaaauccuuauucacuucaccuccugacacuucaggagccuggccuuuccucucugaguuucucccagccuucugcuguuccguacuccugccugcauuuuucaacuaucacuguucauagccuucuggggcuucuugagcccacagcuacaacucauucauguucuuccgauaaccuauucugaaagccaugccaagugaaacaccauggccaaguuuaucaaugcaaccaucccaucucugacacuaguuuucuguauauuuuucuguucauugugaccaaauaccugaugagauuaauuuucaaggaguagagauacacuuuggcuuacuguuucagaugacauaguauguccuggugagaaaggcuugugacgguugcuuuuuagauuuugucagcaugaagcagacagugagcugagcaaugguuuuuuuuuuuuuuaaggaguauuauguuuuuccaagauaaaucuauuaauucaaaacuccuucauuuucuuacuaccuagguguauauguauaaaaccaccuuagaaauaugauugugaauguuuguagguuucauuauguuuggguagaucuaucauguauuauauuuguagaacaaagcuauuuucaugcaauuugggaagaguaggaauuuguaaucagguguuagauaagaauauguauacuaguauauuaugcagaauucuccagcaaaguauauagaaacauuauagaguaugcaucuauaaaagagaggauuuaauauaguuacaaaagcugaaacguuucuguauggaaguuuguaagcuagagaagcagugacacaguaggaaccaaaagcauccagacauaggauauuguuaguguaguccccaugaucuugcagagacccaagagucccguggaaaauuaacugguucaaguucaaguucaaagacugaggaacccaaaacaaaagaagcaggacaugccugcuuuagaagaaagagccagagaaauugauugaaugcuuccccuuccuuuccuggaugucuuuuuagaauuccugugcucauaauuuuagacuuuauuggguauaauaggugagaugugguaaaggucaauuguauauacuuuauuuuuuaauuuuuuaaauuuuauuuuaaauuuuuuuaaaguauugggguuuuuauuguuugguugguuugguuuguuuugguuuuugguuuguuuuuuuguuuuuguuuguuugguuuguuuuuuuuuaagacaggguuucucuguguagcucuggcuguccuggaacucacucuguagaccaggcuggccuugaacucagaaauccgccugccucugccucccaagugcugggauuaaauuaaaggcaugcgccaccacugccuggcuaauuuuaaauuuuaaauguguauguguguaggucagagaacaacuuaguguacaccguucucucauuucuacccuuaccuaguucaggaauuuaacucagguugucaagcuugaagagcaagcaucuuugaagacucaucucaccagacugagacgauuuguauuucagcuuuaagcucccaggaaaauagaccuucauggagauuuccagucauauucugccaccaaauaugugcagagccuuccacauuaccaauauucuguaccaggcuguacauuuguuagaaucaagaagcccacacugacacguuauaaccauucaaagcauaagguuaauguuaagguucacuuuuguguuguccauuugguaggucuacauacauauauaauggcauguggcuaccaugucuugucacacagagcauuuucccuaccuucagaggagcuacuugcuuguaaguacuggcuuuagugaggauaagaccuacucagcuuuccacacaagaguuucuuuuuagguugacuuaugguauaauuuauaucauaauaaaauucaccagugcuaaguaugcccuauugaguaauugacauaugcauauaaucauguguacacugcuuuagcguguugccaaacauuucuaccauuuccccaguuuucuuuugccccuucaaaguugaucacucuccccccccccccccccccccccagugaucugcucccauuccuuacaguucuggcacuuuuuguagacauugaaaauuaugaaucauauaguauauaguuuuauaugacucacuauuuagaucaaacuggccucuaacucacagagaucugccugccuuugcuucccaagugcugacauucaggguauguccuaccacaccuaaccauauuacuucuuuuuauuccugaguuacauucuuuguguggcuauaccacaauuugaauauccauuccucuggagagggccccuugaguuguuucuggggguauaauuuggucauucaguuuacuaauuagacacaugcccauauaauugacugcccaucuccuuuguggagccuguuuucuguguugacaugucuccucaugugcaccugagcuguuaucugugauuauaccuucaaacagcacuggagagaaucaaagcugugacaguuaugcuugacacauuuacgauuugcacuuugagcauuuuguuaucuuugauggcauucugucauuauuugggguccuuaugauaauaauuaugcacuaucccuucuuaacagaccuucuuuaaucauacuuuccuaaaaccuauaauuacauuucuguuucucucaucauuaacuacaacguagccagacucuugaaacgugaaugaaguucauuuguuuucaguuccuuaccuguuauuucagcuguaaacaguugucaccacaucagcauauugaaagaagucacuguacccauucucucaaacuuaugcuguuuuguuguuucuauuugauuccuuuugugguaugagccgaggacuucccaugagcuaaauaauaaucauugagcucuaccgccagcccaaacagagcuuugugaucuucaucuuacuugaucuuucuaugacaucugagcaugagcuauaaaauuucuuccuuaucuucugcaguuucugcuguacuucucugcuuacagucucuuagcauguucuuuuauguaguuguuauuuuuucucagucuuuacaugcuaaucuucuuugggacuaaauccuuaguuguuucuuacuauauguaaugaucucccugggaauucuaccuacagcggugugucauguauguguaagucagccuacucccuagcauucugacccuggccuugcuccauucugcacauucauuucuccagacugcuuuggcauuucauuucucuugugcuuucuuauaagugucauauauucuuuuauuuucacucauguaugucugugggcauauguccugauacaugucagugccuugggaguccagugagggcauuggauccacaagggcuagagcuaccagugauugcgaggccccugacucugagaaccaauguguagucuucaucaagagcaacaagcacccuuaacugcugagccgucuccccagcuccagcacuuuguuuauugacauuugcuuuguaaauuaccaggaaauaagaaugacuuuauuuuuucuucuccaguuuuaugaauuuuaauacauauauaugcaugugggcaaguuacagaaaaacucccaccaugucccaaguuuuuggguuuugugguuguuguuguuauuguuguuguugugguuaauucccuuuucuuaaaagaccuuugugugggggcuuaauuaggguugucugugugucuaaggguuugcuguuacucacuggaguauggagaccgcaucagugacacacaacugagccaagucugcucuucccucagacuccaucagcagcuuaguucagcauggcuuagucuuuucuguuccuuuucuuuuucagauaauaaugugccacaguuuagcaacuuuuaacaauuuacauuuauuggcuccuaguuuuugagaguuagaccauuugucuagucuccuguacucccucacaaggcaguaaggucaguaguacuacauucauaucugaaaacuuaacugggaaaggguuuuacucccaggcucauucauguuggcaagaaaauuaauuucuuuaugcucagugaaugaaugaauuucuuuaugcucagcugcuugcuacagucuugguuaagguuuuguugaugucagaauuucaacauggccauagcaucucuuauaaaggaaaacauuucauuggggcuggcuuacaguucagagguuuaguccauuguugccaugguaagaagcaugaagcacacaggcagacuuggugcuggcaagagguauaugugaguucuacaucugaaucagcaggcagcaggaagaaagagagccacugggccaggcgugggcuucugaaaccccaaagcccaccccuauugacacacuucuuccaccaaugacauaccuacuccaaaaaaacccacacuucccaauagugcccacucccuaugagccuauggggccauuuucauuuaagccaauauacucccuaucaacuggaaaugccucuuaguuuagaggggccauauauguucucagaggucaccuuaaguacuuuaguacaugagucuuucccacaugccuucuguuaucaaacaacugcagucuauguagagagucugauaccaaugcaguuucauuucuuuuuaauaagugcuucuauaguacuucuaguuuuauccuuuuauuuuaagguaccugaaugagagugagacauuuuguagugaauauauacuuguucauuuguuuuucuuuuuugaaaaucuuaccaaaugaccacuuuuaacguuauuauuaacaguauaauuuugauaugucuggaucaguuauguuuuaucauuuuauauuugcuuuaucuauuuuuguucuguuuuuacucuugcuacgucugaguaauuuuuaauauucuauuuuaaucaacccuaucauugugauuguaucuguauucauguagcuuuucagaagugauuaccucaagggcucacaauguauauagacuauuauuuuucacaauaugcuuauaaauuauguuaauucaguagugugauggcuaacuuuacuuaacgugacacagcuuaguuaccucugaagagucucaaugagauauuguccacauuggguuggccugugggcaugucuuuaugggacugugguaaguuaauugaugugggaagacccagcccacuguggacaacauuauccccuagguaggaagucuugaucucuaugagccuaggaauugagcuaagcagcaagcaaaugaacaugaguguauuucugucucuuucugcucuugacuguggcuaugaugugacuugcugcuucaagcucuugccacugugacuuuuaugcagucaugagcuauauaaccuggaauuauaagcuagaauaaguuuccuuuucauugggaccuuuuauuauagcaaccaaugaaauuagaacagaugggaauggaaaaauguugccacuauagugguuccuuuacucuguccuugcaaccaggacaugcuguguguguguguguguguguguguguguguguguguguguguguguguguguguguguguguguauguugcuagguuauugaacccaggaguuugcacgugcuggacaaacacucuuucacugagccauacuuucagcccuugauuauuccuuccuauugccuuauauauuuaagaacuaagagaaaaggaacauuuuccauaaugauuguucccuuccauccaauuuucuaagcuucuuauaucuuuucugucuaaaauuccuguuuauuuacucucaaccuugaagaaauuuuuuuuaaaauuuauuauaaagaauuuguaaauaaaaagcaucacuuagcaaaauuaaguagacuaaaagucugucagacacaaacacagagccagagagaaccaauuccuuuagccguguuuuauuaauugguaauauuuuaaugaaacagucccauguucuuuaggcagggaaccuaguucugagcaagacccuucucuccuggcuucccagguggcuugaaucacagguguggaccacuguaaccagccaucucuucagaacaguucuucuaacuguaaauucucuccaucuuacuuuguacuaagauaucuuaaguuugucuuuauugaauggucucauuuauaaauccaguaucuauauugggcugagaguuuauuuauuugagaaauugugauucaacuaauuuuuauucuuuguaguuuuuaaugauacuuauucuccuuuugaagauuuucuucuguaguuaauauuucucuggaugcuuuuaguuuacuuuuagcucuuaguuuucagcaauauaauuagguuuucucuggaugugggugggcuuuuaggcucaagccacuuuauuauuuugauaucucaauugugaaguaucggcauuauaauacauuauuuguuuuauucauagaugguuuugcauuaaauucaggugguuuuccaauauuauuaccauuauuucauuuuaaaaaacuuuaaucuuugucaagaucuucaguuucauuugucaguguucuguguuuugagaguggacguuggauuuugguuggaugguugguugguugguuuuguuugagggcaggguuugagauuaaauccaggauuuugaacaugcaggacgagcacucugccuucaugcuguaucuccaguccuaucguggaucugaaauagucacauuauauugucagguguuuagaacauuggacuucugacagauaacaguagaaaccuggaugugacuguacagagauggaguuagggauggagggcucccaggagacgacuuguacaguagucacuaaugcacauucauagcaucauucauucauauguuuuaauggugugacaauuuucaccucucagaacugcugaguugaauuuauguauacuagaguacaggaagugauacuacuuauuauaaucuugauucuucaggaaauaauauuaacaucagagauuuaaaguuguaccuaauaaauauuuuccauuaauacugauacccaugauguguuuaaaucauuugaaaauguaaauauauuuacacuggccuuuaguuuuauuuauuuguguaugugugaauguaauaagcuuguacacagagaucagaggacaacuuggaguaguugguuuuuaccugcuauguauguuguugaggcaggacuucucuugucuuuguucucuauaauuaaacacuaaguuucuauaagaacagauaaguguauccaauaauaacacugcauuuuauaguccugaguuugcagguuucaggaaguauugguguuggggaagugacaacaugacagugcagaguacacguguguuuucagaaccaagguuucagggaaguuguaugauaggauguaaugagcacugcaagaacacuucagguucauuguacaugggauucucaguuaaguguuagccaugugggcuagaaaauacugugaaagagagugucuaaccauuuaacuuaucugggcccauuaucaucuacaauuucuaacacuugaaagcugugcaaucuaccuuacaaaacaaauuacagggaaaucccauagucucaaaauuuuguauugggcuguauuuuuaacugucuuacuuuccuguaacucuauggauaacuguguaucuuguaaaaauuggcccacauaaacaaugauauaugguagguuagagggaaccccaacuucauaugguacuacuacagaaacugagacaugucuuaguuaagaguuucauugcuguggagagaccccauaaccaaggcaacucuuauaaaggucaacauuuaauugcuuacagguccagagguucaguccauuaucauaugguggaaagcauagcagugucuaguuaggcauggugcuggaagagccaagaguucuacaucuuauucugaaggcuucuagacugacuuccagaaagccaggaagaaggugucaaagcccacccccacagugacacacuucuuccaacaaagccacaccuccucauagugucacucccuaggccaagcauagucaaaccaccacaagguagaaggaucauuuaaaccuagaaauucucaaagucaaccuuggcaauacagaaagacccugucuucaaaagcaacaacaacaaauaucccucagucauauagcauuuuucucuuaaacuacaaaguuuagaauuuauuaaacugacauuugaguaacuuaagugcaacaaaacuaccucaaccauuuucugaauuugacuuuaccauucuuuuugcaguaugaucuuauucuuagcccagauguugauuaugaccaaugacuacagucaaaaaccuagaauuugccuuugccuuucuuuguacuaccauaugcauaucuaccaaaugccagcguuacuaguucucuuuccucacuaacuauuauugagcccuuuacuuccugucuuuuuuuuuacuuucugucuuaccuuaggcauuucuucuuuugacucuuaagucuucaaaguaguuuccuaacuuauacucccucuagucucacauguaucugucauuuauuccuguauauguguguaguaaacaggugcccuagcacaaggcuccaucaccuacccacacaucacuccuuaugugcucugcuccuggguaugcccuguagugcaaaugaugugcucaggcacaaacugccucacuuagugaauuugaggagggacuggaaauauaauuguaagugacaaaaaacaauuguagaaaaguucauuucuaugaaaacaugcuguaugcauucauacauacauauaaaaggauauaugggagauaauuucuuuaaaauuaagguucucaaaugcuagcuuuauaauguuuaauguuuuuuuuuaauuuuuuaaaguuuccccguaguauaccaccuguauuuaugagaaauauauauacauauacauacauauauauauacauauauaugugaaguagauucaaucaaaaguaauuuuuagagaaaaaaauuuuuaaugaucagaaggcuccauuugaaucauuucugauacuacuagugaccuuaggggaaaaauuuaauuauaauugaauuagaaagcagauuuauagaggguuaagaaaacugauugacaccaggaaauggaaauaaucacuacauuuaccacacacggauaauaauagauggaaaaguggaccaugaacgcuuuacguuggaagaaacguuaaacaugguuguagaaaguagaaaauugggucaucugagaguuuugcugaagcaugucgauaauuuccaguaagacaauuccauguuaacaaugaauucaauaacaagaauguauuugaagaugaggcaguuuguaccuaagcuugucauuugcacuacagggcauacccaagagcagacuuugauuuaggucuaagagcuaagauacagcauauuuguggaagccagagcagugaauaugagagcggcgggggggauugauuguguguauggcauguauuggauuuuuuuuuacuaauuauuuuauuugucuacauuucaaaugucccucuuccaggucucugauccaugagucccccaccccaucuuccuccucuuugccucuaagagggugcucccucaaccauccccccauucccacuucacccaucuagcaucccccuucucuggggcaucaagccucaacaagaccaagugcauccccuccuacugaagccagacacggcaguccucuguuacguauguagcaggggauauguaccaucgugcguccucuuugguugguugguuaguuccugggagcuccgagggcucugauuaguugauauuauuauucuuccuuuaggguugcaauccccuucagcuacuuaacuucuuuccccaacucuuccacugggguccccaggcucaguccaaugguuggauauaaguaucugcaucugucugccagguaggagcuagcagauccucucagaggacagccaugccagguccugccugcaagcacaucucagcauccgcaauagugucaggcuuggugucugcaccugggauggaucccaagaugggguggucucuggauggauggccuuuccuucagugucugcucuaguuguuaucccugcauuuccuuuagaaagcaacaguucuggguuaaaauuuuugagauggguggguggcccuaucccucaagugggggccaugccuaucuacugaagguguucucuucagguucuguuuccccauuguucaguaguggugggauuggaucuuuuuuuaaaaguguauauauauauguguguguguguguguguauauauauauguauguauauauauauauauguauguacuuuggauuuuaauaaggaaaacacucuuaaagaccucuuuagugacuaaaaacauuugcacucucuguacuuaaguaauuauacuuggaguugaccgacuucacugaauuuacaugccaacauggccauaggaagugccaaaacuucuuuagugugguaucuagaaaugaccagcauauaucuaaaagaaguaaguggcauguggauaugccuagauagcagggcaauguagcccuacucauucuuuaaacuuagcacauuaaaugacaaacagggacuccugcaaaaccuggcaucucuguauggaggcaggcccagcucuucaagaggagggaagccaaggaacaaugaggaagagguaugcuuuccgcaugcucagcaccuccgccacgccgccauuuuuaaguuuaucgccuucuuuucuugcaugguuuaaaugcuuaacaauuauuuuaagacuuuguaagucuauagggaccuguuacuauauuuugacugacaugcugugucauaauuuugccccauaacuguuacucagucuucugaguuucaauuucuuuucuuuugauauaauuuaaaaauuuauaauuauaacauauuucuuucuuugcagaaauaaauuccuuuaaauacuugaaagcuaauauuucauuuucauuaaccaaauuucagaacuuuuguuuaauguauuaagauuaacacuuuuccauaaauuaaguuuuauuuuuuuuagcugugaaaauguucauaguuuuccuuuuaaguuaauguuuauuuguuuuuguuguuccuauuuuagguuuauuuggcaagacugaggcaaauaagacuacaaaauuuuaaugagcgccaacagauuaaagccaaacuucguggugagaauguagguaaaaaucaauuuuucaaaaaauaauugaauaauagauuaaguuuaaacaugcuauguccaugauaauaaaaguuaaaacuguugaaauuaaggugaaagagcagaaaagaguguguagggaugaaguaaaccuuaagugaaggaguucaaacugccaggcuuuccugcuccauagagcuguacagagaggagaccugaugugugggaaagguguaggagcacuugacaguggucuccuugcucuugugcuuuggagggcucaggugcagcucucagagaaagagggcagugcugagugguuucaucucccauggagugagcucagucagaggugccacugaacuuggcugcuguugacuaagugcugugcuuguugacaauuguucuagaaagaagcugaugguaccaaaggacaagaagcaacugaagagacugacaugaggcucaaaaagauggagucacuuaagguauagacuaaacaauguaacuucuuaagaaaaugaaagccgagggaggaaaguuuguucuuaugaguuuuauauauuugaauuauuuucuucuccuuaacuuuuuaauuuucccuuuauaagucaccuuacgauuacuagaaaauagcauuuuucuucuuuauacaacauuuaugaagaguaauuaggugaaauaacgugaauauauaaaauugugacacauguaauucuguaaaaguagauacucauguaaucccagcauuuaguaggcugaggcaagaggauugcccugaauucaaggccaggcuggugugugugugugugugugguauaaucaagacacugucucaaaagaguagccauaaaaaugaaauauacagguaucuguuuuuccaaagaugauuggagcuaugcauaaacauuuacauuuuaauuuccauucuaucucauuggacguauuuucacuuaccaaauaucaacuauucucauauuauccgaggugagaaggauacauagcauauauuuuuauucuggaaccacacacacacacacacacacacacacacuugcaugcuggcuacagagugagugucauuuuagacccagguuguaggaugaugaccauaaguuagcuuucugacaacuaauuguguugaugauuuucauuuucaggcgcaaacaaaugcacgugcugcuguacuaaaagaacagcuggagcgaaaaagaaaggaagcuuaugaaagagaaaagaaaguaugggaagaacauguaagauucuuguacuuaagccuuguugaauucauguccuugggcucuuacugaggaaacagucagguuugcaguuuguaaauuuuguagcacugagaaucaaauccagggccuugcauaaaccguaucaggguaagucaguguaaaacucuguacuugugugugugugugugucuuaaguguguuucuuuaaaucuuucucauagcuucuuaccgucauguucagcuacacuaucacaaucacaaguauaaggaucacuguucuugcguauuuuuagauuaaccuuacauaguccauucuaacauccuucguaguccauaaagguagguaaauaaugauguaucuaucaaacagggugagcauacauguaguccaguugagccuuaauuuuuuauuaacuaauuuaguuacuuuucauccgaacagaguuuccugacccuccccuccucccaguccuugccccucaucauccccucccccauccacuucucuguuucucuucagaaaaggagagccuucccauggaucucaaguagcccuggcauaucaaguugcuauaagaccaagaagaccuucuucuacugaggcuagacuaggcagcccaguaggaggaaaggcucccaaaagcaggcaacagcgucagagacagccugcucgcacuguuaggagugccgcaugaagaccaagcugcacaacuguaaacugugugcagagggccuaggucggucccaugcauacuccuggugauagcucugucucugucagccccugugggcccacguuaguuguuucuguggguuuucuuguaguuuccuugaccccucugucagucuuauuuuuuaaaaugcugaguucaggcaaaaaaaugucaaugggacaucaaauuauuugauccuuguugacauggauuucaguguuugguuccucgaagucuuacucgcagggucagcuacuccuuauuugcuuccaucaguaugcacacacagacacacuuuggcagcagaccucuacuuucucgcuuuguuacuuauuuuaccuuaagguagacuagagugaauguuugugucucaguccauucugugauuggcuuagcacauuuaucaaauguuauuguuuucucuagccauguaggcucuacaccuuagaauagcaugcuucccacagcucaaguucauauaaaucagaaaacccaaaagaggauuaccuuugucauggugaugguaagaaacaaguggauacauuuguuggaaauuuugugauucagcuuauuucaaagcuguaucuagagaauuguccaggaaacauuuguuuauuaaauauagccugauauagggagggaaaguguaucuggauugggaugacugccagcuauagucugaaguagcuguuuaaagaaagcauccuugggugcuauugaacuauguaugaaauuauucuauguuuagaauaugaaaucaggcccuuuugauaugguccugacauacuuauuucuccuuauuaauccacauauacagaugaguugauacuuacuguucugugacuuaagauuugauaaagcuucuuacauuaaagauggucccauuuuugguuaccuuuuuuacuuuugucacuugguggcacugcugauuaaguuucagcacuuaguaacauugaaaucugaaauagaauaucuuacagugauaacugaaacccuuuggagagaugugacaaugugaagcugcuuccauagaauuacuaugaaaccugucuuguaagaaccaggcacagagcucagcagcccagggcuuacuuaggaucuccauugcugggaagacaccauggccaaggcaacucuuauaaggacaacauuuaauuggggcuggcuuacagguucagagguucaguccauuaucaccaaggcaggaagcauggcacuguucaggcaggcaaggcacuggaggagcuaagaacucuacaucuuguucugaagggaaguacaaggagacugacuuccaggcaucuaggaggucucaaaguccacccuuacagggucaugcuuccuccaacaaagccaccuccuaauaaccaccuaacaguaccacucacucccugggccaagcacaguaaaccaccacaugcaccacauuuuggauucaauuccuaguacugagaaaaagaggaggaggagggagcgagggaggaaaaagggaagggaagggaagggaaaagggaagggaaggaaaaaaggaaggaaaggaaaaaggaaagggaaaaggaaaaaaggaaggaaaggaaaggagaaaggaaaggaggggaaaggaaagggaagggaaggggaaaggaaagggaagggaagggagaaaaaaaggaagggaagaaagaagggaaaaagggagaaagaaaggaaaggagaggagaggagaaaggaaaggggggaggaaaaggaaaaggaaaaagaaaggaagguuucuuaucuauaauauggugcugcaugccugugugcccaguauuuaggaggcugaaacaggagucucaugcugggccaugugucaugaguuggaagccagccugggcaacaugcacuuaggcacacauacucacacucacacucauauauacaaaucugacuuagaagacuuuucaagucaaugcuuuagucuuguugaaaauuuuuauauuuaaaacuagauguguuuuauaaacuaugcuuagaaggaaguaaauauucuauauuuagccauguaaucaauuuuauuuuuaaaauuggcaugcuugguuuuaagauuucauggguuuuaucuucuauaaaccuuuguggguuuuuaaauaccuauuuuauuuugagaauuucacguaugaguacuguauuuacaugauuuucacacuacagacuccaucuuccaacuuuaccuguuuccccugguacacaugcccugucacacucauaaccucuucuucuuucauuaucacuguuucucugucugucugucugucugucugucucauacuacugagcccauuuaguguugcucauuguguauguugacuuuguuguuuucuguuuuuuguuacuuucguauuugauagcuuucugaauuaaggggucaguguaauaucuucugcuuugauaguuaagguacuuuuauaucuucugucacauuauuuuaaaagaaugugaauauuuuucuauuccuuuuuuauuuauucauucacuuuacaacuugaucgcugcccgcucuucugguccccacucuuuucccccaucccgccuuccccuucuccucugagaggguagauucccccuggguauccccucacccuggcacaucaaaucucuucagggguaggcauauucucucccacugaggccagacaaggcagcccaacuagaauguaucccauguauaggcaacagcuuuugggcuagcccccacuccaguuguuugggccaaaagacagacaaauuaacaaaaucagaaaugaaaagagagacauagcaacaaaugaggaaaugcaaagaaucuuaagaucuuccuucaaaagcaagugcuccacaagagugaaaaacuuaaaacuuacugaaauggaggguuuucuagacagauaccacuuaccaaaguuaaauuaagaucaaguaaacaauuuagacagcccuguaaccccuaaggaaauagaagugguccuuaaaagucuuuaaacugccaggcgugguggcacacgccuuuaaucccagggcgagggaggcagaggcaggcggauuucugaguucgaagccagcuuggucuacaaagugaguuccaggacagccagggcugcacagagaaacccugucucgaaaagccaaaaaaaaaaaaaaaaaaaagucuuucaaccaaaaaaagaaaaaaaagcccaaggccaggugguuuuaguucagaauucuauucuuucaacaaagagcuaaugccaguauuccucaaacuauuacacaagauagaaacaaaaggaacacugccaaacucaugcuaugaagccacaauugaccugaaaccuacaccacaaaaggaugcaacaaagaaaccggauuucagggggcuggagagauggcucagcgguuaagagcacugacugcucuucugaagguccugaguucaaaccccagcaaccacaugguggcucacaacaauccguaacaagaucuggcacccucuucuggagugucugaagacaguuacaguguacuuaaagcauacaauaaauaaauaaaucuuuaaaaaaaaaaagaaaccgaauuucagacagaccucucuuacgagcauugaugcaaaaauauucgcaaaucagauccaagaacacaucaaaaacaucaugcaccaugaucaaguaggcuucauuccagaaauucagggaugguucaauauacaaaaauccaucaauguuauauaccauauaaagaaacuggaagaaaaaaaaucacaugaucaucucauuagaggcugaaaaagccguugacaaaauccaacaccccuucauguuaaaaguguuagaucagguauacaagcauaucuaagcauaauaaaaauaauguacagcaagccaauagccaacaucaaauugaguugaaagaaacuugaacuaaaaccacacaaagcugcccacugucucccucucuauucaauauaguacuugaaguucuagcuagaguaauaaggcaacuaaaggagaucaaggggauacaauuggaaaggaagaagucaaaguacuguuauuugcagaugauauguaguauaccuaaacaacuccaaagauuaucacagaacuccuccagcugauaauacacccucaccaaaguggcuaaauacagauuaacucaaagaaaacaguagcccuccuuaauacaaaugauaaauaggccaagcaagaaauuagagaaacaacgucaauagucaugaguaauauaaaauauucuagugugacucuacccaagcgugugaaagaccuguaugacaagacuucaaguugcugaagaaauugaggaagauaucagaagauggaaaagaucucugugcucauggaucaguuggauuaacauaaugaaaauggacaucuuacaaaagcagucuacagauucagcgcaauucccaucaaaauucuaacacaguuguuuacagaccuugacagcaaaucucaacuucauaugaaaaaacaaagaaaccagaauagcuaaaacaaucuuuuuuuuuccuuuuccauuuuuauuagguauuuagcucauuuacauuuccaaugcuauaccaaaagucccccauacccacccaccgccacuccccuacccacccacucccccuuuuuggcccuggcguuccccuguacuggggcauauaaaguuugcguguccaaugggccucucuuuccagugauggccgacuaggccaucuuuugauacauaugcagcuagagucaagagcuucgggguacugguuaguucauauuguuguuccaccuauaggguugcaguucccuuuagcuccuuggguacuuucucuagcuccuccauugggagcccugugauccauccauuagcugacugugagcauccacuucuguguuugcuaggucccgucacagucucacaggagacagcuauaucaaucuugaacaaaaaaaaaaaaaaaaaaaaaaaaaaaaagaaccccuggaaguuucaccaucccugaauucaagcuauacuacagagcaauaguaauagaaacugcgugguauugguauaagaauacacacagugaucaaaguagugugucaauauuuugauuuaagaaugacuuaccuugagcucuuucauuuucacauaaucacagcugguacugaaucugauucucuggugucaggcccuguuuagcucaucagucauaacuuagauguuugacugcuacuauagguuucucuuaagguucaguuuaauauagaaauacuucuacuaauuauuuaugcuuuauagcuuacuugaaaauauuaagaccaaguuaaagaauuuucacacucaaaaaaaaagcuauauauuacaugagauuugguuuuguuuuggagacagggucucauagcccaggcucacuuuaaacuuacuguguagcuaaggaccuugacuuuugcaucuucuuuuuuuuuagaauuaauuuuuuuuauuagguauuuuccucauuuacauuuccaaugcuauccagaaaguccccaauacacucccccccccacuccccuacccacccacucccacuuuuuggcccuggcguuccccuguacuggggcauauaaaguuugcaaguccaaugggccucucuuuccagugauggccgaauaggccaucuuuugauacauaugcagcuagagucaagagcucugggguacugguuaguucauaauguuguuccaccuauaggguugcagaucccuuuagcuccuugaguacuuucucuagcuccuccauugggagcccugugauccauccaauagcugacugugagcauccacuucuguguuugcuaggccccggcauugucucacaagagacaccuauaucuggguccuuucagcaaaaucuugcuaguguaugcaauggugucagcguuuggaagcugauuaugggauggaucccugcauauggcaaucacuacaugguccauccuuuugucacagcuccaaauguuaucucuguaacuccuuccaaggguguuuuguucccacuucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuugccuaggaauuucauaaauucauucuuuuuaauagcugaguaguacuacauuguguaaauguaccacauuuucuguauccauuccucuguugagggucaucuggguucuuuccagcuucuggcuauuauaaauaagacugcuaugaacauaguggagcaugugucccucuuaccaguugggauaucuucuggauauaugcccaggagagguauugcuggauccuccgguaguacuauguccaauuuucugaggaaccgccagacugauuuccagagugguuguacaagcuugcaaucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugauaauucuuuguucaguucugagccccauuuuuuaaugggguuauuugauuuucuggaguccacuuucuugaguucuuuauauauauuggauauuaguccccuaucugauuuaggauagguaaagauccuuucccaaucuguugguggucuuuuugucuuauugacggugucuuuugccuugcagaagcuuugcaacuuuaugaggucccauuuaucgauucucgaucuuacagcacaugccauugcuguucuauucaggaauuuuuccccugcacccauaucuucgaggccuuucccuacuuucuccucuauaaguuucagugucucugguuuuauguggaguuccuuaauccacuuacauuugacuuaguacaaggagauaggaauggaucaauucgcaaucuucuacaugauaacagccaguugugccagcaccauuuguugaaaaugcugucuguuuuccacuggaugguuuuugcucccuugucaaagaucaagugaccauagguguguggguucaucucagggucuucaauucuguuccauuguucuacuugucugucguuauaccaguaccaugcaguuuugaucacaauugcucuguaguacagcuuuaggucaggcauggugauuccaccagagguucuuuuauccuugagaagaguuuuugcuauccuagguuuuuuguuguuccaaauuaauuugcagauugcccuuucuaauuuguugaagaauugaguuggaauuuugaugggauugcauugaaucuguagauugcuuuuggcaagauagccauuuuuacaauguugauccugccaauccaugagcaugggagaucuuuccaucuucugagaucuucuuuaauuucuuucuucagagacuugaaguuuuugucauacagaucuuucacuuccuuaguuagagucacgccaaguauuuuuuauuguuugugacuauugagaaggguguuguuucccuaauuucuuucucagccuuuuuauccuuuauguacagaaaggccauugacuugcuugaguuaauuuuauauccagcuacuucauugaagcuguuuaucaggcuuaggaguucucugguggaauuuuuagggucacuuauauauacuaacaucaucugcaaaaagugauauuuugacuucuuccucuccaauuuguauucccuugaucuccuuuuguugucuaauugcucuggcuaggacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauggaccuugaauuccugaucuuuccaagacuuuuaucaugaauggguguuggauuuugucaaaugcuuucucagcaucuaacgagaugaucaugugguuuuugucuuugauuuguuuauauacuggauuacauugauggauuuccguauauugaaccauccuugcaucuuuggaauaaaaccuccuuggucaggauggaugauuguuuugauguguucuuggauucaguuagcgagaaauuuauugaggauuuuugcaucgauauucauaagggaaauuggucugaaguucucuaucuuuguugggucuuuuugugguuuagguaucagaguaauuguggcuucauagaaugaguuggguagaguaccuucuguuucuauuuuguggaauaguuugugaagaacuggaauuagaucuucuuugaaggucugauagaacucugcacuaaacccaucugguccugggcuuuuuuugguugggagacaauuaaugacugcuucuauuucuuuaggggauaugggacuguuuagaucauuaaccugaucuugauuuaacuuugguaccugguaucugucuagaaacuuguccauuucauccagguucuccaguuuuguugaguauagccuuuuguagaaggaucugaugguguuuuggauuucuucaggaucuguuguuaugucucccuuuucauuucugauuuuguuaacuagaauacuuucccugugcccucuagugagucuggcuaaggguuuaucuaucuuguugauuuucucaaagaaccagcuccucaauugguugauucuuugaauaguucuuguuuccacuugguugauuucaccccugaguuugauuauuuccugccaucuacuccucuugggugaauuugcuaccuuuuguucuagagcuuuuaggugugcugucaagcugcuagugugugcucucucuaguuucuuuuuggaggcacucagagcuaugaguuuuccucuuagaaaugcuuucauugugucccauaaguuuggguauguuguggcuucauuuuuauuaaacuccaaaaaguccuuaauuucuuucuuuauuccuuccuugaccaagguaucauugagaagaguguuguuuaguuuccaccuguguguuggcuuucuauuauuuauuuuguuauugaagaucagucuuaguccauggugaucugauaggaggcaugggacaauuucaauauuuuuguauauguugaggcuuguuuugugaccaauuauguggucaguuuuggagaagguaccaugaggugcugagaagaagguauauccuuuuguuuuaggauaaaauguucuguagauaucugucagauccauuuguuucauaacuucuguuaguuucacugugucccuguuuaguuucuguuuccaugaucuguccauuggugaaagugguguguugaagucucccacuauuauugugugaggugcaaugugugcuuugagcuuuacuaaaguuucuuuaaugaauguggcugcccuuguauuuggagcauagauauucagaauugauaguuccucuuggaggauuuuaccuuugauaaguaugaagugcccuuccuugucuuuuuugaugacuuuggguuggaaguccauuuuauuagauauuaggauggcuacuccagcuuguuucuuccuaccauuugcuuggaaaauuguuuuccagccuuucauucugagguagugucuaucuuuuucucugagaugaguuuccuguaagcagcaaaauguuggguccuguuuguguagccagucuguuagucuaugucuuuuuauuggggaguugaguccauugauauuaagagauauuaaggaaaaguaauuguugcuuccuuuuauuuuuguuuuuagaguuggcauucuguucuuguggcugucuucuuuuagguuuguugagggauuaccuucuugcuuuuucuaggacgugguuuccauccuuguauugguuuuuuucuguuauuauccuuugaagggcuggauucguggaaagauaaugugugaauuugguuuugucguggaauacuuugguuucuccaucuaugguaauugagaguuuggcuggguaugguagccuuggcuggaauuuguguucucuuaguuucuguaugacuuuugcaucuucuuuccuccaucuaugagugcuggacuuugaggcauuuaccaccaagccagguuuaugaaguacaagggcuggaacccagugcuuuguguuagacaaauucuagacacagcugagcucugucauaagcccucccuauggcacaugagauuacauguguacauuuucagagagcugcacuaauauuuauauaguaguuuaggaauuuaagaauuaugugaauuaaaaaaaaaccuuaacuuuuuaagguucuguguaucaaguacauccucagauuagacagcugucuauucuacuguugaacucugcccaccccccacacaaccccagaaagaacuuuuucacaagaauguauacaagcagaucgagagaugccauaggggcaacguuccugcuaguacaagccugaguucagauccacagcacugacauaaaugcuggcaaggcagugcucaccuguaauuccagggcuggggaggcugagucaggaagauccuugagauucacucaucaguccaucuagucacaucugcaagcuccagguucacugagacaucgcaccuacuaaaaaacauggagaguauuugaagaagacacauaacacccaucuuugguauccauacauacauaaaaauaauuaugguuaagugaaguauaacucaaugagggaauuugcauaugggucuuuuuuuuuuuuuucagaauuuccucuuugucccuauguuuuagguuaccugcccaauaauuucaaaaaugacuuuuaagauaaucuuuaaaaucaugaauuaaaugaaccguaaaguugcgaaggccauuuaauuacauacuuaccuugaugaaauuauuucaacacauuuuauaacuucuauuuaauuauucauacaacucuauuacuuuuuaaucuuuuugaaucuugaguuuuguuugaauuaauagguaaagcauuuggcuuguggcucacugucucuugugaacuucuguucuaagacccugaaugcacuacugaaacuuaaacucugauugugcacacaugaccuuuuguuuuuauugugcauucuagagaucagaagcaugguuccugcaagcugauucauaaguaagcucagucuaggcuuuuggugcuuaagccagaugaccuuauuugauagagguuaaaucaauacuugcugugugcuucacacuacuuauuucauuugaucucuucagaaaagagaaaauggggacagugcucuuuuguuacagaaaaaaaaaugagucuuaggccaagaaauaaugaaaaaucauaaugcuaaugaguuggaguuugaagcuuuggcuguagaagugccugaguuugacuuugagggcugcugggggagcgccggggguggggguggggggagggugccagggaggcuacugucuucaucaccucuucugaccugcacagucaguucucgcucaucuuuguuguuucagucuacuccagaccauuggcgucucucgguaacauagagcuuugcuucuuuccugcuuuccauuacagucugcaguccuuuaggagagaacaucgagcuuacuaauucucauuauucauuaucuacaugguguuuggugcagauaggaauauaaugcaccuuucagcuuguuaguacauuuucuuucuagaagacuuugggggaucauuuuaugagacacuguugaacagugguaaccaguuuuauuuaggauuauauuuaccuaugagguuggaagauuuucguguucacuguuucaccagcagauguaucauaguguuuaacaacaaguaauuaaggaaugagacagaucuguacugugcauaaaaguacauguacuaugccuucuguuuuuccaugaaaauauggaauccagcacgucuaaguguguauucugucuccugcaguugguggcgaggguaaaaagcucagauguuccucugccuuuggaacuucuugaaacaggugguucuccaucaaagcagcaggugaagccugucauuucugugacuucagcuuugaaagaagugggccugguaaguuucauaaaauuuagaacuccucaaagacuagagauuauuuuaaauaaaaauaaauuuagugaauugaccuuaauuccaaaugccuccuuguuuuuucuagagaaucuaucuucuugcauuuuuugaacauuuuuugaagugacuauuggaacuuuucugccaguaggauuuaucuaggacucugucauggaucaauuuauauugaggacucuguuucuaaggauucccaauauacauagucaaucaauuucagacccagaguguuugagaaacaaagucauguuacugcuguguaucacacaggccugucuguaaugauggcaucuauaguacugagugauauuucuuguuguuaaaccauauaacuauguaaaugguacauaaugcuauaguuaugcgguaugucauucuguuauaucuuguaacuaaucuagaaauuccgauuauaugaaggauauacauagguuauaggcauuacucauuuuaaauaugagaaugagcaccuguggguuuuggcaagguaguggagaguucuuagaaccaguuuaggaguaggggacauagguuaaaaugacuuccacuuuaaagcaguuuacuaacaggcugguaagaugacucaguggagaaauuugcuugucacaaugccugacaaucugagauugaugcacauaguaaagagaaugacuccuacaaguuuucuucugacauccaugugcaugcaguuguagcagcagcaagcagccacucauguuugugccugugcuaaauaauugcaguaaaaaaaucaauggaaagcaauaacugaaaacaauguggcaaacaguuuuauacccuaaacuuuaugauuagcaauuuuuuaagaauuauaucucuuuagcacuuaaaguaacucuaggaacaaagucccaacuauuugaaauuuuguaacaagguaaaugauauucacuguaauuacauuuaauauguuauuuucucaccuucuacuucugagccucuguauaccauacagauaauaaacaaacaaaugugaauaaguguaaguuuaaacuuguaaguaucuaaaaugugaagacuauuugggacugggagaaauggcucagaguuuggagugccugcuuggccuucaugguccugaaagccaucuacugagcccaacaagucagcaaccuugguucccuucccuagcuacugccuguaacuuggauuucaugagauucguuagguuuuuuuucaugcugcagagguuauugauuacuacaaagauuucuuagagcuuugugcagaguauuaagcuuuuccugcucacucuucagugcuucauauaagaaucuuuguugccccaguagguuuugucucuuucugauaauaacuuugcaugugccgcauuguucacagcaacuuuagauaccauugugugauuuccuuccugguacccagucucacaucucaaguagcuguucaucucucugacugcuuuccuggguaaaauccuccuugucuuguuuauguguauuacuuucaucugaccacuguucucuuauguuuucuaaauacuauaaaauuugagauaauccaugugacuaaauggcuuuuauuacucugugauauuuuuagaaacugcuuacuuaaaacuuugaagauuauuuagucacacugagucacaggcuucauaacaacuaaucuuuuccuuuucauauguuuuuaaauauuaaguuguuuagaaugucuucauugugcuaaucagaaguaacaucuacauuauuaaugacacagauaaguaagagucuauucuugauucuuucuaaccucuuuccuuagagcgaaaaaaaacaaguugucaauuaugucuaauccuauggcuuugguguguguguguguguguguguguguguguguguguguguguguguguauaacguaaagaugguuucagaauaacacagguuauccugaauuacuuuuaucuaccaaaagauuccuugggacugagaauuuagcucuguuaguagaacacuugcaugagacaacuucaguccccagaaucauuucuucuuaagguauauuuauuuuauauguauugguguuuugccuguauguaucucugugcacaacaugcaugccugauguccgcagaggccgaaaggguguuagaucuuuuagaacuggcauuacagauaguugugacuacugggaaauuauaccugguuccucggcaaaagcagccaguguucuuuacugggcuuucucucuagccccagaaacucuuuguauuuugguuauuuuuuuguuuuuguuuuguuuuguuuuuuuaagaaacaaaaaaaaagugcaaaaauagagacccuuuuucuaacucuaguaaacaaaguauauggauucucuuuucacauuuuuuuaaaaaaagauuuguuuguuuguuuguuuccuauauguauguacaguuuuacugucuucagacacaccagaagagggcauugaaugcuuguuacagaugguugugagccaccaugugguugcuggggauagaacucagggcaucuggaagaacagucagugcucuuaaccacugagccaucucuccagcccucuguucacaucuuuuguugacuuuaaauuaccaaaaauuagaugcugaagaggacaaagagauaauuguuagcuguaauccacaaauguggcacauaauugagaacugacccuuauuaaucuuauuaacugauugauaaucuuuaaauguuuauuauuacugauaaugaaagaaguuguguuaacauuuuacaggaaugagaaaaguucacagaggucaguuaaaugaaacguuaaaagaaacaaaauuaucaacuguuuuaccauaaaguuuuaaaugguuuuaacucuuacucuuuaaccgucuuguguuuaaaggauggaaguuuaacugauacccaggaagaagaaauggaaaagaguaacagugcuauuucaguaaguacaguuuucaaaacuucugucaggcauuugauuuaauaauaugcuuacuaacauguaacuguuucagaguaagcgagaaauccugcguaggcuaaaugaaaaucuuaaagcucaagaggaugaaaaggaaaagcagcaucacucagguucuugugagaccguuggucacaaagaugagagagaguaugagacagaaaaugccauuuccucugaucgcaagaagugggagaugggaggucagcuugugauuccucucgaugcagugacacuggauacauccuucucugcaaccgaaaguauguaugaguauguuaaugucauggcuugguuuaucacucacauaaacucauaucuuggccauccaaagaaaucaacauguagauggcuugaaagagguagaauuaugggcaucccaugaggaugggcaugaaguaucuucuaguaaaauauaaagaguaaaauauaaagagcauuaaaaaaguuuggucuuugcaguggcaaagauuuuuauaugaguauaaucagagaagagagaacuaaauuaaauuuaaacuaaauuuaaauguauuuaaauuuguuuugaacccuuuauaccauguuaaauuguuacugguuuuuuguucuuauuggagugaagggggugcuuaguggggagacaagaugucucacuauguaucuaggacuguccuugaacucacagucuucuuuucucugucuuccaagugcuuaaauuacagacacauauugcccagcuccccagcucuucauuuugugagauauacuuaaauguauaucaggcuagacuugaacuuauaauccucuugccucugccucugaaugcugaguacauucuacuuugcccaacucuagcaguaaugucuaauaaaaaugagcaauaaaagcucugaaaguccucuuagacauuuaggaggaguuucgugauuuauguagcaagaauucccaagcacccaacuguguucuuauucuuacauuauucuaggcacuggaaauacauuaaaaaaaaaaagacacauauggucucuucacaaucuaaguaaacaagugugacuaugaagaaaacuuguuuuaacugauuucaauaacuauuuuugucaaauucuuuucaguuguacagaagcccaauaauucuuuaugcuguaugccaacuacucauaagcuguagaaacaugaugauagcuaaggauagucccucuuaaggaggguaggauaggaauagaaagggugcaagcaaaaggaaauuguuguugauaaauaacacacuaauaacaaugggcuacucugagaauacuuacaguggcagaaaugagucuuuggaagucaagcaagugguuucuuuaagcacuuggugaaaguaguaguuagcuaagccaaagcccagccaaggguuuaggcagagaguaagcagaacucagggguaggaaauuuuaucucaccaugucucacuauguauuccugccuuugagcucgugauuguccugccuguccuccaagugcuggaacgacaggugugcaccacuaucccuagcucccagaccugugaagcuuaggaaacuugauauaauucaacaugaauggcuaaaauucaaauuuuaugacaagaaaauuaaacaaggagccuugggagggcucuauggauccuuaucauaaagaguuucuucugacuuaagcaaauauuauagacuuauuagcauggaagggagacuuuaaauuuuggucuucugagccgggcgugguggcgcacgccuuuaaucccagcacucgggaggcagaggcaggcguauuucugaguuugaggccagccuggucuacagagugaguuccaggacagccagggcuacacagaaaaacccugucucgaaaaaccaaaaaaaaaaaaaaaauugugguuaauguagacacucacaacuggucaaagugcagagaauaaauggaacugaagugcuuagccauaaguggaauaucuauaaaacauauacacacacacacacacacacacacacacacacacacacucucuuucucucucucucucucucucucucucucucucucucucucucucacagacacacacgcacacacacacacacacacacacgcacgcacacgcacacaaugacauauggugagggagagauggcuagagagcacacaggcaugcaggaacugucauggaagagggcuggaaagauguaagaccugagguugaggaugacuggaucauaacagcaucuucugggcguggcaggagcacugcacucauaaauuuauagugcugugguugucuguaggagaucaagccagucaacauucuaucuugaagaggaaagcaguuuuggguuucuauccuaacuauagagagcuuguggcuucugggugagggaagaguuggagguuuuuaaagccuauuaucucugucauccuccacugaauggucauguucccaggagugugcggauaacacaaauuugacucaguagguuuuuuggggguuugggggguuuuguuuuguuuuaaggacaugaaaugaagugggaagagagguguguuugaguggccccuuuacucuuugagccauauauuuuguauuuuucuuuucuuauuuuucugugcuugaugcucauaagagugaaucaugggacaaagucuaaacuaggauuuuuuugaacuucuuuuucaaugcaauuaaucuaaaucucuuuaccuuagcuuuagacauacucuucagccaaggguaaaaagcagccacauucuucacuaaaauuacagaugaauuacaggcagcguacucaaauucuucucagaaaccacuuuagcuaggcccccagaguucaaaucaccaucagcaccaaugucuucuauauuccuauuaggauggccuauaagccccacuuaaaauauuucacugcuuuccaaaucuaacaucuuggggucucuaagguaauuuuaacuuuauaguuucuuguuucaaugucugggacccacacaugaucuucugggcuccuccaaagggcuugggucacuucuccagcucugcucucuguagcacucuaagcucagguugaucuacuccacugcaacuucuguucuuggugaucaucccaugguacuggcaucuccaauacacuggggucuuccacugcaacuaggcuucaccaauagccucucauaggcucucuuuaugguaccaagccucaacuuugcaucauuaccccuucagugcugggcugucagcugcaacugaugcuguaccuucaccaaguggcuuuuccuggccuuccacagugccaagccucagaugcucuccaugaccccuucaugccuucaaaaccaguacaaucacugcuaauuuguuaguuccagcuaaccagcaucaauuauuucaguaaccccuucuguucuugacucuaaagccagagccacguggccaaagcugcugaauucugaugcuuucuuagacuggaacauaccacccuuguucuauuacaucaucacuagcugucuuagucaggguuucugcacaaacaucaugaccaagaagcaaguuggggaggaaaggguuuauucggcuuacacuuccauacugcuguucaucaccaaaggaagucaggacuggaacucaagcaggucagggagcaggagcuggugcagaagccauggagggauguucuuuauuggcuugccucaccuggcuugcucagccugcucucuuauagaacccaagacugccagcccagagauggucccacccacaagaggccuuucccccuugcucacuaauugagaaaaugccuuacaguuagaucccauggagguauuuacucaacugaagcuccuuucucuuugauaacuccagcucugucaaguugacacuagcuaucuguuuuuauccuccuuccuaagcaacuaccuaagcuuggcuguccuggaacuugcucuguagucugacuuugaacucagagcucugcaugucucugucuccugugcauguauauguuuauauguguguauauauguauauauguguauguguguuuauauauacaugaacauguuuguaaacauuucuaccuuuauuuugcauuauuuauauccaauuuuuauuauuugcauuguucuugacuuuauuuuuaaguguaaguacuucauuuuaaaauucucuuuauuuauguugguguaauauuuauuccauuguguuaucauacauaaauuccuagaauuuuauaauaaaacauuucaaauuuguagcaaaauuuaaauaauguuacaguguguguuguaaaccauccauuuauauaugccauuagugccuuacuguaccuugucaauaucuaagcucuauuugucagucuuauguuuaacauaacucagaguaaacuacagauguuaguauucuguucuguaaggguuucacagcauguagucaucaucagaauucacaucagauguuuucuccuuuucuguuauuguacggauaaugguacgcacacacugugauuguacaguguggaccuauauacugcacaacgcuaacugcuaguaauacauagagcauugccaucaccccaaauugucacagcucuuccucaguccuucuuuugucuaccugaggcuauuuugucugagauucucccaucuuagauuaucuauucucauucuagaaugaggguuguaagucaacccucuaaguuuuuuguucuuuucuuucuggcuucuuugacuuaucauaauccuuugugagaggcaucuguguuaugacuuuuaauaauuucuuucuuuuaaagaauucuuuguugguauaaucauuuucacugacaugaucacuucauaaucauguuagguuacuauaucugucccucuccucugcucagucuauuuaggcauuuauagugaauguggguuugccuuuuuuaauccacucagaacaccuaaauaguauuuuuauacuauuuacaaucuguacaauuuaaauauaccaccuugcuuauuuucucugaucacccauauguuuuuuucuucuauuuccucuugcuuucuuagcuacacuucauuagucugcuagcucagaacgauuuggaguuaacaguauauauuuuuauggaauguuuuuucaaacgacuucagugcuuagccuguaguggaucauaacaaucuuguacugacuccuuuccugccuuugugcuguuauuguuaugggugaggcgauuacucugcuuguacuuaugcuaugaaguucaugaucuuuucuagccauuaguucucuagggagacuuaagcaguaagugacaagggccuaugugucuacuuuguauuugccauuuccagugcucuucaucuuuggugaagaggagcuaagaguugcagugcuguaaucucacuaauuuaguucucccaacuuguauaugucuguaaauguuuaccaugccugccuuuagcaaauauuuuuucaugaacuauggaauucuagccuaauggguuuuuuuuucuuuccuguucugaaaacacuguuccacuauuuaguuuaucuugugaagccaucgauaacugucaguuuuagccauccucugugugcaauguauggcuguccuugcuccucugugugcaguguauggcuguccuugcuccucugugugcaauguauggcuguccuugcuccucugugugcaguguaugacuauccuugcucuugcuccucugugugcaguguauggcuguccuugcuccucugugugcaguguauggcuguccucuuccucugugugcaauguauggcuguccuugcuccucugugugcaguguaugacuauccuugcucuugcuccucugugugcaauguauggcuguccuugcuccucugugugcaguguauggcuguccucuuccucugugugcaguguauggcuguccuugcuccucugugugcaguguauggcuguccucuuccucugugugcaguguauggcuguccuugcuccucugugugcaguguauggcuguccucuuccucugugugcaguguauggcuguccuugcuccucugugugcaguguauggcuguccuugcuccucugugugcaguguauggcuguccucuuccucugugugcaguguauggcuguccucuuccucugugugcaguguauggcuguccucuuccucugugugcaguguauggcuguccuugcuccucugugugcauuguauggcuguccucuugcaacuucucauucuccuaaaggccuagugccagggaguuugguggugauaccuugucaucacauccauccuauugguuggcuuguguuucuuggguuugugggucauagcuguuaccauuuuaggaaaacucuuggaugucacuuucccaguguuuuguuuguuuguuugagguuuuuuuguuuuguuuuguugguuuugguuuucccuccuauaagucuaauaacauuucuccuuccuuccuuuucuucuuuuggugauggggucaaucccagggccucugcaugcuaugcagguacucuacaguugaacuauguacugggccaacuuuccuuccuugucacucccauggccaguauucuuuaguuuguugaaccaguagaauucagcugugauaaucacuauagauguccuucuccuguaaguagugucaucauuucugucauuuggacauugguuuucauugguugaucauacuauucuuaauuauuuuguuuaggagcaaaacacuaaauuuuguuauggcauuuauauauuuuuuuuauauuugucauuauucuugaccuuuguacuggaauagaguuaaguuaguuaugaauaucuugauccuuguaggucuuccuaagcucuguuaagugggaucaggcaguguuuagucuauggcuaauccuucccgucuacugagucaacaaccuuucuaaacaaucugccuaauggcucggcucguuggugaauuguaagucuugcuguucucacugauggauaggauguauuccuggcucuucauaaacuccaagacuuacuccucccaucccuuugggugggcuucucucaagacaacagugauucccuugcaccugaugcacaagucaauguucagcuaauggcaugcaucagcuuugugaaaucuguuuucucugaugggcacuagccucucuaucuuccuuagacuucaagaucuguccuuucaaugcagacugaccaccaacccugccugcuuugaacuccccuugcuuuaaagagacugauuuguuuuuuuaaaauggguauucaguuuuuucaguuucauuuguuccagaaauuuucuuuucuguuggcauuacuuggcacucuucaucacauaccaaauaacuuucaguuuuuaguuuuauuccuauguuucauccaguuuuaaccacuuaaauuauaaauuuauuauaggcaggcagugguggcgcaugccuuuaaucccagcacuugggaggcagaggcagguggauuucuaaguucgaggccagccuggucuacaaaguaaguuccaggacagccagagcuacauagagaaacccugucucgaaaaaagaaaaauuauuauaaagaacuugugaauaaaaaaaucauauaucaggauuagccagacccagagucuuuuauacaucucagcaaacuuuuaugcuguaagaauagccauucuaaugcugugacacuucauauugacuuuuacacuucaguuauguuuguauauacuuauacacacacacacacaguuaaaacuagaaaaacaauucaguuuguaucuucuuucgugauucaugugucuuuuaccuuagcuauacuuuugaaaauuaggucccucguguuagucaugucagaaguacgaaccaauaauuucuugcugauuugcguuucuuauuauaucuuggagucuguuugcuguuccucuuuaugcuacauacuaaauccuaauaaaguaucuuucagaugguaucuuagucaagguacaauagaggaacauaaccuauagagugaaucuauauuacaagagggcuuauuagauuggcuuacacgacacaguuugggucuuccaaaaauguccgucucacaccugaaaggcuaagaauccaguagcugcucacucugugagguugaugcuucaucauuccuagucugggacuaaaggccugaaggauuacggagcacacugguccaaagaagcuagguucugcaaucagggaaggaauaaagcaaagauagaagcagcagcaacagaauagaugagcuugccagugagagugaaggcaagcaggcaaaaagcgaagcuucagagacuuggucugccaccagaaggugcuguccacagugaggaccuaucuucccacuucacauaaccugaucaaggaaaucucuuacaggugcuccccuuaaucugcccuuuggcugauucuagguccaguuuuggugacaaccaaaauuaaucauaaguagccuuuaaaaaaaucucuccuugugugggcuauaauuauaaauguauauccuguaauauaauauauauuacucuuuaaguauauauauuuggguuuuaaauuuuuauuuuauuuauuuuuugcuuugcuaaauuuuauuuaaauuaauuauccagaauuauuauuauuguaaaaaggaaauguuaguuaucugcuuaugauauauaaccuaaaguaagggagauuuucuuagacuauuuucuuccuuuuagcccauauguauauuuaccuuauaauuuauuuuuauauuagcuuuuagccugaagcacuuggcuggauaauaggaauuaaauuacuaaacaaugaauuacucuauuuuugaggauuauuuucuuauauuucuuuccucacagaacauacugugggagagguuauuaaauuagauucuaauggcucuccaagaaaagucugggggaaaaacccuacagauucugugcugaagauacuuggagaagcugaauuacagcuacagacagaacuacuagaaaacacaucuuuuaaaagugguaagcuuaaguaccaauauuauuaaaaauuaauguguuaagaugucuucauuuuauuguguggaauuauuuuccguucuggguggugguuguuauaaaggaaucuugaguuaugacuuagaccugagugaaaucuaaaugaggaaacuaaaugaaggaaaccuggaugagggagcuggaaaaaugcacgcaugucuuccaugagggaaaauguuggaauaauuuaagauuccugguguaucuuuaaaagagacuaaggaauuaaauugaguaaaagaaaugugugguaaguuuguguaucauuauucuuggacugggaagaauagcugucaugagacaauaggaggacauucuggacccaugaauuuuagguguuugagugucacagcagcacuuaaggaagagcagcugugugaugccuguucacagguagggaaugaauggaacugaauccagacauggacagggucuggacauguguguuuccuuuugcauucucuuuucucuguuguuccuugauguuuaggacaaaacucauaucuaaagcaugugaaaauuugacuuaggacauggggauauugacauguucuauaguggucagcgagauucugagaaauagacugaaaagagccugccgcauauguuacaaaagggcaaaagaagguuguucauucuugccaaaggugaauaucauagccauaagaaacagcccugaagguuagaaauggggauucugaaaguugggacuuuggagaggccauaauuuacaaggucucuaaagcauagcuuaagacuaagacagugagguugagaacugagaggucugcauauuggcaggauuacuuauuguguauauaaaaucaucuaccuaugacagaauugcuuuuagggagcagguacagcggcuacuaaaauguucagcagucacacaggaaugcugagagcagauagcugcaggcagcuguuguacaauaaaccaguucuuuccuggaaacagccaaaguguacagaauuuauaacaaauuagaaguauuaguugcuauuaugaaaaaaaaaaggugguuaauacuuuuuaaaguuugauucuaauacagguauuuuacccaaaaagaaaaagaaaaugaaaacuguguuaaacauccuagaggucguuauggaaucaaauuuggcuguacauuaucuuaacuuguuuuuaguuauuaguguauaauagagcuuuacuaguaacuacuuguugcaacaaucagaguugggguguuuuauguuugucuguguguugcucuaaaugucauugcaaguaaacucaagaccuuuugagagcaguagacuuuucauucuuuugcuucugcagagguuuaugcugaagaggagaacuacaaacccuuacuuacugaagaagagaaucugcagugcauuucaaaagaaauaaauccaucagcuacuguugauucuacugaaacgaaaaguccaaaguuuacugaggugucuccacaaaugucagaaggaaauguggaagguauauuauaaugauuuuaauuagcuaaguugcauuugauacugaaaguuuuucuuuuuuaucaucaaaauuuguguauauguuuaaguaauuaccucgaauuaggcucacuauuuuuauacuuuuagcaacuguggcuuuuuuuuucuuccuguuuuugauuuuuuuuaauuuauuuuuuuaauuagguauuuucuucauuuacauuucaaaugcuaucccaaaaggcccccagacacuccccugccacuccccugcccacccacucccacuucuuggaccuggaauucacccguacugaggcauauaaaguuugcaagacccaggagccucucuucccaaugauggccgacuaggccaucuucuaauacauaugcagcuagaggcaugagcuccgggguacugguuaguucauauuguuguuccaccuauaggguugcagaccccuuuagcuccuugggugcuuucucuagcuccuccauugggggcccuguguuccauccaauaguugacugugagcauccacuucaguguuugccaagccccagcguagccccacaagagacagcuauaucaggguccuuucagcaaaaucuugcugguguaugcaguggugucagcguuuggaggcugauuaugggauggauccccggguauagcugucucuagaugguccauccuuucgucucagcuccaaacuuugucucuguaacuccuuccacggguguuuuguucccaguucuaagaaggggcaaaguguccacacuuuggucuuccuucuucuugaguuucauguguuuugcaaauuguaucuuguaucuuggguauuagcccaaaaacuuagaauacccaagauacaagauacaauuugcaaaacgcuguuuuugauuuuuacgaccaagaguuuucaaggguuguuauaugggccaggcuggucuuccagaauacagaguccugcugucacugcuguuguucuagaauucaggcauguguggccuuccacacuaagaacaggcccucuuaucgcaguauuuuaugaaucagggacugagucaagucuugacuuaugaguuuucuaauacacugugucuuugccuaagagaucaguaagacugccugauggcuuuuccaccaucuuggaagguacacuucagaggcuuaguaacguaggucucucucccuccugcuuugagagccauguggaugcuaggaauuaaaccuugguccucuagaaaacaaccagugcucuuaauugcugagcauuucuccagccccuguuuuucccaucuucugugcuucccucugugaugacuuuagucaucuuuugagucugagaugggggaaucagaaguccccucugaaaaagaaaaguucuaaugaaucuacagccaucucggaugcuauaguaaaagccacuuacguuucuguuuguuuguuugcuacuuauuucuuuaaagcuaacaagggaauuagcaucucuguuggucauaguugucacaaacccacaaagucaacccacuguaggaagccaggccugcccuucaaagggaagagugcuaaagaaucuguagccauuuuuaaccauuucugcccaguaacuaaaaauuacuacauuccuucuacacacaaauugaucuuuuagucucagaaaauugccauggguucuucuaagcuagaugaacuucucuucuaaugccccugaccuccagauaccaaccagaagcugccaguuuucuuaaccauccagucaugaauuggaguagcaucaccuccauuguguuucauuugugaagguaaaacaguaccuucugcaaaacaagacugucagagacuguuucaugcaaccaucuuuaguucaucauaguauaagagcuagaagcaugguaguaguggauguuccagaauaaugucugugcuccucaaaagauguauauguugaaaucuaauucccuguguauuuggagguaauuaaguuugaauuaaaguagagccucaugaauggcauuaguauccuucuaacaagaggccagagagccagccuuugucaugcuagaaauacaggaagaaaaaggcugucaguauaccuagaagaaagcaucuuucuccagaacuuacugugcugguauccugauacuagauucucugaccuguggagcuaagugaaauuaauuucuauuuaagccacccauucugauauuuuauuauaguagcuuaaacaagacagcauauuguguccuucuuaaacauuaagaauaaaacuuuuaagaaaugaaaucaacuaacaggauaaguaugcaguaaugaaggcuguauagccuagauuggggcuggcaagcuuaacauucccugcaaagagcuguggaguacauauuuuacgcuuugugaagaguguagucacaaauugaguuuacagaauaaaguaaguuaguugguuuuaauauggcuaaagauuaguggggguauuggacuguggaccugccccuuuaggaagcugaucacuccacaguccagccccacagccugaagagaucaggcuuugcucccugcaguucuuugucugggagccaucugugcugugguuuuaccaccccuaauucauagagcuauacuaaauguggcuccucagugcugucagggggcuacguugaacuaagucaugugaugcagagugucaugucagcucuggaaggauauagaagucagauccuucccuuuguucaggggacuucucuagaguugcccccaucugucauccugucuauggcagcugucugucucuuauuuuaagcuguaccucuuaauaaaacugcuuucuagguucuacagggaaagcuguccuccaucagaccuucuucuuuacauugucuaguagaaggugcuauccuucuuaaugcuuuccugugucaaagucugaucauagcucccauuaucuugaggucuuuucucuuaauaaaauucaucccugaaggaaaaguugugucagcuccuuucuggaaacaaccaaaccauuugccacuaccucuuuuucucuauuugacaagaacagaauuacauacuaaaacaagaaauagguucuuuucccucagugcuuacuguauaugaaugaccaaaaacauucaugugagccacagauaaaaauuauuagaauuuguaugucucuugucuuucacaaugggucaagaaaagucauuagaaauuuaaauguaagcaauaaaaguaugucucaauucuagaaaagugagcaugguauugaaugaaguaacaguauaagcucucagacaggaaaaagagaaguaucauggggcugaacaaaggcuuggcaaguaagcacuaaucacgaggaccagaguuuggaucccagcacagcuggcauccugcaaaccccaaugaugucagcucugagggaucuagcucucuucuagccucuguaugcauucacacauccuuguacauaugcauacacccauguagacauauacauacacauauguguacauaugugcauacauacauauguggaauacuuuuuaaagacugccagaauaacagggauaguucccuagcuauuaauuauuugaggauauaaaugaaaauagauuuuccauaguccacuuuuuuucuaggccauuguaaaaguccagguaaucauauuguguguguguguguguguguguguauuuguuggaaaauagauuuuaaagguuacaguuuccuuccuaaucauuaauaucacagucuauuucuccaaacuguaacaacagguaucuuuacuuuuuaguuuugaugccuuuaagcuuauuuacauauuacuauaauuuuaauaaggcauacauuuuauauaauaaugaguauuguacacaguaaucaaguauuuguguuauaccaaaaagaugaaaggacuagucuuuucauuucagaagugacuacucuacaggacuaacacagaaaucuuaaaacugguuuguauauaauuagcauuaguuaagcaaauuauagugauaacuuaauuaaaguuuauucaguccauuuucgaagaaacuuuccucugacaucugauuuucuuugaagaaccugaugauuuggaaacagaaguucuacaagagccaaguagcacacacacagaugggaguuugccaccuguucuuaaugauguguggacuagagagaaggaagcagcuaaggaaacugaguaaguugucuuucucuauacuuuucaaagcucagucccuuuagaaagcucuucaauaaguaaugcugcaugaacuaauauucuaguuuaauaacuucauauuguagcaccauauaaucugauuucauaauaguuauucacaugggucagaaaucacaaaguacaugacaauaaacaguaaaugucuuaccagccugcauuuccuuucaucuaaauucugauauuucucugcagauaacuuauaguauguauaaacaaaggucuucagcccauuccaaauauaguugcuaguauaauaauagucaaugcuuuccaccuuuucagcuuuaaaaaguuuauuugugugucugugcaagugugugcucacaugugugugcacagguacuauggagucaaggaggcacauuagaucccuuggagcugaagcuuauguguucaugaguuuucccauaauuaugcuaggauccaaacccuaguccucaugaaggaguagcaaguucucuuaacuacugagccaucucuccauccucaccuugcuuguuuuuuuaaaaagucaguagucuggggaccaggggagauagguuaagagggcuugcagcuuuugcagaagaccuagguuugguucccagcacagacauggcaguucauaggcuccuggaacucuaguuuuagcauaacugaugcccucuucuguccuugugcacuuguggugcacauacauacacucauguauguacacaaacacauacaugcaugcacacacacauaaauacacaugcauauaaaauauauauuuuuagaaguucauagucuaggaaguuuucucucauuaauauaugaauauauauguguauauauauauuccauauucuacuacauggauguaaggaugacucaauaaguccacuacuucaucacuacuuacugaugcuauauauugugaugcuucaacaaguaauaauuuauauaaaguguuuuugcaaaaguagauguguuugguuuagaaacauagagguauaauuuuaagugaauugcauuuguaauuuagucauuccucaaaugaagauucuaccgcuauugacauucaaaaugaaugaaugauuggugacuagugauuggugaguuucauuuugcucaaaguagaaaauacauugugcuuacaagagaaaguauuauauaaaaaugagaaaauacuuggacaaggaagcaggggauacuaguagauguggguuucauuuucuuuauaugaggaaguuuuauuucuaauaaacugugguauuuuuuuuuaauuuuguuugguucaccugucuauggaagguuggaagauaagguugcugugcagcagagugaaguuugugaagauagaauuccagggaacguggaccaauccuguaaggaucagagagguaaauucaucauaauuuucuuuuaaaugaaaauaggccuagagaacaagaaucugcauuagccagcccagaauuguaaguuaagcugguaacuuuuugguaaguuauauugcucaaaaugaaaagaauuacugcuaaaauaaaacuaauauacuaagggcagugaauacauugguuucuuuuaaaaauacuauugguuaaaauauaagauaauauaaauaauuuuccacucugcauaaagaaaauaaacugaaaaaugauugucuaaacugaauuuuuauauuucuuugaauuucuauauuuuaaaacucccaauggaggagcuagagaaaguacccaaggagcuaaagggaucugcaacccuauagguggaacaacauuaugaacuaaccaguaccccggagcucuugucucuagcugcauauguaucaaaagauggccuagucggccaucacuggaaagagaggcccauuggacacgcaaacuuuauaugccccaguacaggggaacgccagggcuaaaaagggggaguggguggguaggggaguggggguggguggguaugggggacuuuugguauagcauuggaaauguaaaugagcuaaauaccuaauaaaaaauggaaaagaaaaaaaaacuacaagcaaauaaauaaauaaauaaauaaauaaauaaaacuugcaacuuaaugaaagcaucuauuaaauccugaaauuaaaauacuauauuuccuuagagauuauuuauaugguaauauucaguauacuuccauguauacuuugauuccguuuuccugguaugagguuguuuugggauggaauucacuuuuuaauuaaaaaauauuuuaugugccugagaaguuugcguuuguauacacaauuguguauugcacauguagucuugcuacccaugaaggccagaagagcaugucagaucucauugagcucaaauaaagauguuuuugagcuguuauauggguccugagagccaaacccaggucccuguaagaacaacaagugcuuguaaccacuaagccaucucucucuccagcccuuuggauggaguucauguuaaauaguauauaaaacuuguugauauuuagaauuuaaaugcucuuuuguagacuuaguguauaaacucuucuguauuccacagauccugcaguagacgauucuccgcagucuggcugugauguagagaagucaguacagccagaaucgauuuuccagaaagugguucauucuaaggacuugaacuuaguucaggcaguucauugcucaccagaagaaccaauuccaauucgaucucacucugauucuccaccaaaaacuaagagcaagaauuccuuacugauuggacuuucaacuggucuguuugaugcaaacaauccaaaggcaaguguggucucagauagauaaugcucucucugcagugauagcacugcuugauugccaguguugggcuuuaauugagccaaacaaguucaaacacacacacaaaagcaacaauaauccccuauuuuuuuuggcuaggguucuuuuuaguuacuagcaaauagcuauggagccaugcuugcucucucaaugacuauccuauuuggagauauacuccauauauuguuuauguagcuauuuuuauuguauauguuacaguauuauaaauauuguucugaugugaacaaaaaauaacagccauuaaauaucuucucauaguaucuugaaugaccaaauacuccauuaaguugcuauaucauuauuacuacuuccuuuaauuuugagauuauaauuacauuauuuuucccuuccccuuccucccuccaaacccucccauaugccccuccuugcugucuuucaaauucacggccucuguuuucauuaguuguuacauguauauauguauauauuccuuaauauaaucuguuuagucuauauguuaauuguuuauguuuuagggcugaucauuuaguauugaaucaccaauuguucugcacuuccuuacugaagaucaguauuacucucaguauuucuuuauugccuguaguccuuuauauaggguuaaggccuugugggcuuuccccaucuacuuuggcauaucaauuuuuguuagcuuuguuuagcucauguuuagcuaguccuguuaguaacacuuuauaguuguagcuucugacaucauuaguggaagauacuaucuuacagcaaacucucugauccucuggcucuuacacuuuuucuauucccucuuccccaauguucugugagcauuauuagcuaugggaguuguuuuguauccauugggacauagcuccacaacucugcauuuugguugguuguaguuuucuguguugaucucugucuguugcagagaaaagcuuccuuggugaaagguaaggacuacauuuauacuuugugaguauaaggacaaauauuuagaauauaguuaggaauuauccuggcuuaguaaagugaagauuauagguucuuuuccagaauucaugacuucacuagccauggguaguuggauaguuuuccauuacgaguuaugauuucuuucucguugaguaggucuuaaauccaacuagaaagcuguugguuacugccagguuaugugugccacugcacucuuaagguuauagugccuauauauuggucagugcaguucauagacaucacagcuggguaucacuguuagguuuuguuuguuuguuuuaacuugggaagcuugcaggauaccuucuaguaccaugaaaacuacucaucagagaauaggccuucaggccacuuccagaucaggggccucugggaacuguaucugaagugcauaguuucuuuagcaauagggacuuuccaccucagggacaaccaaggacuguaagucuguaguauuuggggagucagucuaugggagaacucugcaugauguugagauuuuuguuggacuaucuucguaucacauuuuuaacaauacauuucuaucauugagccucugccuuuguuuauucuauaauuauuucuauaaaauaaauuucuauaggugauacuuaaaauucauaauucauuuuauuucucuuuaauaguuuuggggcuauggaaauuguucacuuaauaaagugcuucauguguaagcuuaaaccuggguuugaacccccagcacccauguaaaaccaggcagggcaguacccaccugaaaucccagugcugcaaaggcagagcaggaaggucccuggggcuugcuguccagccagucuaucaaauuggugaguuccaggucagugaaagaccaugucucaaaaaaugaaguagagagaagcuucuaagaaagaaagcuaauguagaccucuggucuacacacucauuccacaugcacaugaauuaaauuugaaaaacaaaaugauguaguuugaaacacauuuaaaaauuaagucauucuggcaguucaauuauguauaggaggaaauugauaaaaauauuugaucucacaaauauaaacacauaaaaauaugaaaauagucuuugugcugucaguuccucauugaagaaugaagaauauugauuccuuuguaugcuacauagcauuacuaucauaauuuacuuaaaauuaacucuucaaugagaaauuaauaguauuuuuuuaauuuguauuuauaucugugagauucaauauuuuuaucuauuugcuccuauauguaauugaauugccagaauucuuuaauguuuaacuauauuuuaaaauacaucauuugagguauuuaguuauaugcgucuucaacuuagaaauguuaaauuuuauuguuuacuuuaaauggcagacacuagaagauguaaauuaccaaaacaaauuuacagucuucagcguuaaauacaaaggcaaacaagcacuaucagauaauuuauguacuuucguuguaugugcaugugaaggccaguggucaaacucuggcauugcucuuuaagcaacaguuaagcuaggcuggcaaacaaaggccaggaauccugucucugccuccccagcacugggguuacaaauacccaucacuugucccaagauuuuuacaugagugcuggggaugaaacuccagaccagcugaaccaucucccuagcuccccauguguuuucuauagaccuguccuuagcccaggcuucugaauguauuccugucuaguaggcuaaaauucaaauuguguaaugcuuuugaguauugauuuccucuuaaaaccuuaguugagcuacaagacuccuauugaaauacucacucuggaaguauauacagaagguuuuacccguacuauagaccucagguagauuuggugcaaagaggcaagaggaaaacacaaaacagcauaguaauccauggccaucugagacaagaaugaaaguuguccugccuauucugagaucaggaagccauuacugggccuguguaguaaacaggcagauuuguaguaguagucaaaacuucauaacugagauaaauuuggauguagcccauugaacuaaaauggaguaauuuaacuucuuacaaagguuuuugcugcuaaaucaggcuuguuuuuuuguauuuugauuuuuguguuauuguugagguaacuuccuugugucuguuuucaaacaguuuucuugagagcucagacuuucuccucauucccuuccaagggcucugccccauugcuuuuguguuccaauuucaguccucuuccucuauggcggcucauuucugccauguucuaagaaaugucauggaaagaagcaagccuggguugaccacgcaacccuguuuacucaccgccugugucugcucuuucucaugucuaaacggcuaccuaggcugcagucuacacaugcauccacuuccugcgacacuguguagauguuggccauccuucucuaacacugcaugucaaggucagcaguugggaggacaaugccaccccgaacccuuuucucuccuccuugacacugcuucucucagcaguuaugucuacacuucacuugcaucaugcuuuccaaguuucucucugaacugacuaaugacucugcagcggcuccugugcuacacaccuccccacccucaagugcauucuuaagcuucacgugaaguguccucuaaaugucagucaaaucacggaaguugauccuuguguccaaacuccuauagcuuuccugacucuuuuuguauacuugagcugucaauugcugagguugacauuuuuaucuauacuuguacuauuucuucucucaauuguaucaguuuuuauccucugcauuguagaguucuguugagugaauaaacauauaguguuauuuugucuucuggaugaacugauauggcacuguuaugacauguucuuugauaguguuauauaagacuucaaagcuuugccacuuuucuuuguacuuguuuauuaaguacugagaaagaauggugaaaaugucauuuaguugcauuuaaauuaagaguucuuauggcuucuugaacccacuccuuuaucaguaugaagugaaucuugugaucucuagacaucaucugaucugaaguguacauugucugcuucugauagucaucccaacuuucuuauguuuaaccucuauacuguguauaaauguuuacauccuugacuacuuucauuuuauguuuaaaguggauuucucaugauuagcaagaguccaguuuugcuuuucuuaaaaaaucuuugugcauguuugcgugugugcaugcaggcuugugaauacacaaauggaggccaaaagauaccuacagguauugguugucaucuuccaccuugagacaaggugucuucuuguuggccacuguaguaugccaggcgggauggcuggccucaaggcuucaaggaagccuucuaucccaucccacagggagcugcagauguguacggccauacuggcuugacgugaguucuggaaauccagacucaagauucuucccauuugaacagcaagcacuuaaccaauuuggccaagaggagccaucuccucugcuaggacuuacauuguuucugacauguuucacugucaugaaaagcacuuuauuaauaaaacaucuuuaaaugccauaugcuauagauaucugaagauuucaaagaccaucuaucuauguauaguauaucugaauuguuuguuucuaacuauuuacuaugcauuuaaucuaggaaacauauuucuguaauuaaacuaguaucuaacaucuaacaugacuguaaauuugauugacuauuaaaucgcucuuuuuuuuuuuuuuuuuuuggccuuggcucugcuuuuuugaccuuggagcacccuuuggauauaguuuuaaaaaauaagcuauauauacacagugagaacuggguccagacuggugcaccauaucuccagaaaaaucccaaccaaagaauauuuaaacaaaacaucagaagggaaaccaugaggcagcauggugcugagcugauguguggccaguuggcaaggguagccauggucagugauggagcagccaggccacgccuccuucucauaagucccaacacauugccuugggugagucagaaugacuuucccgucgcuuagcucccuuguaagcauacucuccugccuguucuacuucugcacauggacaacuuugccucugcccaguguuaggacugacuuaaccuuccugucaucugccguuaccucuucaaaaucuacccccagaugaaaacugaucucugugcucuugaagguacuauguaucuuuauggugauaguauccccacucuucucaaugacugugguaggcuuggucaugcuugccaccugccugguggcaaagcccacaccaagugacuucauguagucaucaaaauucuugcuguccacuagcuuccagugcugacgaagguguccaccauggugcgaugagagaggaggugugcaggcacugagaacuaaauugcacuucuuuuuauuuuauuuuuuuguuuuuguuuuuggagacaggguuucucuguguagcccuggcuguccuggaacucacucuauagaccaggcuggccucgaacucagaaauucuccgccucugccucccaagugcugggauuaaagguggguucaccacugcccagcuaaauugcauuucuuaauuauccuaaauaguugguaauagcaacuuucaaaaggacuggaaauucgguacaauacuuuaaauaaaguugaaacauauauauaguauguuguaaugaaauauaauucuaaaccuguaucaauauacaaaguccauaccaaauuaaaauauuuggcuuguuaaugcucauugaucuaacaguauauucaauaauauacccuuuauuuucucaauucuauauccccccaauuucuuuuuaucucuuauccccauuuuucuuuucaucccuucucccuuaacucuaaauaggagagaaagaaggauagagaaaauaaaaagaaagagaaaaaaaucccugaaucuaacuuccuuuaguuuguuucccuccuuacaagaccauuaauaacuugcauccaacccccuguaacaaugacagacauccacaauccaucaucaaucaacugaacaaaaagcacacaucccaccucuugggaaugaggccuucauucucuugaaauugcucccuguucucuguggacaguguuuuuuuggggggacuaagaaaauugggauauuggcuagucuuaagaaagcuagcugugggcuggugagauggcucaguggguaagagcacccgacugcucuuccgaaggucaggaguucaaaucccagcaaccacaugguggcucacaaccauccguaacgagaucugacuccuucuucuggagugucugaagacagcuacaguguacuuacauauaauaaauaaauaaaucuuaaaaaaaaaaaaaaaagaaagcuagcuguaauauuuguuguccagucucuggaaauggacauuccaggacagccagggcuacacagagaaacccugucuccaaaaacaaaaacuggacaccuuugucagcacuggaaaugaugugaaaaugcagggcuuaacugaaguccugacuggaacagucugaagggcuggaccauccucgcuagcuguuuuaaaacuguuccaaaugcagauccccaaguaggacgcuggaauaaauauguuucagcagcucagcaucagccucagcauaucugagggucagucuuuucaggggugcucuaccuuccuugucugguggguuuucucugugaauguauaagcuuuuaaugguaauacacauguuuucauuaacacauguauagaaugugcagugugcauaacucagcuaaagaugauucucucuucuuugagcagguaaggcucuguuguauuugugaguguguuuggacuguaaucuuaauuuucauccaugcuauuugaaaggauggcgugguaaguccugaggacuccguggccaacaagauuuauuaccuaggcuuagcuaaaguccuggagacauuuccaugucucagccuguuccagaguuguucccaugcagagggaucagcgugcuugugaccugcuuuguuguggucaagucagauauauuauagcucucaggucaagucagugcuguguguaaggcuugagacuuucugcugcuguuaaguuguauucacucuucaccgugcucuguaagacauuaagaaccucccugacucaccucaaaguugcucucauucucuuuucccuugguggccaagcucuucuguguuacagacugaacuuucuguuagccuugaccagaccgggcuugcuucucuuaguucugcucaguucuaacucauuucugacuuucaagcaucaccucucaaguauuauccucacaagccuuaaguacgggaauuuccauccugagcuacuuuuuguuuaauuuccuaguagcuauaaaaauagaauucaucuugguuacuuauuuucuacuguuucuuuuccaguagaauaugaucccccuuaaguuauacuauucacagguuuuacacacacauuuauauguaaucuaaaguggguuauuauucgcaucuauucagccaaugucuaucaagcuguauuguauguuagguacuaugcuuauaguaaugauacgauguucauagccaagaaagggaauaaauuaagugaaaaacauuugugauaauucuuauaaggagaaaugaaaauggguggauagugugccaggaaagaagacaugccuaaggcugcaccacgauagagaagagguuucggugcagauguugaaggccuggccuuggagaacacuuaaagcagaagcagauguucugaagcagcgcagugcgcuuuggugcgagggccugugaaugaggcgaggcuggagaaaggcccaccaguuaggaacacuggcuagucuucccucguucaguuuucagaacccacauggcguggcagcucacaacugucugugauucuagucuagucccagggagcccauucuucucuucuggccauugcaggcacugcacacaugacauacaugcagguaaacauucauucacauuaaaaaauuuuuuucuuaaaauaucaaagugugaagacaguaggaugccaaucauucuuguuccuaauuaauaguguucaaauauguggcucagagccuuuugggaguguuuuguuugggguuuugguaugguggaauuuauuucauuucuaaacaaggacacugugugugaagagauggaaguacuuguugcucacguuaccccugucuccuugcccucuuguccucugccucacagcugcuuuagacauaaccucagagcccuaagacucaggaaacaauacuaaggcauucaucuaguguacuuuaaauagaucuuuuagcaaaaaccaaauguaauguuaguuaacugaauuguacaauuaaccacccacacagauaguaguuagugguuaaguugaucacuguaagacuggcaaucaaaguaaugcuuucauuaacacuguccgucagugggacuguaagugauggucuaaaacaagcucggguccuagaagucuguucuuccuuuuacacuguuuacauaugcaaugacucaggcaaguugaagauuuauacccaaauauauaaauuguauuuaagacugugcauuauacaucagcaagccauuagcaacuguuauaauagucauuaauguuaauuaaguaaaaauuuaucuauguaguagucaaagugaaaugaaaguuauaaacccugcuguauuucugaggcuagaaaauuaugaguuguucaggggaaagcuuucuguguuuuucucucgagagaagauuucucuucuggagguuucuuugugcagggucucacuuucuacccaggcuggccucaagcuuucaccuucccugucuaugccugccaaguacagguauauacaaccacauccagcugguuccuuuagaguugguaagaagugauggcuucacguccauugcuacugcaaacagaauagcagauuuccuaagguaauuaaaauacaaugauuugauaaaaauguagauauaacaguaaauuguagauucucaacaguaaauuuuaaaaagucaaaauaaacgugguuuucucaugaucuuccuuuuaaaaguugcagaaucuggauuacuagaggaaccaauccuuugccuuuccaacagucccauuuugcaaaagggcccacaacagugguuacucuguguagucuggcaaaggcauauauaugguugguugguagaaggucuguaugacuuagagagcaagugaggaacagauaagguuaaauaacuaugauagcaaaugacuguaauuuuaccaagagucuguucuagacaaguaacuagccauuuuauugaaaaugggagaauuucuagcucaacuucuuuauagaaggguuuugugauuugccagugauugucuguauucaaauaacaaaguauucauucuaaaaacaaaaguuuugauauaagcacgaccuggaauagcugagaugcacaguccugccaaaccacugcuuuagugcauuggacagaguucaggaagauagauuucuggcauucaugguugaccuggccgguuccugggguguuugaaucauuuuaugucuccuucucagcuauuaaaaaugcuagcagcguuuucaaagagccacgaguacugaugccuuuaugaugaauugcuauuauguauaccuugucaaauauaauugcaaacauuaaacaagacaacuacauaacauuaauggguaguagccaguuaaacugugaaaagagucugcuaguacaauuuuuuuuuuugcuuugcucucugacagagcaaauugccaaauuauuaucucacccaugcuuaauuuauagaaaaaagaccauauguuuagaauaauacagaguauucuuaauuuucuguuacuagaacauucuaacucacuaaaauucaagcaaauauagauuuaggguuagaaaacggccucucacugcccccaguuaucucuugagaagaauucuagucuacuuugacuucuauaaagguggcuaacacaauuauaauccucauugucaguacaacauagucaggaaacucuaccaaccaugugugcaguucuucaauauuguuccagcagcuuuacaauaauaaucucauguucacggucacccagguaacgcugucaucaucccaugucacacauaagcaacuuggccacagucagaucguggauaccucagccauuaaguuccaaagcgauuccucagagguuuccagccaggaaagcugcucucauauugcagcagugccaacaaguacuuguagagaggaaaaucuaaacuuuguauuuguuaugacagucaagggaaauuauugguaaauuucuccugugaauuuucuaagauaguaauauuuucaagguuaauuuauaaucccacgggaacuaaaggaauacgguagacaacugugccuuaaggccucuucaaauuugcagacuuaaaguggcuuaagagucagucagaugaaggccacagcaucaguucaguuucuggcacagguaggugggaagucugacugauucugccuacagugaccaggcacuaagucagccuuagagugugcgaugugagcuuccucaaaucaagggagcaccaguuuuaggauacugaaacuuagaccucuuuguucccaccccaccaccacacccaccaagcacaugccaagccuuuuacuuuggauucuauuuuuuuuaacauaauucuguauugauucuuuaugacuuccacaucauguacccaggucuucucauuuccuaggucuucuaugucugccccugcaaaagaaaauaaaaaauuaaaauaaaaaaaaaaucucaccauggaggcuguggugugucacacauuauacccuuuuccccaaacaacuuuacuugcaaauguucauugcagugagucacuguuugguucaaggacucuggcuucugcuaaucuauucuuaaauaauagauagaaucuggcuuggggaauaaaguuagcaauuauuuguaaaagcuguuuugagggaacauuguugaaguauucacaguaauaaucagaggcuaaacaaaugugcccauaauaaacugcuuuauagcauaacaggaggauuacuaauuuauaguuuauaucaaaacuuguaaagauuaaaagaauuccuugauguagaacuugaugugaaauuacuaauaagacuagcauguaacucauuugcugcuuuauguccccuuacuuugagaugagcaguuaccuaguacugaagaguaaaggagcagugccuugggugcgagguucccuacagcacugcuuuccgucugauguugccacagggcccgcugcucgcugguacacaguuggggaaagccguaccuccacugaaguaagcucuccaggcacugcuaggggcugccccaucuuuuuaggauuucuuuccauugcugcuaagacaacaaaauauacuuuaagcaguaugaaaaaagucaggagaaucagaacagaaaugaaaaggauccaggguuauaccucagggugugaugugggcugcuugauaugcucauggccugaccucagacuuagcaccaaauaaaugggaagaacagaagcauucugagauagguagguaaguagguugguuagauagaauggagagagagagagagagagagagagagagagagagagagagagagaauauuacugugaauaaaguuuugauauaaacuauaaauuagcaauccucuaguuaugcaauaaagcagauccauuuaaaacauaaaguaagaauccaguggcagcacuugaccaugauuccacgugccgcauaggacaaggcaggaaaaucguaagcccaagcccagcguggauggcuuaaaacagaucauaaagucugaaggaggcccagcaaggaguacugugaacacaaagguuuauccuacagauacacuagugagugaguguaagucuuaaggagagguaaggugucaaaucaugggaccccuugaaguacacuucugauggaauuauuucaugauauaguauaaaaauuauauuaauacacauaguagcacacaccuguagcuguagaacuuggugggcagaagcaggaaggucacauuccugggcuacauaucagugggaaaaaaaguuauuuuaacuauuaagaggaauaaauuaaaauuguauugaguuccuaaaaaaugcuaggaugagcuaaauuuucccagccuguauauaugacauccucaaguuuaauuguguaauguauccuguuuauuuuguugguuagcagucagccugcguagauuguuacaagugcuacuuuauauucuucuggcucaguacacacauggcccaaaucuuaguaaguccaaaguuggauguggggcaccugcagucccagcacuggggccaguugaguggcacugagagacauaccucagcaccauugccaucuuuaagugcuuuaagaagcacuagguuuuguugguuugcuuuucaccacuuuggccagcuucaccaguuuguaacugaugaucauucucuuaauuaguguaauguagaaaugguguucaaauaaugggaaccuauucuuuauuauucugaaaugcugcacuaagaaaauuggccaacuacgcaaauuuccaccacuguguguuuucuucaaagccuucccuguaaugcagagcucuuuucagggccuagcacucacauuucaaucucagauuccuggagagucggcccagcccagagacagguccacagcuaucugucucgucuccuguuugucacaugcuuauuguugaaagguugaugaauagagacgcuuccaguuauuucugcucuuguccaacacugauuucguuuucaacaccuccgcugucuguuguuuuguuuguuuucuuuagcacaguuggccuacuuccuucuuggugguguuauaaaugcuuuuccucauugcccucaaagaacuuguccuugcagccuucugucugaacaugagguccccacucagccccaucuuggggaagcaaagucagguuucucuucacacugaucuaacccauguuagccagccagcaacuccucggaguaagugcugcacaguggcugacugaacaucauagagcuucaccgcgcuccagacaacucgcuucagcuuucagcaggucugcacagggcaaguugaccacaggaagguaggagaaacaauacacaugagaaagaaccaacgggcacuucucacaccugauugccagcagcuuggcauuucaaggccaaguguaucuccaaaauagccacucuccacucuuuaaaagcugacccaacugaacugcuaugcuaaagcccaaucguuacucacgaguuuaacuuucuuuaugaaaaaaaaaaaugcuagcugaauuuuuaauuauuuuuuuauauuuuccuacaugaguacuacauuugcauaauuuccaauccuccaucucccccuccaacucaucccguguacuugcacauccucucgaauucauggccucuucuuuaaugauuauugguacauacaugcauaugaguguuuaauaagucuaucuaguguugcucaugugagcugaacuuuaagaaaguuggguucuaaccuugggcaaggccccuuugaguccuuuaggucuaacuacaugacuuaaguauuguaacuaguauuaccucugauuuccucuucugauuucaauugucuuccuccuaaugaucaaucugugaaccucucugcagaugcugaggaccugcucacuuccagaucuuuccaagcuguucagaacccuaauggacguucccacugugggggacguucaucaagacagucuugaaaucgaugagcuggaagaugaaccaauuaaagaagggccuucugauuccgaagacacguaaguauaggaccacuaacaaaugccaguaucacuuugacaucuagauugggauuuucuucaaaguccagagagugagcauggucuacagcugccuuuucuucacccuucaagcucuuauaacuucguuaaaguguaaucaaccuuuugaaaauguauggcugccucuaaacaauuuacugucucauuugaggcacauaaaaacagcuuguauuuaugcucacuguuuuuuuccccccauuaacauccaucuaguacacugaugugacuauacugauuacuaaauaguaguuaaauaauuuucacaggauaauaccuguugaauagugaaaucuccauucuacuaggauugagaugggaagcagggaaguauuaaaccgucugcaugacaucagggagaugcugaaaacuuuccugucuguuugugacauuugguuuuaggauguaucagugaggauguuauuuuugugguauauguggaagugggguaagguaacuguguguguguguguguguguguguguguguguguguguguguguugguuugcauguaacuucacugcuuacagaaaauuccuuucuugugauucaugggaaauauagaacucaggaagaaauguaacaauguuucugaaaguuaugggaaauguuggcugagccuuagauaagaauccuucuuggcuucugcaguuuuagccuuccaacugccucaaacaaguauaacaaacucagaggaauaaaccaaaauauccugcagucagaugcuagaagcagcacagcguaggagucuggugcagggguguagcuuggguagaguagcuuagccugagugaggcugcaguuggugucaggauugcugcaucugacauguuguuacuucuuccuaaugaagcuccauuuucucaucagcccucuuagagaccuguggaucuuacuaggaaccuagugguuuggagggaggucacuuuaguuccuauuuuagucggcuuacuggggaacacaacauacaucacuuauggucgacaaagugccggguaaugggguuuguggguuuguccucuguaaguaaaaugaaccauuuguaauugagccagcuguaacaaaacuauucuacaucuacuuguuugucuuuggaaacugacuuggguccguaccuuucuccagauuuuauaauaagaacuaaaaacuaagcuuagggccagauuucaaauaaccuaacugucuuagucaggguuucuucuauuccugcaugaccaagaagcaaguuggggaggaaaggguuuauccagcuuacauuuccacauugcuguucaucacugaaagaagucaggacuggaacucaagcaggucagggagcaggagcugaugcagaggccauggagggauguucuuuacuggcuugcuucuccugguuugcucagccugcucucuuauagaacccaagacuaccagccuggagauggcaccacccacaaggggaccuccccccuugaucacuaauugagaaaaugccuuacagcuggaucucauggaggcauuuccucaacugaagcuccuuucucugugauaacuccagccugugucaaguugacacaaaacuagccauuacacuaacagagacuuguaaaugcugauuucauacaguauuagaucuucucacauuuuucuuaggcaacagucaggcuggccucacgaauuuuaacuccucuaugucuuggccauuauuuccucuagcuaauaaguggguuaucagcaggucaacauaauagucuucacaugaaagauugaaugaugaguuaggcuucuuauuaaacaccaagucuuauucugaucagauuguuuucuguagcuuccacaaagucaaauggcuaguuaguaugcauaaguacaaaauaaagauauuucuguguaaaugauuauuuucuuuuccauuaauguaaauugucuucaaggucucauagaguguauuugggaguuggcuguaaacuuugggaaggguccucaucagcccuauauauuucuuagcauugcauuucuagucuagggacuccugccgauggcccugaccccucacuacaaggccucacacaucagacucagguaacuccucaccuucaugcauguccucagagauaaacugggagucuuagaacugaguuucucaguuacuguacaaguguccaaggacagaggcuagagauccauugauaggccucuuauauuuucaugucucuaccaugaguuucauuuggauaaaauuuaaauaggaagaaacuccuuaguaaguguacuacauacauauaagauuuuuaccuauuaauugauuccacauuuuaaaucucagaaaauaucauuuauauucugacuaaugccuugaaaacaaaauucuccugugaggauuauggccauuguuuuauucuugggaaaaucuauuuauauauuuuagaauucuuuucaggaauauacacauaaagauaaauuucuccugacuauuauauucacuguaucaucaucccguuagccuuaaaaagcacaaauauuaugcaagaccuuaaguacaugucucuaaaaauccaaauacauucacauggaaauccuugcauauaguacacagcuaguaucuacauuaagauugugauaaacuuucaaaauuggaaaaugguuuuuccaauuuuccuuuaaacauuugacuauuaauucauuuuuuaaaaaacaugugauaaacaucuuugcuuucuuaacuuccccaacuacaggugggacacacagacacaaaccuuuguugcaaaguuuaagcagugacugagguuaauaguuacaugagucuccucugcaaaucagcaccaauuucagcaaaucaccuauaguugcagaguaccccucguguacuauuuuucucaguuguauucauccucaauuccuuaguuaaaaacucuauaugcuuauuucagacuucuuuuuuauccacaguuaguacuuuuaaguggaagagaaugcaccauuucaaaauaagauuaggcaguauucaguuuaacucuuuacauuucaguguauuugaagaaacugacacagauuuacaagagcuucaggccucaauggagcagcugcuuagggagcaaccaggugacgaauacagugaggaggaagagucuguuuuaaaaagcagcgauguggagcagacagcaagagggacagaugccccagacgaggaggacaaccccagcagcgaaagcgcccugaacgaggaauggcacucagguguguguucacgguggcucacggcugcucauggcugagcgcccguuucugucucucugcucagaguucacguaggaggugguuuccugguaucugauagggacauauccagccuuacaguugaugugugcuucugucugucugugcucacuguguguuccacacagacauaccaaccgcuucucaguucuucuguuaagugacuucugaaguguuuucucucuguuuuggccccuguuccuugaccuuuuuuuaguaauaaagcuuaauuuaguuugguauguaugcuucuuggcucaucugcaucugcaucucuuugcauguuuuguuccauguuugucaagccuucaucauagguuugguugcuucauuucagaacaucaaaaugugauuuuuuuuuccauuuguuucugaacuaacauuuaauagugagguuucugggagucuuucuguaguaaccugauuuacuacuuauguccuuaaggaaacaauacucaaacuaagauuccugaguaagacagcuuuauaugugcuuugauguccagguauccuaaugaagacugcuuauauugaagguagaagaauacaggaagccaaaguucacuuaucauucaugcuagucuacuauuguaaaauuacuuuuauucauaaaguacccuuuuuuuuuuuuuuuagauaauagugacgcugagaccacuagugaaugugaauaugacagugucuuuaaccauuuagaggaacuaagacuucacuuggagcaagaaaugggcuuugaaaaguucuuugagguuuaugagaaaguaaaggugcgugaacuuagacacugucucugaugugcugcugaagaggagugacaaguuggccguccuuaucacugcauuaggaucaauguccgcacacacacacugaaggcuccacuuaaguuagcauuggcacauuaacuguuaaacuuuaauugcaucauuucucccacucuuucuuccugccucuuccauauggguccccucccaaauucacagccuccuguuauuuaaccacugauguuaaauagaaaaggauagacacauguaucauuuggggccaucaauuccuaugaugguuuauucucuguauuuuaacuagguuuagcuuuguguaauggucuccugcuaguguaaagauaagcuucuguguugaaaggugaggucuacacuuaacuuauaaugguaaguacuuagaugcaguuaggaaucaggcuaguuuaggaacgugguaguagugggguuuuuuucuaagaucccugaugucaccagcuguguauaguggcuagguuucuaguacuaggcauaguuucccccguguugagcaggccuggagucuagucagacagcuauugguuaccacugagauacaagugccacuaucagaccuuccagcagagcuggcugugcucgucacuauuacacuagcaggagacccuuacacaaagcuaaaccuaguuaaaauacagagaauaagccaucauaggaauugauggccccaaaugauacaugugucuauccuuuucuauuuaacaucagugguuaaauaacaggaggcuauuauuaauugcuuuucuccuuuagcagcuuccauauuaacuuacauuugguaauuuggcauaggcuauucaugaggaugaagaugaaaauauugaaauuuguucaacaauaguugagaauauuuugggcaaugagcaccagcaucucuaugccaagauucugcauuuagucauggcagauggagccuaucaggaagguaaaguuuucuugugucuucauauucuaaacaaaugagagaagaagaaaaagauggcagaugugugaugaaacucucccagcagaugggcuuugauguggucugugcuagagcccaccugauacuuugaagcaaguaucccucugcccugucacauuaagucacuguccuauaguuuguaaguaauguuugagugaauuuuuaaugccuuuuuuauucauguaugcaggcauuuugccuacauguaugugugugcacuguguguacguuucccacaaaagccaugugagggcaucagauccccuggaacugguguuacacacggcuuugagccaccauaugaguucugagaacugaacucauacucuuagccacugagccaucucuccagcccuugaauaaaaaaucuuaagucuccuaauugaaagcucaagcucuuuagaauaacucucgucaaugaugugucauuaaacucuuuugcagaggaagaaaauauaaaauucugagcaugaauuuauuuguaacaugguugccaaaacuaauacauuuaccuuaaagauuuaauuuguagaccaaaacagaagauuuuaaaucuugaugcuuaauuuuaacaaugcaauuuuuauuaaaauauauuuauauuccuucccguuaaaaacaacucaagaucccuuuuuaaaaaugcauccagguacaaaaauuaaaauaaguuuuaaaaauauuucaaaacacagcauauuagauaagcacaaaagaagagauggaguaaaauuaugauaauguuaagaaggucuccauugugaaaacuguaaaaacuuuacugugaagcagaaaauaaagcagacuguuccuuagaggucagcagucugugguggaaacagcucuccagaucuguuugcugucuugguuuuguucuuguuugaggcaaggucuugccgcagccgcuaggacagccucaagcacaugcacguccugccuuucccucaccaccaugccuagccaucuuucaugugccgccuucaaguucagguuaauucugaucccuuuaagaagggaaaggguuuuguuuuccucccagguacaacagaaucaaaaggucuauagaucuuacuacaacugaaguguuaugacuuugaaaauguccuucaguuauacuacuauaaaauacgugguuuauuuucugaaaugauaaaagauuacuugaucauuaagaugaaagucucuaguuuaacugguaucugaaacuuucagguuccugaguuuacugagaucuugaacuccaucuguacuguacugagaugagaaauagccuguaacuuuuggauuucauagguuacuucucacaucauuguguaagcuaacagcacaaggccagagaaugacuguuucaggaugucuguggugaggugaggucgaggcaguugucuccucacucgccuggcccuuccucaggcagcucugcccaaggcuucuucaaauggagcucuccacaaggagugugcucaggcugcaggauugcuugucaaguaucugaaaagcuuuuaauuugccuugccccuucaguggagagcuguaacagucaagugagccacaagguagaauuggcacagcugagugguuucuaaagggcuccuggcuucauagaagcccauucacuuacagggucacaagcuaggcuggaccauacagcccucaagaagcauggucagcucugcugugguaagcaguggaaacagaaaggacagcuguaaucucuucagccuggggagaaaauagcaguuuuaauaacauacuuuaacuuacuacugaaugagcucaugugaaauacauugucugaguaaaagcuagcacacauagucacuggauuaagaaaaagagagccuccuuguauggagcaguugaaucucugaucaagcagucuuauguauagcugugcuuuagauccugucgaagagaucaguaaucaugccauguguaugaugcuuacacgcuuuuauucucuguggcaaaaucugauccagcucauucaaaguaaagcuaguaaggggcauacuagaaacaagauuucuugaaagacugucucauaagugaggugaagagauugaggaaagcaugcggacauccacugguggucucugcauaugcacacauagaaggugcaccugcacacauaccugcucuugugcauauacccacaccacaaacaacauuuuaaccuuuaaagucauugccuaauaucauuucuguuuaauuccacuggaaauugucugagucccccaaaaugaccagcucccaugauaacuguuacagugcagguuuggugagcauuaauaacuaucucuguuggaaaaguuaacacugccuaguccauauauagcugcuuuccagagucaaaagucaaauagagguaguaauuuguggguuacuuaaaacuguuucuaggugcuccuucacaaaugaauguguggccaauggaggauuggcagagacuaccaaguccucccacugagcagcagcagaccaagcaugugggguuuuuuuuuuuuuuucaauguaccuuucauucacauccauuuuagauggaauuuuguauuguguuuauguagugaaauucuauacagcuauucaaauaaaugaaccaaaucuucagcuaucaauauacauaagcccagagaccuaaguuaaaguuaugugauaugacuuauaugacaucuaaaacaauacuguuuacuuuuacauauguuuaauaacugugaaaaaguauaagcaagaaaaauauacauuaauuuaguguccuuaaaaauguuccuagaaacggagaaaaggucaccaaaguggaaaaguagacugcuuauaauauaguuuucuuaaauaucagaaucaguaggagcaaaaguuaaccucuguucaugcuagguaggcacauaggugcucauugcuuuccagauuaucugaagcaaugcguaacucuaaaacugaguggauuaaguugcaugaagcagugacaucacucuuugggcugaaacaguggguccugcaggagaagacauccuguauagaaggauacaaaacauugcaguagagaagaugaguggcgauugguaacugacucagggaauauuucagauauugucaugaccauggugaucaggucuguggacgugguaagcagguagggagugaguagaaaguaggcgcuguacaggguguaguguuugacagggugcuuggguuuacucgggugccagagugauaggcaaaucaaugugcuuaauucauucagauguuuuuaagaauaaacauucuuaugguuuauguaacuaagaauagcuaaugcauuaugucaugcucauaaaaugcaauggugugcagacauuaaagccacauggaauauauacaucauuuguccuacaguauucuauugugagguuuucaagaaguugaacacuauagugguaccuggcauacccaccacagagacucuaccaugagcauuuauaaucuugcuuuucauaucacuacacuucuuuuuuuuuuaagauuuauuuauuauuauaaguaaguacacuguaguugucuucagacacaccagaagagggcaucagaucccauuacagaugguugugcgccacuauguaguugcugggauuugaacucaggacuucggaagagcagucagugcucuuaaccacugagcucucucuccagccccaucacugcacuucuuuauuuaucuuucuauugugugucuuauguggaaacuucaugucccaagccugcaucauggucuaauuuucuuaguuauuugugauccacaaggcaaucugaggauuuauauguacauaguuguaacacuaguugucuuugaaauuuuguaccuucauucuuuauaauacugucuggauguuguacaaugaauaugugcuauuauaacaaaauuauauuuaaugcugaacuaaucuuuagaaagggaaaaugcuuuuuauaaaaaacauagauacugcuugaacuaaaaugaagugaauuauuuuuuucuuuuuucuacagauaaugaugaauaauccucaggacauucuuuaauagucaacuguaagaacacauuugaacuuggcucauaauacaagcuuccugggaaauagagauuauuuaugagaaauaccagauuuaagaugggcaugcuuauugcaugaaaaaaauuaagaagugugauauuuuuccucacguuuuaucuaccuuauuuuguuuauuggauucuucagcuaacucucauagaauguauguuucuuuaaaucaccucaccaaagcauugagucaacugaaaauuuauugugcaauaaggaacuacuuuuagcaacugucuuucuguggaagaguuggcuauaucaaaaaaggccugcuuuugguguuucauuuaaauuucagcaugacuuuuuuuuuuucugucuaacauuuuuuauccuggcuagcaguucacauuaaauaauucuugucaagggcucuauucaaguaucuacauuuagaagaugaaauucuagccuugaaguuuguauucucgaguuauuuucaaccacuggaucucucccugagcuagcccgaugaaaacaggcuauagaagcaauccuaaaaaucauugaaagauuuaauuuugaaggaauagcaaaguuauauuuccugacacuugaaaguucccugauucuucuguuucucuuuauagaccagaaacgcuguaucuaaaaaucaggcuauaaauuuaaaccuagcauauagcauaaaauugccauuuugguuuuuagcuccucgcauacaugugccuccguggucaccuguguuaaaaaggagagagggcccuuuuucuuuuggcacugugacaauuuaguaacuacuguggggaaguguuugccuuuuauuuucagugugaggauuuaaccagguuauuacaaugauggucacauaguuucaguuaugugaaccuauauauagaaacaguuauaguuucagaauuugccaaguauacauugugucauucucuacaguccagguguuccuaauaaaauaaaagcagaaaugugugcuuuuugguaccaaucagccugauugguguaagcugucaucugaaacauggaaucuuuccuuguagcacuauuaguacuguguugacuuuauuauguauauuauuucuaacauccaaaaguaaauagcugauuuuuauauuuuuauuuuguacuauuaaauuuuuauuauguaccugaaguau

SEQ ID NO: 4451 - RNA, 3442 nt, Mus musculus
aaaaugaaagcucuaguguuaucuuuacucaucuuuuauuuuuuacuucucuuucuccauguguguguuguguguuuauccgacugcacacauguguguacacauaugugugugugugugcaugcaugcaugcacauauguguuugaguguucaaccggcaugaauguaugugaaccaugcauauaccugggucccacagaggccagaagaugucaaaccucuagaauuggaguuccagaugguuauagucaucuuguacguucugggauucaaacccagguccuaugaagcucuaagagagcaggcaguguucuuaaccacugaaccauuucucuaucgauucuuucauucccugugugugugugugugugugugugugucuugcaaagcgagaguacuaccaaugaaugaguuucuucaauauguuuaagauguagcccaggcuggccuuagacucacuacguggucuaagaugaccucaucuuccaggucuugugaucacaggcauccaucaucacaccagcuuucucuuuuauuuuuauuuuauuauuuauuuuauuauuauugaauguuugagacaaggucucacuauguagcucuggcugucccggaacucccuacauagaccagguaaccuuaaccucacagagcucuacagaccucuaccuccugauugcugggacugcaggcguguaccaccaugcccagcuuuuucuuuuacuuuugaagcaguucacagcauacagaauguuuuucagccacccuuuaaauauuucacucccuugcccucuucuugcuucggaggagacagagguauaauuccagucguucuccuguauaaauaaaguugcuuucccucccuggcuucuugaaggauuuuaaaaacccaacaauuccugauguucuaaacucuaaaggcuacgaugcccagguguaguuuuucugcuuguuuggguuuauccacuuccugcccccugagcuucccagauguguaauuuugugucugacaucaauuugggggaauuucucagucauaacugcucugcuccuuucauuauucucggggcgggugugccuguugccugugugucacagccuuugaaacaucuguauacuccuggauacucugcucugggcuucucugcaguacuccccuucccucauuugcuucucaguuugggaucuuuugacuuagagagauccucaagcacggagcuccuuccauucucuguguucaguccgcuaaugagcccaucaaagacauucuucgcuuguuacaauguuacaauccuuuugguuuccacuacuuauuuuaguucuuaggauucucaccucugccuaaauugcccaucuaguccugcagcgucuauuuugucuacuaugcgccuuagcauauuugaaauggcuuauuuaguuacugucuuuucuuuugagacugagucuuacucuguagcccaggcuggccuuaaagacuccauguaguccaagcuagcacugggcuuacuuugccuugucaccaugugcuuuugcccuuucguauuuaucauaauuauuuuuaaucaauguacuggguuaaaaggacugcuaucaggucaugagguagcauggcaugagguuggaaagcguucuacaguuccaugacugggacuuagucuugaaugucuugugugcuucugagcuccccugccccuugggcagggggagauggcuacagcaggcugcaguuggguauuucccugucaugggcuagucaggcucuaacaaaaccucagcugcuguacucuggcuagaccuguuucccaaaggcaggcuugcuaagaccacuccccuugugguauuuugaaauauuucuuucccuucccccacagaggcucaaggagauuuucucugguccacagggugcuggcuuuguugagcuucaagaguggacucaguuuccccugagucuuucaugcucugacuugcucacauagaacuuccagcagcuugucaauuauagcucagguuuuccuauccugguucuugcacagauaugagcuuggcgguuuucuuuucuuucuccaauuuugggguggugugggggaguggcuugcugaugacuucauaucuccuagaaggagacucugacuuucauuugcuuaguuugcugcuuacacagaguggcaaucccaggaugucuauacucuagacuggauguuuuccuuugcuuugcuuuagcugaaaugaauguaggcaaguggacucucgagcuuugaaggagcucuucugaaacccaagagguccgaauuugagcaggauuuauugauuggcccguuacacaagucuuaucucaacuuucagaaacugguuuaacuucaacuugacccagaguuuggaacugaauagguuauauucugagugagggccugguguggguccuggacaaucugauuacaucuuaucuggaagcuggccuggagggcuccggucgcuugucuuuuaucuucuuauuccuggauccauccacuuuccccacauaugccauuuaaucuuugaaacacucucuccugcaacucuaccugugugcuccagcuuggccuggcuccucccugggucagcugcccagcuggguacucuggagcugcugugcccugagauauuugguuugacacaaucauuuucagaugccacaugcucuuucuuguuuugguccauugcucauuuaagcacaucuucacauacuucuucagagggaaaaaacaaaugagaauuagguaugcugguguaugucugaaauucuagaacuagagaggcugaggcaggaggauugugaguuugagaucagggggggcuacauggggagacucuguuucaaaaguagauacaaaaauauuuuagagggcugaagggauggcucaguggcaaagagcauuuauugcugcugcagaggguauggguucuauugccaggacccacaugguggcucacagccauccauaacuccaguuucagaggcaucuuauucuggucuccaugagcaccuguacacaugugccuaaaccccacagggcuauauacguacaauuaaaaauaauagaaaacaaaacuuuuuaaaggucugcaguuuuagaacuacuaagauugcccaacucccaccuuaaucuauagauuaucugauuauagacacaacaauacauuuccuauuguuuucuuucaucugcuugauguggacaucagugacucuuccuccaaucaaagucauugugaaaccauugucagaugauccugggagggcagggaaaggggauauuauagccauggaugcugugaaaggauaacaugggaaugggcuacaccuugguaugcuccaggccagaaagauggaggguccaagagaugucuugaggcaaagguuagaacugagauuacuagagagaguuuggcccaugggaucuacaguca

SEQ ID NO: 4452 - RNA, 15812 nt, Mus musculus
cgaagaguccgugugcacugacgucuaauccucgcgccuuguuuuguggccuggguugucuguugaaaggagagcauacugguuuugucaguagcugugucuuuuauuacaaguucugagucucagggauccaucuugcugguccgcgguccaagauggacaaagucugugcgguuuuuggaggcucccgggggaucggcagggcgguagcccagcuaauggcccagaaggguuaccgucuggcgaucgucuccagaaaccuggaaguggccaaagucaccgccggcgagcucggcgguauguaccggaaguguccucgccgugcgaccaaggugcaaguccuugaguuccaguccacgggcccugcccauguacccggguuugcgccccagaucgcucgugccccaugaccaaacacucacaggggcucucgccuacuccaggcagauucuaaggaccccugacaaguaguugccuuccccgcggccagugcugauauugagagcugccuugcucuggccucugggaggagagaauggacgcgauuauacugaaaguagagaagucagauacaaauggcuagauugcauuuugcugagagcucuugcccuuugcgaaggcacccgacaguauuucaaagagaaacucuugauaagucaggguugcuucuccaagcccaucaaugacuuuaguaaguuacuaauuuguuuucccaggcccuuugauuguauuccuauuccagcccccccccccccaaccccagguuauuaacggauuagucauugcauugcaaguuuaagucucguuuggagaagacaacuugaagaauggagaaaaauacaugucacuaucaggaaagcauuggguaucuuguaggucuaagagugucuggugccgacuauauuucuuuacuuauguggaaauagccuugauauguaacucacacuggcuuugaacuuguggaucucgugucucagcuucccaguugcugagaucuccuuacugugaugggacggugaugucuuuaguacagaguacacucugaaccugcggugugguauccagcuuucucggacauagggucucacuacgcagccuagguuucccuuggaucaggagcuggucucugccuccuccgugcugggaacacaggggaacacaucuguucaccuugggugugaacacgagccucaacaccuagccagucagcauugcuuccaguuugcuagauacuccaccuugcccugugguacuaguuaccuguucuucggcucuccaucauauaguugguucaucuugauguaucccuaucauaaauugaggagcauauauauuaauaugguagcuuaucagauagggaauauguuuacuuugaagucaggguugcuuccccaagcccaucagugacuucgugaguuuggugauagggaucagggaguucuauggagccaccucucuuguccaugcuggccacaaccuuacaguaguaaucuccuaucccaaagcugagacggaagguauacacuaccaugcccagauuuaauugcaguuuuaaaaaucacauuuauucauuugguuggaugaguacaucuaugucauugugcaccugaggaacucagaggacagucuguucuuuccuuucauuguaugggacccaaagguucaacccagauuguuaggcgugguggaaagugcccuuaucaagugagccaucuugcuggcccugaccacuuuuguuucuagacuuuccaagcuuauuucuucuuaaggguuugaggugucacucagaauagccaugaacuugugaguccagcaagugccaacauuauggguagccagguacccauaguucuugugucuaaaucucccauucaagaaaacuccaaaguuaaaguuagauuucgauaauguuuuauuuuauguacuugcuguauccuagaauuuggcaggcagaggcaagaugagccugaguuuugaagucagucuaggcaacacaguaaaaccuuaucucaaagcaaaacaaaaacaaaacacucauacacaagacggaaaaaacaaaccucauuauuucuccuucacuuccauccacccuguccuuucaucgugugcucugagggcaggaacccaugacuggcugucauugcucggcccagcacaggcuugcugaagagucuaaucauaaagcaaauaaauucgaaauucaaguuaagauuuagagguaauucugauuuaacuuuguuuuguaggaaaccacuuggcauuuaggugugauguugccaaagaacaagauguucagaguacauuucaagagauggagaaacauuuagguccaguaaauuucuugguaaaugcagccgguaucaacagguuggucaaagauugaggugaauuugugauaccuguuuuaaaagauuuuuuuucuuaaugcguugauggcuuaguuucuuuuccauugcuauuacgaaaugucaugacccaaagcuauauauaaaacagaguguucgauugagguuaugguuucagaguguuagagccauguugguggaguaaagccaugguggguagcagcagccgggaacccauauugugauuggcauauaggaggcagagauagggcacagugggaauggagccagucuuuggaaaccucaaagcccacucccagugacacaccuccuccaacaaggccacacucccuaauccuucccaaacuugguucuaaacuggggcucagcauucaaauauaugcgccuccggggaccauucucacuccgaacaccacaucaguaugagacaauauauuaggcuguuuuauuucuaacuggaaaggcuuuuuagaaaauuaucauacauucuuuuauuuuaaaaaugguguguguaucugcauguuaguacgugcggaguguguggauucccacaggagcgaaaggagggcaucaaaucccuggaguuggugauacgggagccugugagcuacuuggaacugcaccugcacucucuguaagaucaguauguguucuugaucaaugagccauuucuuuagccuaauucuuuuaugaugagauaaauguccaguuggaucaguccuaacaaccaucaccggcauaucaccuagcaugccagaagacucccuuggucucuucucacaggaagccaguguucugaguuccauugaucauaacaagcuuaauaguaauguuuguaggauaauaaauguaauaauaauaggaugaggggggguuuguuuaggagaaaguauuuagauuuacagccccguuaaagaaggcaaaacuggcaguagcuuaaaccauuuguuuacuugcuacuguguuuagccacuggcaguauuuaucagucuaucagagagguggagaauccugccuucccuguggcuccuuucuggauuaucaacagcuaucuuagugguuuuaaagccaaguucaaaaugggacugcccagcacuuagcuagaaagcauagcuuauacuauauuuuaauccagaaaaaauucugguacguauguuuugacuugauuuuuuaaaaaauauuuaguucugcuauuuuaaaauagugugugugugugugugugugugugugugugugugugugugugugugagagugcacgugcggcgugcauauguaugcaguugccuguggaguucugaaguggauguauaauacccugaagcuggaguuacagguggcugagagcuuuuggacacaugugcugggaagugaacucaguucuccugauggagcacuuggagcucuuaccugcugagccaguccucuagcauccagauuugaguucugaucugcuuguuaaugugcccacuuucuuuuuuuguagagacagucuucuaguaagaacaaagacugaagacaugaucucucagcugcacacuaaccuccugggcuccaugcugaccuguaaagcugccaugaagacaaugauucagcagggagggucuauuguuaaugugggugaguucucaccuccgggggcuauagucauugcauguaaacauggggcuacuuaauccacugauggacuugaccgucagugagggacuuacuaaguauuaaaaaugacagcagaagccacgugauaaauagcaucuguauggaaugggaaaggccacagcugugcacauccaucagacugucuguacaacaaugucauaauagcuuuaucaccaguuucaauuuucaggagaaaucaggcacccucgccuuuuuuuuuuuuuuuuaaucaaaccuauaaugauuauaagagucaaaaaggccagguaauguacugagagauuguguuuccuagaaaugacugggaagcuacaaccaugcuaccucaauggucuggcuuccuaaacaaggcauggacaauggcaguagacacucuaagacagaaggggaacucacaggguccuagagcuauaggacacucaggacugcugagagcaggagaggcagccuuccccagcaugagcccagucuuacugggucuccauugcugugaacagacaccgugacuagggcaacuucuauaagggacaacauuuaauugaggcuggcuuacagguucugagcuucaguccauugucaucauggugggaaacauggcagcauccauguaggcauggugcuggaggagcugagaguucuacaucuuguucugaaggcaaauaggagaagacugccaaagcccacccccacaaugacacacuuccuccaacaaggccacaccuauuucaacaaggacacacuuucuaauaguaucacucccugugggccgagcauuuaagcacaugagacuaugggggccaaaccuauucaaaccaccacaggccccuaauaaguuauccuacucuaaguggucaggccugauacuguuacauacaagcaauaguaaacagauucagcagguauauuuaugugugcauauauauauauauauauauauauauauauauauauauauauauauauacacacacauacauaugccacaauaauaacaaaaugucuaugaaucugagagugugagagagcaaauaggagggcuggauuggaggagaagguggaaaaugaugucauuuauuuuuaaaauuguuaagaagaccaaucuaauuuuugauaugaaaaagaaagcuuguaacaugagucuaaauaacaauuauuuauggcagucgcauagaucccuggucugucuagugucaaaguuugaggaacaguaaacgucagcuuuucagaguggauguaagcagccuuucguuuguuggaaccgcagggaagagguguucccaguucuugccugucgagcagaaaaugcagaguaacguggaguuugaugucccuguacuauuuggaaaugguagcauacagucugacaguuagccuuaagugaugagcaguaccuuaaaagucugcagacgggggaugcugcucuguuagagguccucucaggaggaugcuguucuguuagagguccucucaggaggaugcugcucuguuagaggucccucucaggaggaguugcugcccuguggcucucggacacagucaguucagauguuggcucuuaagaccugucacacagaccugagacugccuggagaucauaggacagauuuaaaauaccuucauuuuagguaaguuucagaaaccuaaaguuagucccuuaaaaucuuagacuauugcuaaggcugaugcuuuauaaugagugaacagcaugcuuacuggauaggaaaaacaaaaagaaaacaaaaccccagauaggcugaccuuguagacguguugcuacuucuaaagaaaucauuacuuugaccaaaugugaauggaguguggcucgagugccgguuaugggagcuuccuaauggaucuuucugucuuucugacccccacacacccccuuucccguccacuccuuuccuuaacauaauggccuuucuuucuuccugugcuacccaguuuucuucuucucuuaaccaaggugccacauuuaguaaugugccgugugaucaaucaguucauggaggacagaugcauggcagugguucuguagguuauggguuauagguuauagguuagggugggggacccucacccuagaccacauacacuauuuuuacuguucuucucugugcuuagauacacauaugccaucacuguuggccgaucuucuuugcauucguguuacauagguuuguagcaugcuauauauggcagaagaaguggccuauaacugcuugcuuuauguaagcauaccgugggaugcucucacuacuuugaacccacuauacaguguauuucuugggggaaauuacugucaucaagcaauguugacuguacaguguagguaaacauuuuaacacugggcuccuugauuauaauauaaaaguagaauaauucuuuuucuaauguaauuucaauuuuguguguguguacauuuccuguucaauuuuuauauaauaagcacaggccaguggugcagaaaauuacuucccuauuucuguuuugcaagcauguauuugcauacaauugauauuugaauuauaaauuguucuuacauauuuauuagacaaguucauugaggaaugcuuaguucaaguacaagguacauauaaacaaaaucacaccauuaccaaguuugcauggccauuuuuuaaguuacuggauuuggucuucuuauagguggaggugaauaccuauucccaucuaugguagaauuauagaguuaaucagccuuuauuuuacaccuucuggcuuuaccuuauuucugccuguguuuguuauguuucuguugcugugauggccaaggcaacuuauagaagacaguuuauuuuggcuuauggucccugagguauacaagucagucaugguggaaggcaaacagcaggcaagguggcagaaacaggaggcugagagguggcaucucaaccacaagcacaaagcggaagagaacuggaagucgggugaagccauacucuugacacgcagucccagcaaagccacaccucccaaaaugccagggcagcagcuggggcagguguucaaaugucugcgcuagagggacauuucucauucaagccaccacacugucagacccagcacucauuguaccugaccucugcccaccuuucagguaacaaaucacacaagcuucucucccauuccuggugguuugacaucauuuuccuccaguuucucuuugccuguguggcuggguuaccccuuaaaggaccaugguuagaguuacucaguuuagcaaacaaugaaagaaggcgggguucccuccugauuuggugacuguaaaggauaugaaucgucaaauaaugacccgguuggcuugcacucgcuuucuucuuuuccugcaggaaguauuauugguuugaaaggcaacguuggccagucugcauacagugccaccaaaggaggacucguuggguuuucacgcucgcuugcuaaagagguugcacggaagaaaaucagagugaaugugguggcaccaggucagugaaaacgccauacaguagcuguaguaucauuuacugauguaaagaaaggccacuagguugucggucgauugguuaauuggcagucauuaauugacauuuggauagugucucucuaaaaucauuguugaaagaaauaaugaauuagugacuaaaaaaacuuacuuguuccucuugucuuacauaaaaaucuuuauuuucuauuuuuuucaccaguuaaggaguaaauuaugguaaaaaaaaaaaaaaaaccuuggagaucaccuuguguuuugagacagggucuuuaccaugcacuguaguacugggacugcaggcugcuccaccacaccuggcuuauuccagccacagugacaacuuaaaaauugugaccgaggguuugaugugauuuacccaaagcuaccuggcuguuucauggaaagcuggaaaaauacacuccugaacgguuccccuuuuuuagggggagggggucgagacaggguuucucuguguagcucuggcuguacuggaacucacuuuguagaccaggcuggccucgaacucagaaauccaccugccucugccucccaagugcugggauuaaaggcgugcgccaccaccgccuggcauugaaggguuccuuuugaaucauaagauugaugucuuuuuauccuuuaguuucugauuuauuuauguauuuauuuacuuauucucccucuuuuguucacuugcauauuauuugccaguuucuacuaaaaaccaugucaaaauucagauauguugucauuuauuaguuggcuggccuguuagaaauguuuuauuggguauuuacuugacuucccaacagaaugaauuuuuucuauacuuuguaaguuagaauaggaucuuuuuaauacuuauguguucauuuguguguguauguguauacuuuugugugggugcaugcacacaacuugcugcacacguaguuaucagaggauaacuugcaggaauggguuuugucuuugcagcauguggguucugugggacugugaaaggcagucuguuuucuggucaagcaagacuuacucuacaagggucagaacagugagccauacucccagacagauauaggugccugacaccagggagcccccaaccucauaauccugugacuaucagccacacaggcaaugucccaagcuccugguauccuggcuagucuccgcccccacaguuaaccuggcaauagccagguaugcuccucuccacaguuacuuggcaacugcaagauagcccagccugcaauaaaaggggcucaucucuagcucuccuucucccucuccuuuccccccucuuuccacguggccauggcugaccucucucuuucuaccuucucucuuucucucugccuuucuacaauaaagcucuaaaaccauagacuaucucugcucaucgagaccugcugugcuugaaugaugggauaggcuuuccucuaaagagucgugucuaacaucacgcuggaaggccuuccuuugugacauacagcgacgucugggauguucaagacugagaaccuguggucucuggccuccuugaggcccagagacccuagauugcucccucucuaccccuucuacuuuccacagcaagacacccacccacgcaguguagagagcacgcacagcagucucccauguccacuugcccagacagagcaccggagcucuggcgggacucagguucucucccacccccuuuauuuccccacacccgcugccugggucaaacucaggccaucgggcuugauagcaaguuucuucuccugcugagccaucuuguugggacuagauagucugucuuggucuugcaguuuuacauacuuaagaaguaaucucuauagccacuaaaauagcccaguugggagugcauuagacugaagaacuaaucccuguauaguuuguucuugugacugaccagcagucuguaggagaguggcugcaguugaccucugccaccuuucacuuuuaggucccucgugacuccagcuggaccugagaguaggcacucauugagcuagcagauguuuuucaggauguucugugaaucuguuugcuguauaacauaccuucacuccaguuccuuguuuagucguagacuagcuuaaguccagacauuccauauccaugaguauugagaaaguuuuacagcuuagaugaauacuuuugaaggaaaaaggaaaagggucucaaaccaaagcuuuccaugggaaguugcauugucguuaccuaggccugacugucuguuucggugugcucugugcaggcugugacaguuaguguuggcugagcuagucguccgugggguuguuuauuuguuguuuggaagggcauggacuugcccucucucuuuucaggauuccagugguaugaguaacaagggguucuauuuuuuuggugauguaauagcugacuggcugagaggaaggcucaucuucccaauucacauggacccaugcagcgaauguccugggugccuuccucuaugccaaggcugugcuagguccaagaguaaaaaaagaaaugagaugucucuguuacaagcuacagaaacaguuggaaagagcgcugagugucauggcugaaggaagauaguaauguggaccauguuaggaagaugcugagcuguuuagcauggauucguugccaaggcaaugacaugaguggugccaauccauuuucuauacaaaggagcuguuugaaagguguuauggaauugcaauagagucuuuucuaaagaucauacuuuuccugugcaauucauauuagggauaaauauagguugcuagaaagugaucccuaguaggguagccuuuguaauacuauauuguauauuauauauauacauauauaauauauauugcauauaucauuguauauaauauuauauauguacacuauauuguauauuauauauauuauacauauacacacacauagagacacacacaucuuguuucauaguacagauugaaauaacaagacuaaaucaauucuauaaguuaucuguugacuuaauuuugauauuaagaucuaucagcuucuugacuagaucuuaaguagagcuagcaaaugugcacuugugguguacuuacccgugcacuaacaucuggagagaggucgugguguacuuacccgugcacuaacaucuggagagagcgcauucauuucccaguguauuuuuugagacagggccucucagugaaccugaagcucugaagcucacuguuugagcuagacuggcugagacuagugagacccugugaccuguuugucgucucuggguccccagugcugguucccuugugcugccaugccugguuuugauguagguccaggauauccagacugggggcuuuaugcuagugcuuacacacggagccgucuuuccagcccuuagaccucuaguuuguuucuuuuuaugucaggcuuuucugauuagcuucaaguggagguucuaaauaacagaaaaacaguugaaaagcgaacuguagcacgaaacccaggaaacaaggcagauaacgcuuagacugucgcugccuccuaaauccuugacgguucugcuaagcguuggcauuuuugacuuggcauauaaaguaaagaugccaucauggaugagucucccucacugaaagucaauacgaggaauuauauuugauagguugacuaucaucaauuccucaucaaaagugaaucaaugaacuguccuuucuucagaguuuauaacauaaaaauucucauggcuguugggagccagcgcaucccagaguaaugguggucuuugagguguggccuagugcuagagcauuugcccagcaugcacuaggcccaaguuugauccuagacacccucccccucuguguuggguugucauuguaugucucguaaggaagugcagugccuuugcucuaaguugcuagagugcauauuauuucacuuaccgcauuugaucuaaggaagguggccuuguagccagguggaaaccuccgaguggccaguaaugcaguagcacucucuguuggacagcggcaccuacugguacuuuauagcuuuuauagccacuucaaggcuuugcaaauacaugagaaucaugaguguggaguagaacaaaauuuccagaacuuuacaaauaugaagagugauauggagagagucuuagggcugaggaaagaagauggacugggaaguaaggcaagcagcaagauaggugugugggaugcuuggggaccguuagcaucuacccucggggcugauguaugugguggaggggaccuaagggauuagugauacaucaugcauugggcugugaauauauuuaagugaagauuacaugguucaugagccucagcauaagauaacaucgacauuuucuacagccccugaguaauuuaucauacgagagcagcuuaccaucuuaguuaauuucuggugaacuggaacagaucuaugcggucugggaagcugcagauagagugggucgggacaacuauguuguaaugguggauaacaguagcucuugguaagacccauacacacagcuaacggaggaccccagcucuuguguucuguggacuuuacccagugaugugucagcaguguucacgcacagcacauaaaugacaccaagguaagaugcuaggggaaguggagggagcauggggcgagggcaguguggucagcaauagaagccuuuguucaaucauuuuguaaaucuacaacacauuaaacaugacauccacuaauuaaaaagacacugaagauccaggagagggaucaauagaaauauguucauuuuucacauuaaacauaaucuaagagaaaaacuagcauguggaggcaaauucuuuccuuucuuaaaaaauaauuauuauuugugccaccugugcacauggcacaguacacucaacgacuaguuaguuggguuagugugaaacccuuuaugccaguuuuguucaaauuuuacagaguaaaaggcaguuguaucaugaauucuuugauuuuuuucuuuuguaaguuaaaaauauuugaggauguucaugaguacuguauuuacaucauuccuaccccccccccaacuccuccugcuucucccucuacuuccucuccauuuuauggucucuucuccaguuauuuuggaccgguacauguguugugcaugcacagcagccugcugaguccuuuaguguggcuuguaugaguuuguaauuagggccgacugugugggacuggaucacugucgcagcucgucccuggaggagacugauucuccuuuucucagcagccuuuaacugcucgcagcucuucaucucggggucaggccuugugaaucucccauccaagcugcugaucacugugcagggcuuguuuagguggccacaguguugacauuucaugggugcaacuuccccauccuaugcagagagagccuaugucauagcagauacucugguccucugacggcagucuucaugucaugucugcaguguucccugagccuuuggcuagggauuguaauaugaaguuuuuaguauugacauuaauuauuguauguaacuuaacuuuuauaaccugaagugauuauaggguuuauucugucuggggcauccuugaaaacauguuugccaacacacagcauuggauuuccugaaauccauugguuccugaaagaacuggaaucgucuagauucuggcuucucagugaagaccaagcuucaucucugggccaguugggguggcagagacuccuuuagucccagcacccagcaggcagaggcagguggagcucugugaguuugagacaagccuugacuacauacggaguuccaggcuagccaggaaugcacaaugagagucugucucauaacaacauguuugcucauugcucaaugucugcagagacauuuuggcuuuaucugugucagcugaugccuucaucccuuccugccaacacuguauguaaagaugaaaggaaauguugcugacuucucaaauaaacgugcucagacuuuccuggcagaggggguuauguuucacaguauagucucacaggcacgacaaaaucagucuuguuauuuuguuauuucuggaccucguuauacaucaucuguaacucauaugcucauauuuuuucaauaauuuuaucaacaaagacacacacacagcuuaaaagaagaaaaguacaaaaaaaaaucaucaccugcucuauaguucuggugacuacugucacuugucccucugauguccagagauaaucagaugucagcauuuuuuaauuuauauuuugccuuguuuucaauagugauacaguggaauuuauuaauaaccugcuuuuaagaugauuacagaggugaaaucuucauuuaugacauuaguaugaacauuguucuaugcuguggauguaucagguguuaacccauuccauguugaaagaccuuucaguuugcuuccagauuuccccaguaaacucuuacuaucuuagguuuuaugguaggaaaaaaaaaccuacaaugauuuuuuacagaaccuuaaagaaaacauuugaauuuucauaaaugaaaauccaaaguaaaguuaauuauaugguauuacauaauaaacaaacagaugaauucaguauuuagcucacauuuaucaacacaucauuuauaaauggcaguauauuuaagcugauuuauaguuuaauuuauaagugauuuaguuuuaacauaaaccaacuauguuuuuugugagugcacauggaaccuucacuugcugugacuuauuuaacuuuaaguccaucuuuuauuaccuuaaacuauaaacuuucccaugccugccgcucucaugaaaguuaguauuugcuuucuuuuaaaacuuagugacugaaguugggcaugguaguguaugccuucaauccugucacucaagaggcagagcagguggauuuauuugaguuuucuacauggugagacuaugucucaaaaaauauuuaggacuaauuggugaacaagaaacuaugugguaaaauuuuguuauguaugucugagacuauucuuguaguuguuuuguaaaccuauaguuaucuugguguguguguuugugugcaugcauauguauacauauguacaauaauuuugaauucugaauacauaauacuugauacuguagaacuuguuuuagaacaugcuauuuguacacucuauugcauauauauaccaauacugaguuaaaauuuuaucuuuguguacauuguauccagauuagauaagaccagaggacuuuuuucuuauguggacuuuggagucuuaccaguuauugugguuuaguaaauggaauggucuaauccuuauuaguauugcaaaaucauuucaugggcccaucuuugugaucccaacucucaauacugugucuuccuuucugccccaccugugugaaaauuauuucucugccauuuuaucuauggauucaccagacuuuauuauauuacaguuggguauguggcaauuacuuccucccuucauagauuuuaguuacucaaagaaugcaucguguuucauuuauguuuguaccugccuguuauagucaacagcauuaucuuuauguuugccaagagcugagccauggacuuggguguuaggcauuuuuguguucaauaaacauugauuuacagugaauaaaauuguauaccuaaguacuugcuaacaguacucugaaguuccuaaacaauguuuauuaauagugucaaacucucagaagcaaauucucuuuauaagaguugaacaaccacuuuuaguguuuauacuuuucaacugaauucacauuucucuuuuaggauuuauucgcacggauaugacaagacacuugaaagaagaacacuucaagaaaaacauuccucuugggagguuuggagaaacucuugagguagcacaugccguuguguuucuuuuagagucaccauacaucacaggccauguucuuaucguggauggaggauugcagcucaccgucuaauuagagaugauguuacugugauggcgcuuugggucaaguacacauuucccuauuaauuugacaaucucaucuauaugggugacauuugcuaauggaaacaaaucagcuaacggaugcuacaaaggauuccaucuuuguaugaacaugucucaaaaaacaaagugugaccaguuguaaagggugugaauucucugucuuagaggccauggacauuuuuaaggguuauuguaacacaccuguaucaagcuggauauuaaaggcaucaaccuucuagacuguugcuaagaguauuua

SEQ ID NO: 4453 - RNA, 2000 nt, Mus musculus
gagugaugcuacuuuucucugagcugcucagcaaaauaaccugguuauuuaagugcggugcaguugacuuuguauauagcaguucuuggggauuguagcuguacuuuugcuacuuuguggguucuucuuucuuccauccuuauccaccuuuucaacccccuaacacuagguaggggagaaagagaucccugacucuaauucuuuucuuuuucuuuuuguuuuuuuuguuuuguuuuguuuuuuguuuuucuuucacuacagcuacuauuaaacaguagccaaccuucccaaacgaccaacaacaaccaacagcauucaaccaccaaccagcaaacuaccucuucucagggccauagcauuuauuauauacccccauaaguccccagaauuacaaaugucucacaguagcagaaccuaucuggagcuggcaaaaucaugccccugcuagggugugaggcaaaucauagucagcugcuguggaccgucugaagcagccucauaucccacaccugugauuaaaacaaaaacacauucuuaugauauuucuguguuuuacaaagcaaccaaaauucucucuacaggaaaugauguauugaguccuuaagguaccugcuauaguuaugagccacacugaucuugagcuuagggagugucuuccccucaugaaaagcucagcauagcuagcuguuuaaggaccauaugaagagcuggguguagcccugucauccgggcacgcaaagcugggucaggauggccaagaguucaaggucagccuggucaagucagggcgaucuucucucaaaucaagguguuaaaacucuauaagaaauauaaaaugauagucagaugugguugaauaugcuuuuaaucuuagcccucaggaggcuaaggcaaguagaucugaggguucaugcuauccuuguuuacauacuaaguuccagaccagcuaggacuauauagugagauccuaucucaaaaacacuacacacacacacacacacacacacacacaaauaauuaggaauaauuuauguuaguagauauaauaaugauucauccccaaaucuuagaaugauaaugaauaauuacaguuaaucauaaaauauacaauaacaguaaccauggauuuuucuuucacaaggaaugugugggauuuuuuuuguuauuuucuuguuuuguuuuguuuugcuuuauuuuguguuguuuuguuucguuuuguuuugugcugcuggaucaagcucagggucuccagccaggcgccagacaaggacuuucccacugagcuuccucagccuggacagcacuggucuucaaaagagugcuugcuugagaacagaaaugaagacacagaacugacugcaaauauagauagaauuccuuuugccuugaacuuuuguggggaauaauaggcuauuucuauauacuggauucaugcuguuuuuauuugccguuguugaaauguucuuaauauuucauuuuaaaaaguaauguuuuggucaggcacuggugguacucaccuuuuauuucagcacuugagaagcaagugaaucacugaguucaggacagccaaagcugcacagagaaacccucucuugaaaaacaaacaaacaaacaaacaaacaaacaaacaagugccuauaaccucagcuccuugagcagcuaaggaaggaguauagcaaacucaaggacacccuggguuacauagugcaaggacauccugggaaaguuagcaagacuuuuucaaaauaauuaauacauuuuaaaccggacuggugaugugguagagugcuugcccagcaugaacaaguucccagguucagaacagaacaaaacucagugauccaggauucacugaacuacaguuuugaagcagaacauuaucuaaacggagauuuaauuauauauugaaggucaacucaaacaugugaauaagcuguacuaauaaauccagaauaacugucauaaauuaaaagcuguguauuaaauacggagcccuuuau

SEQ ID NO: 4454 - RNA, 2000 nt, Mus musculus
auaaagggcuccguauuuaauacacagcuuuuaauuuaugacaguuauucuggauuuauuaguacagcuuauucacauguuugaguugaccuucaauauauaauuaaaucuccguuuagauaauguucugcuucaaaacuguaguucagugaauccuggaucacugaguuuuguucuguucugaaccugggaacuuguucaugcugggcaagcacucuaccacaucaccaguccgguuuaaaauguauuaauuauuuugaaaaagucuugcuaacuuucccaggauguccuugcacuauguaacccaggguguccuugaguuugcuauacuccuuccuuagcugcucaaggagcugagguuauaggcacuuguuuguuuguuuguuuguuuguuuguuuguuuuucaagagaggguuucucugugcagcuuuggcuguccugaacucagugauucacuugcuucucaagugcugaaauaaaaggugaguaccaccagugccugaccaaaacauuacuuuuuaaaaugaaauauuaagaacauuucaacaacggcaaauaaaaacagcaugaauccaguauauagaaauagccuauuauuccccacaaaaguucaaggcaaaaggaauucuaucuauauuugcagucaguucugugucuucauuucuguucucaagcaagcacucuuuugaagaccagugcuguccaggcugaggaagcucagugggaaaguccuugucuggcgccuggcuggagacccugagcuugauccagcagcacaaaacaaaacgaaacaaaacaacacaaaauaaagcaaaacaaaacaaaacaagaaaauaacaaaaaaaaucccacacauuccuugugaaagaaaaauccaugguuacuguuauuguauauuuuaugauuaacuguaauuauucauuaucauucuaagauuuggggaugaaucauuauuauaucuacuaacauaaauuauuccuaauuauuuguguguguguguguguguguguguguguaguguuuuugagauaggaucucacuauauaguccuagcuggucuggaacuuaguauguaaacaaggauagcaugaacccucagaucuacuugccuuagccuccugagggcuaagauuaaaagcauauucaaccacaucugacuaucauuuuauauuucuuauagaguuuuaacaccuugauuugagagaagaucgcccugacuugaccaggcugaccuugaacucuuggccauccugacccagcuuugcgugcccggaugacagggcuacacccagcucuucauaugguccuuaaacagcuagcuaugcugagcuuuucaugaggggaagacacucccuaagcucaagaucaguguggcucauaacuauagcagguaccuuaaggacucaauacaucauuuccuguagagagaauuuugguugcuuuguaaaacacagaaauaucauaagaauguguuuuuguuuuaaucacaggugugggauaugaggcugcuucagacgguccacagcagcugacuaugauuugccucacacccuagcaggggcaugauuuugccagcuccagauagguucugcuacugugagacauuuguaauucuggggacuuauggggguauauaauaaaugcuauggcccugagaagagguaguuugcugguuggugguugaaugcuguugguuguuguuggucguuugggaagguuggcuacuguuuaauaguagcuguagugaaagaaaaacaaaaaacaaaacaaaacaaaaaaaacaaaaagaaaaagaaaagaauuagagucagggaucucuuucuccccuaccuaguguuaggggguugaaaagguggauaaggauggaagaaagaagaacccacaaaguagcaaaaguacagcuacaauccccaagaacugcuauauacaaagucaacugcaccgcacuuaaauaaccagguuauuuugcugagcagcucagagaaaaguagcaucacuc

SEQ ID NO: 4455 - RNA, 6659 nt, Mus musculus
caucacuaaucaaagagcauuuggugaaugcagcuuugcgcauccuuugguaaaguuaguacuguuaagguaggaaaaccagaggcuuugggauucuugagguaaggaggaggauuugacagggaaaucuggagacaucuaagcaaggcaacauuggagaggcuguagcagcagaacuccgggcgcugugccaauugcuccuacugugcuaacgacagcaggaggacaaagccucaacaaagcccagacaccucuaccuuuucagguaguauuuuaaagguagguaggaauuugagauuacaugagucuauuauugaagccugugauuaauccauuugggaucuucuuuagccgaauggcacuacuaaacaagcugaaaauggagccuacuuuuaucucagccuuaauaacuuuucuuuccuuugauuuuguuugauuugguuuggcuugguuuuuuaccugucaauaccugaaauuuggguuugaaagcuggcuugcuuaguauccuaugcuugcugaacuuuaggaaggcucuaaauaugacaauucuauuuucaauauuggaauucuagaaagugggggacucuugcauuugggugaccgugacaacaaugggaccaaaagcuauuuugucaggcacuggcagaacucucauccauggggaaagagcaacagaaugcaauguguugagauaacuugagaaacauccauuguuuugaaggccauuaagaauggacccuucccucauggucagcuuuugaccuagccccuguuuccuugguaacaguaagaaaaggucccacccuuucuguccuccuuuacauuaaaauacuaccugaaaagguagaggugucugggcuuuguugaggcuuuguccuccugggugagaaaaugucacccuuuccuguucccuccaauuuaagucagcgaccuaauuccuugagacugugguaacugugguaauagauacugcacgcauagccuaaaccaaggagcaugauauaaguggauuaucucaggugggcccaaaauaaucauaagcagguucuuaauguggugacagaggcagaaauucaggcugguaauuugauuacauauguagucuucuagcaagacucuaugaagaugauggaaaaccacaaaccaaggaaugaaauugaaauaaucuacuccagguuacaaaucuccaugcuuauuaagccaacugugagcacugugaguucuuuacacagccagcugaccaagaguaagcuggcaccucaggagagcucucgguggagaaaacaggguuuucaagucaaaagucuacaauuauagcacacaggggguaggcugaggacaugucacaucaggauauauauauauauaauuuacuggagcaaggacaacucuguggccaccauugagggauaugucucccucacuguuaauguuuacugguccucaggaagagcucaugagcuccccucaucagugauggaacguugaugagccuugucuuguguugauagucacuguuacuaugaauucacagguauaacaggcaugucguguccagaagagaguguuucacagcacucuuuccuguuugagacucuuacauucuuucccuccuuucccccauaauauuccuugagcuuuggaggaaaagauaucaaugucucauuuuaggaugagugcccagcugucccuuauucaccaguuaucucugcauuaaccaucaccuacuccagagccacccaaaucuaugaauauagauacaaauauuuagaaggcgguuugacaucauauccauauagcaaagcaacaggaguaguuuccccuuuagagccuauaacuucgccauucauggguuuuggauuaggucagacaugaguugcuccuguagaauagaccuaaaauccuaaaaucagaaugucguugguuaucauaccacuacugugccaguggaaacauccugucugacagguuaguauuacagaaaacagauuccuuucuagaucuucuagaaaccacuccugauggcgcuuggauuugaacccagugaaacugacuuucagaacuaagaacaaguuacucuuguucuaagcgacugugaauaauucaguacaggagccccaaaaagugaacgaacaaacuaacuaaauguaauacagucauguaagcuaauguaguagaaaaaccaugacauauuugcuaguagcaaaacuaagacucuuacaacacaggagacgacuaugagcucagugaugugggaauauccucauauuuauuaucauacuauuccagguuuuacaagauggauauuuuuguguugcuuuuuuugaugagguaagugauuuugaugauuaaagugauacaaagacaauaaguggugacauaauaccaaacuuaaugaaaaccaaaaguuugcuuauaggauuuucaguuacaugaacucugacaaaugcuucuccuucuagaacugaaauucuuccagccuauagaccaacuguuuucuuuucauuuuuuuuuuaauuaaacuugugugcuguuguuaucauuuggggauuuucuuugugggcauuuuuaggguaagcaaacucugugguguucaugguuguuuugacuuucagugacuucagauuuuucagugaauaacuuaauaaacuuugauucaccccccucaauuuucuagucuuugucuguuccguguuacuaaaauaagauaacacagucuggguaauuuauaaggaaaaaugcauuuauuguaauuuuggaaacuuugaaauccagagugccagcaucuggcaaaaaguccucguugguagcgucuauaauagcaguucucgaccucccuaaugcugggacccuucaauacaguuccucauguuguagcuaccccaaccauaaaauuauuuugguugucucuucauagcuguaauuuugcuaguguuaugagucauaauguaaauaucugauaugaaagauaucugguaggcaaccccugugaaaggguugcuugacccccacaggguugcagcccauagguugagaaccacugaugggguacagugaaaacccaagucacagcccauuaguugcuauaauccaucugugaaggcagagccuuuauaaauucaacaaauaccugccauucagggcccucgcucccacuugaucacaguaaugauuguguuuauagcacauaacucugggugacacauuuaaaccacaucaugccccauagugcauaaagcagcugaggauuauguuuuaugcuuugguguuugugguuuuuguuuguuuuucuccaccuccaauaucugcucaggugcuacacccuguccuuucacagagucuuugauaagcacacauuccauuuccacuuuacuuuaugcccuggacuuuagccucuuugaauucuugaguuucugucuugucagggugagcuacauaagcuaacauuucaaccuuccucuauguaacauagucaguguuucugucuuaugccuucccucuguacuuaccuacaguuugguacucuaaggguuuuuuuguuuuguuuuguuuuguuuuguuuuguuuuuuuccaauaacugaccauugaggaaaaugaccugauuuauauucaaucaaauuaauuauucauaaaugucauagucaaguggguacagaagguaccauacuugugaucuguaaaaccuuuguccagggguauccaguaucaggaagguguaacacuugguugucaaaggccguauuuuguauggaaguccaagguugaauucuggcauauuccaugaauccucaggggaagccaugaauggcauuauagugacagacucucugaagguacuaaucgagugcucacugguuucaguaacaucuguuuugauggggcccccauuuaauuugagcuacuuuugaaucaguuaucaguaaaauaaguuacaauuugcaaacauggaacauaagaucuccaagccucagacaacuaaacagugcuugacuuuucauagugugggucccaaggugaacacuguuagaugcccagggcaucagauaaaacagccucagcuacaggacauaacuuucaggaauuuagccaguuuggcaggaccuugcacuuaugugucauguugguuaguuugcaaucaacucgacacagucugacaggaaaaugccuccauaggaucugacucuaggcuagccuauaggacacaccuauagggcauguuccuaauuagugauagauggggaaaacccagcccuuuguggguggugacauuccugcagugguaguccuggguguaguaagaaaaacaggcugggcaagccaugaggagcugccagucagaaagcaacucuuguccauggccuccacaucagcuccgaccuccauguuucugcucugaaugccuuugaagcuaaauuauaguuaggaagcagaagugaaaucaacucuuuccugucgaaguuguuuugaucaugcuguuuuaucacagcaauagaaaccccagcuaagacauauaugaaacauggcccuuuguaaguauaucuguagauacuuauguguccuuuguggguguuucaaauugauauccauaaaggaugaagucguggugcaauaucaggugugcuuacagagaagaguggcuauagugauguugccggagcaucugugugugaugacaguuagcugaguguccaucuuaaaugugcuuuguguccuuuaagagguggcacauuccacccugcuuggccccagaagcuugacuagagauggcaaggaaaugaagaaaggacagacauacagaaacaggugcagaaaagcugcagucaggugaacuagguacggucugauacagcuagacuaacuauacaggaacgcauaacucagcauguuuauuaggcacacugcaggggauauugcuuucucuugguagguugguaagaggucucuguaggugaggaguccuauaaacaacugagaagaggaaacuacaguuguggauuuugcacauacugauccauuguuuguaaauacuacuaugagcacauucugucuuguuagcauugacacucaggccagaggaagccuuugcuaucccucagagccuaaccaggagacaguggguugccauucucauaggucuaagacaauggucuuugauaaggcucuaccaaugugaacaaaacacaaucacuugucuguucuuuacacauuuaaucaaggccuuguuggcucccucuacaaauaaggcaaacugaaacauggagacuguugaaccaggcaaugaucagaauaggauggucaaaucuacaauagcaaguuucucauuguguuguaggcuuuuauacuucauuucuaugaugcuaacaucuggcaagagagcugauuauacagagcaaguauuuuaagaauauugacuacugagcauaaggacuuagcaugguccauagcauuaaaguggugauaauaaacugugggcaggcauagucucuucaaguuucagagcgugucagacuaucuacuagauagagauacugugaggauaaccaccucugaauccauuaggucuacagccacuaaagaguuuaauaaccuauccgauuguuucacauuugcuuucuuuuuucagacacugaacugauugccauuucaggagccuaauuugcacgcacuguuguuaaaauaaaaacaaaauuaauacuauuuaauuuugcauccguaacaaguuuuuagaaagucaugauagcuuuggguaugguucaaauuaauguaugccaacaucuuuucuuccagagagcucccauucuauaugagaucucuauagguuugaauuguguggucauaacuucaauaugcagcuuaaaaauaagaaaagaggcugugaucacaaugcacccauauguguaucuauggaaacacuacuucauccacacuuuauuugccucucuuuuuuucccccugcagaaacaaauaaaaggcuuccuuguucaagaagcaauacauucgaacucugccacuuaagcagguguaaaauuagaacgacagaggggucuggaauauuucugccaccagcucuuugacaccuguugaccaaucauucagaggaaaccuugggaguugaagacacuccaguuccgaggacauuccuucccgaaauagguuuuaucaaauugcuguggcaaaagaagcaacagggugggcagacucccggcugcguggcuccgcuacugucccuaacgguuggcauuuugucagugucuaaauccucuguugcuccaacagcugauuuccuccuuugucccacucuuccuuucugguuuuauagggagugacugcuucauacuucccaggccacuucuuuggaagcagccacugaaaugcccacacagcugucugcaguugucucacagugaccaccauauucaagaguuaaauaguuccucaugaggcggcugaaaaacaaacuggaagagaaagaaaacuguuaguucugaguuaaggcaaauaaacuccaaagcccguucuaaauauucacuugaccuucuccucuauugaagaaaaauaaagaacaucaaaguaucccauccaauauguuccuuacuuuuauauccacccaauuuuaaacauuacaacuucagccauaaaaaugauguugaccuuuuua

SEQ ID NO: 4456 - RNA, 109619 nt, Mus musculus
cacuuauaaaaggcggccugagagacucacaaguugccacuuuuuggagcuagcgauuggucuuaggucuccuguggucgacugugugcuugcuuguuaccugcagcgcggaccagcgcgcucaauaccugcugcgcagaccagcgguucucugcacguagcagguccagguucccggucugggcuucccggugaggccaggggguugcuucugggcucgccaggggauuguagggcgugccuaggucagaguaucccaaaagaggagcuggagcggagcugaggggacagcacuaggagguagcuuucaaugggcaguggagcacagacccaccuaccccaguggccaguacucgguggaccacagagggaagaggucugaguggugaguggcagggaaaaagaugccugacucagucucuugaggauccuuuguaaacggguagcugggauagggaucaauaaguaggggcauuggggugugugcacagccaauaaauguugaacauccccaccaauaguuuuucuccuaggugccgaaucgaaucggggcccuacuucaggcuuccagagcuagaagcagaaugugaagaaaaacccagaugaauuguaguugcccugaaauugcaguggcuaagacaaguuaugcuuuacugcagaaaugcauccccccacccaaucucuucguaugcuagcccuagcagucucccugggcuuccugguacuccccauggaacccagguugggccaacuuggaguaucccgcugccucagucucccuguuugagucaucugagauuuaauguauucauguguaaggagcagggauugauuuucuguuuccucaucacaaaucagcacaaacugaguugcuuuaaacacaauagguguuuuauuuuacagauucuguuuaggcacaggcuaagugcuuuuugcaaagcccagcauagaacucaagaugucugccagggcggagccagguucugggugcucauuuugguuccuugaggucaguaagaagucuggaauucucugauuucuugcaaguuguugauuaaggguaacucagagucugauaccuuccauugucacacuucaggucacuucucacagguggcuguacuuuccaaggauauaggaggcuuucucaauuaacuaacaugccucauuaccagagagacuguccugguaauaagggugucaggacgcccaacauauauauacguauauacauauaugcauauauauauacauauauacauacauacauauauacauacauacauacguacauacguacauacauacauacauauauacauauaugcauauacauauacacauauacacauauucauauauacacauguauguguauguaucaggucuaucauguuuugcaggauuuugugacaauucuuguaauuucuuuucauagugaguaaaagaaugagaaaucaguaaauagcuuuuagauucacuuuuuaaguguguguguuuguugaugugugggaauaugcauuugagugcaaauauacuaggaguccagcgugguuggaucccuugugcuguuacaaccuguugugagccuguguacauucuaggaacagaaguugguugguccucuacaacagcaguagacagucuuaauuacugcaucaucugccaucuuucuggcccuuuauauguucauacuuucuaaaggcacaacgugccuguggggaucagaggacaaucugcagggauguguucucuuccucucucagguaggucucaaggauagaaugcaggucaucuggcuggguggcaagcaccuuuacccacugagcaauuuuauugguccgguuauguagauauuauucaaugucgaugcagucugcauguuuuagccugaaaauauaguccuauauuacuguggcuaccccuagaaguagucuuacuacauguaaacuauguacauagcuccauugaaucuuuuuauuuuccacaguuucucuguggauuuuguuuugcauccccccucuuccuuuagcuagaauuacaauucaagaugagaauugguggaaugccucacuuuacaaugacagguuauaucuuuuugcauucucaaugaacuaaaauguauguuugaugcagaauccuggcuucaagguauuuucuuuuagaaauuuaaaaacauguuuuuuucccucauaaaaguauccagcaauauuuuuucuuuucauucuuuugaauggccuauacauacauguuauuaacagcuugucaugcacauacugcuacuaaugacuugcuugguauaauuuaaugguccaguccaggcgguacaugaaggaguacaauccuuauggacaauaacuagacucaguguuccaggaggguuuguaccaguggggugagcgugagcucugggaugguggucggcuuuggccuuuggucugucuguaugaggcugguuggggaugaguugcagagcucuuuguuuauagagugauaaccagcugcuuuuucauaucaccagcucacccuaaagauaaacugcagagacacacauuuuuacacacacaggaaucccuuagaaacacaaaaccagaagaaauaauacauaugcuaaggaccuguaagauggaaaagaaaguucugacucaacauuauaaaacaaagaaccuacaaaaaugccuugaguuuggccaucuacuuaguaguggguaugaagccuacaguuaagaguagauuguuuccucagcgagaaaacucauuuuucauuugcaagugguuaccuauuagggauagcuucuagguuagagaugggcccagagaggggcauguguucacuucuuucaguccugguaccccauuugguacagacccauguagguccuugugcauauugccagucucacauugccagaguucacaugugcuccaguccuguuguauccagaagaucuuggugccuugguguccucuggcucuuacacuuuuuccaccuucucuugggcucagagaacuccaagaggguuaguuuggcaauauccuagguuauuuggguguuccuaugagacuuauuuggccaagagcuagauguaacccauucuugguacuggaagcuccauuuugaaacaggagaugucaaguugggacucuaaccucacccccuuauuuggcaaauucauuucgauugucuucauauaugcguuucugauaggaagguucuacuguauuagguccucuccauuuccucucccuugccucauuccauuacaacaccaccccacccccacccccugccauccacccauaacuagcuauucuaguuccuucuccuagggcaaugcaaccuucauccuagucagucacacgauccuuaaccccucugguuauacagcuuguagccugcuuaucaaugacuuaacagcuagcauccauuuaagugaacacauaccaucauugucuuucugagucugaguuaccucacucaggaugauuuuuuuuuuuuuucuaauuccauccacuuaccugugaauuucgaaccuucuggaagacuggacuuauagauaaacaucccugucucgaaaaaccaaaaaaacaaaaacaaaaacaaacaaacaaacaaacaaacaaaacauugcuaaaauuuggcuuuauccuggaauguaugguuuuuccauguauuuugacuaaacguuuugcuggguguaguuugggcuggcaucuguggucucuugacaauuggccaacaucuagaugucuaggcccuucuggcuuugagaguccgguugagaagcagguuugauucuaggagguuucccuuuguauguuguggucuuuuucccuuucaucuuuacuauuccuucuuuguucuguauguuguaguuauuaugugacuugggaaguucuuuucuggccuaguauacuugguguucuuuaugcuucuuguaccuugauaaggaccuccugcuuuagauugggaaauuuucuucgaugauuuuguugaaaauauuuucuguacuuuggaccugaguuucuucuccuuccuuuauuuccauuaugcauagauuuugaauuuuuauagugucccauguuuccuggaugcuuugugccuggauuccauuagauuuagcauuguuuugagcgaguauccauugcuucuauuuugucuucagggacugugauuuccugucucaucuuucguauucuguuggugauucuagccuaugagguuccuguucgaguucuaaaguuuucaaucucaguuuuuccucaguuuggguuuuuuucuuuugauucuauuucuauuguaugucuugaaccuuuguuucguuuguuuuaaauuuacuaacacugugcuuuuauagauuucuuuaaucaaucuauacauuuucuuuuuaaggacuucuaacauauucauaaaggccauuugcaaguucuugucuugugcuucagcuauauuacaauucuugggguuuacuauaguggaccgauaagcucuaguagagacacauuauccugguuguuauugauuauacuuuuuacgcuggcaucuuggacaauuugggaugauuguaauucuaggugcugauaccuggucuugucuuuguuggguagaugauucauuccuuguauucuguugcuaucucugggugauggcucuguguugucugauaaugaaugcuucugagauccugccuaguguggccauugggaguucauguuagaauguguuucuuggcauuggaaguugacauuuagggaugguaaugggcuggggaauaggcugaugggccucacaggaggguagaaagcaggguuuuccaguaaugucugcuuaguccucuggaaauggaggcagagaggaaggagaggcagcauccagcagugugcuccagaucuggguauaagauuagggaauuugauggagcagacaauugagaauaaagagcugacaauugucuaccugcuucccuggcuggcauggcuguguacaauaauuuuuaaaauuacuauaccaaugcuccagguccagccuuccaucacuagacuaaauaggaagccuccugccaaacuuguaccacaggacacuuucuugcuuuauuuucuuagguccagaaacaguuugcugucuccuccagaucuccagaggaauagaugucuuuuuagguccagaaacaguuugcugucuccuccagaucuccagaggaauagaugucuuuuguguuggaaacugcaacuauaggguuaacauaaaagaauguuugguugucuguguaucucccuuuuccuccuugcuuguacaaggucguuggaaacuuuguuaucuuggccugcucuuacucaagugaaacauucuauaacucucagacucaugugagccugaggaagauaaaacguguaagaguuucaaaaucccagaugcucuguguaggacuaacaacagcuguguagugugguugacuauggacagauauucuuaauuuguuauauuaucucauaagugaaauuuggguucacuccuacuuuaauaaauuuugaaaauuuccuuguuauguuguuuuuuucucauggaauuaaggaaguaaaauaagaaagaaacaauaauuaggagagagaagaauggaacgugaaaugggcacauuuuccauuuuaaaaaauaggucaaaauaaaagaguuuuuuuuuuauuauuuuuaaaaaauaaaaaguauuuuuccacagaguacaauaagauuuuuuccucgggcaaagacuagguuauuugaaugggagaggagagaugagggcagggccaggagguucucaaguuucccaggaagucagccagagaagccuggaggaggaggaggaggaggaggaggaggaggaggaggaggaggaggagggggacgcccaggaugcauggaaugccuaucgaagguuguuaauuaguagaguguauuuagaaacuuaccuucguguaugcaaggauuguaauugaagaacaaggagccagugcauuugagagagaguggaagggacagaggaggacuggaagaaggagaggaugagggagagcgaagaaguggaagaagauaacugacuccagaaguugucccacaaucuccacauuuauaugggcacauaugcacacacacuuaaagaaaugaaaugcaauaauuuuuuaaaaaauucuuugaaaugccacuuuauaaacaacuccuuuaguguuccucuagauaaggauaacuauauugcuuugccaguuauuaagccucuuacaaaacccuaaucucucucuuaagucuuucuguaacugugagcuuugccaccugcacccaaauucaugaaauaaugacucugagacagaauuauuaugaauaacugccuaggccagaugcuagggcuuguuccagaacuagcuuguaauucaauuauccuguuuauucuaaguccugccacauguggguuaccucuucucagguucaugugaccuucuccuucagguucaugcgaccuucuccuucaucguucgggaggcaaaucuuccguucuacaccugguucuaucccacuauccuaucucucugcugaaugcuccauguuccaauucugccucagcucauuggccauaguuguuuuuuuaaauuuuuuaauuuaauuuaaguuuccauacacugcacaaaaaauucccacuacaucuuuugucauucaguuuuggcuauuaccacacaaaaauagauagauccauuucuaauaaguauuuuuuucuaaauuaguuuuuaugaaauacuuaacuuuauugguuuauuuugaguuuuccuucucaaucuuuguaauugcugucuguugacuuuuuacagaacagugccccuaugagaacaacuuggucuagaaucuuggaagguucuagacgauuacccacaggacagauacaauuaaacuuaggagugcaguucagguguagcuagcccaagagcaucuuacagcuguugaaaucugaaacaauuacaagggguuuuauuagcuuugaauuacccacauucaucacccccacuccuacacacacacacacacacacacacacacacacacacacacacacacaaagagauauuagaucaaccaguagagaugucauugaaguagcagggauagucagaauuaaauaaucggauggcaaaucaacaaugucuuccugggaaguuguccagaaugaggacaggggaagacuauaaauauuaaccuccuuggccuuggcaggaggggagaaacuucauaggauuugcuaacaauugucuacauacaauaucaagcuaagcuuguucauaauauugcuucugguucaaagaaaagagagggucccuucaguuucuaucuuuuauccccugacuccugcaucuuccaucccucagggaagccucccuagucuuucuaaucacauuuucuuuggcuauaacuguuugguguucuaugugguacugagagaggccuagagauguacuggaaaguuuucuuacuggucauaagucaugguggcagcugauuagggggcacaguggcagguugccaccuuuccugagaagcagcuguuagagaucaaaguguucucacuaacaguggaggaugcugcguauggauggagggauacagcuacuuucuucuucagacuacacaggcacuauuguguuccacaucugagaaagcagucuauguauacauguucuucacagcuuagcaguuaagcacugcuaggacuugcuuguccugaguugacuccccucuucagguaggauugauacuggcagaugcuaauuagagucaguguuauaagaaguggcugaacuccgaugucuggagaaugggugcaagucaagcggugugaaccagagagaugcgcacaccacaggucuaagaagugugguugaccuaauuagaguggcagaccugagcucuggaaugauccccugcuuuuguccuuucuauaaggugcgauggaagacagauugcuuuuacggugagaacaagcucucucucggcagaucaccaccucucuuaauaaagccuagauuauguagucuauuguucuuuucauuagcguuugugcuaucagacaaccugagugugguguccagguuaacaacuugagauuauaacaggcuuguuuuagucuugauauuuucuauuugugauauugacaguuaaacccaagguacuaggcaagagcuacauccuuaaccuuaaaaaaauccccaaaaaacccaaaaaacaaaaacaaaaacaaaaacaaaaagcaaaaaacaaaaaacguuuauugagaacaaggaucuugcuguuuuucuucuuaucuguuaaguaaugugcgugugugugugucugugugcgugcacacucauuuacuaguuauuacagguaugcaaauagcugauucuguguuccauagcaugccacuuaaguaagaggagaaagaaggaggacuacgguaaugguuggggcuuccauuguguguuaaggauugcauauaauuuguuacagagcuaacuagggaagcucucacauaauguggugagaggagagaaggcaggcaggcaggcaguggaaugaaucucuuaacuguaaaauuaaaaacaaaugguuuuauacuccaucacggcuaguuuaaaaguagugcuguagcagcaggcaccugcaucucagugauaguuaugacuuuuuaauuaaaacuuuauuacuuucuucaauauagcauuuccuuaaaacauuuauuucuuuauuaaacaguugcuuugguuuaggucauagauacaugcaugcuaauuuguuuggaaugaacuauuuguuuuguuagaacaguucuauaaaacagcccagauuuaccauguacauucuguuuuguuuuggcuuuuuguaccacuaccacccaccuuccauggacauugugaauauauaggaacuuauuaauugccuuauaguauuuuauaagauagaauuagacacuauccauucuugaaacuuuucauugaaaaaugggugguguuguguguguguguguguguguguguguuugugugugcaugcauaugcaugcuacauugguauggauacugucaaaggccagaaggugucagaucuuuuggagcuugauuuauaggcauuucugagcugccugaagaggaugcuggguacccaacaagaguccucacacugagccacuuccagccccucuuuucucuuuguaacauguuugaggcuaauuaucuuuugccuguuuaguucucaccaacuagccauuuuccuuuugagcuggguacaguguggagaaugccagcuaaugcacaauuacuaaauuugaggacuguguuuaaaauuuuuaaccuggggcauaggacucuuuaaaauuggauucuucaugucuuuccaguuuaucuccaaccaagcacccugugcuuugccuucaagaacgaaccacagaaucucuaguucagcuuggagugccauauucuuuguccuaauuaacacgaugcugauuuuucuccuuggacugccaugccuuagcuuccccccacccccaccccacaagcuucuguaguucauuaucuuuauacacuauucccagaaccucugaauacaagaaucuuauuaaagagccccucagcaaccugugcccuugcagugcagacacccaacacuuuguuuccuuugaaucucuaccaggagccgaggaccugcuucauauaugcuugagugcucugcagcaugugugggguguggugacaaguagacccucugcaaggcuuugaaaaugacagagugacugugugaguuaaagagaccaugcucacacucuggcccacauguaaauguugcuuuuauuuccucgauugagggaugagaugagagccauacucaggcuuuacagauacauggcuugggcuaagcucagagucuaucuaucccuagaucuaagccuggaagcuucuaacuucuguacaaucuaaucuucuggaagccuggaccuugaaagcuucaucuuucagccucugucugcuauccuaggccuggaaugcuucagccuccaauacugcugaguaaguucagccuuucugaauccaggcuggcugguugaacucagcuguucuggcucaaacucccuuccauucuuucugacucaaauuuucuucucuuggguugaauugauaucucugaauugcucugcuuggccuuauacuaacuuugguaaucuguucuaauuuggcuccuucucauucucuggcguauucugucuuccuguggcuagcuuguucucucugcagccugucucugugaaaaugccauacacaccccaccacacccccuuuuucucucucuugcugcucuuaaguagcuucucuuuccuaugcuugugugaguugacuguagccuaucuccgacucacucugucaaaucuuucucugauuugucacuuugucugccccucaauuagaugucaccuucagacauagcugcuuccuucuguaaacuaaccuuaccuucauuguuaaggauuaaagguauauacuaguggcaugucuguauuucagccagaucaaaaaguauuccaggacauauuugcauucugcccagaucauauagaccuagaaguuauguaggauguuaucccuugccaaagcagccauguugcuagauuaaaaauuccucuauacccaggugguuuuuaaacauccuggaccacagucauugcuucuuucuuuagauuugaucauuuucacagacacauauccucauccauuuuaauauuuguuauuaguguuggcuucaccacuguauguuccuauuuuaauauuaugggauagaagucucugauuucuggcuucucucuguguccacagauaucucucucucucucugucucucucucucucuuuaauugccuucagacagaaucuaccacgaaacuagaaguuugcucuuuuagcuagacucacuagucagugggcuccugauagcugcuucucuucauccccuaaugcuaguuucagaaauaugccucaugccuggguuuuuacaugggugcuggcauuuuggacucaguuccucaugcuuucauaacaagcucucuuaacuauguaagcaucucucaucccuggaucagaaucuucagagucauccuugacagcccacgucucuacucugauuugauuuguugucagucucugaccuacuuaccuuuuaacaucaaauaaauucagaccuucccagccuuauuaccucaaccucccauuaaccugugaugacaccaagcugccacuguuacuuugcccagcagcagcucucucugugucugcgacaagaauauuauucccaccccuguacugugcuggagugaccucuucagaaugcgaugcuuucucaccuccuucacacccuuagaagcuaacuauaaagcaugcccaaaggaucugcaugcuuugcugucucucaggcccuagcucuugaacaucaaacacuuucuccuacucuccacuccaggcuccuggcuucuuacagacaccugguuugguguucauuccuucaugccacaggccguuacauauguaacauaugguguucuucucuuccuugccuggaccuuuccuuuccuuuguuuugccuaauucuuguuuaauccuuuagauuaaacaaguuuagaauucuuuuugggcauugaauuuuuucuagagaaaugucucacaucuuugacuuggucuccuuuguaauuuuuccauugcauauacgaugaugugauuagugguuguuuucuugguuuuuguuccuggagaacagagugcacauagaaugugcucauuccuguagucccgcugcuuauugcuuuguuagagauauagccauucuggacacuucuguugauagaaaaguugaccggguuuucuuuugcuuuauagauacgacauuucauuaauaaggaccauugagaggaaacagaguaaaggauauuuacauuuuuaauauuuuccaguucagguugaaagcacagauagcagcaagaauggguaaguucugauucaaaauacuauuuauaacaacauaaaaauauauagugcagagauuaaauaguuuacauauucaaauaacgacaucacuguuucuuauuucuccaacaagaagaaugagcucccucaaaauacugacuaaaaauaauccauucucucucucucuuucuuucuuucuuuuuagaaaaaaaauacacagguuuuuuaaaaauaaugucacauuuaaucuuggaaacuaugucaaaggcugaguaaguauuuuuuuuuuuuugcaguaaucaagaguuuuggaaucauguguaauauguaguguuuagacuuauacaguuauuuuaaucugcaucugucucuauggauaaagacauauaauuauaugcaacuauauauucaauaauguaggagauuaaugguaaugacauaauagcaccaugucuguuuggggguaugguguccuccauuuggaucuugcuauaauucuguuuuaucauuguuuuagcuacuccagcuuauucaaugauuuuguugaaucugaguucuuucugauugauggcgacuccuugcucaucacgugugcgugugagaggucacuuaagccaggacagagucuccacuucuucuaccugguugagcgcuaccuguuggauguuauuagcaaaggagggcaauuugccauaguuuucuucaagguaacacauuccaacuggguuuuuuauucucuaaauacuaaaaucggaauucaccuaauuaauuagagacacaggcucuaguugccgaaacuggccuuggacucaacgauccucuugccucuaccucccaagugaaaagauuucaagugugcacuacuaugccuggcuacagcuaaaauugguuuuauaaaauuuuguaaauguuuuaaacucugauugcaaaagugcggaaaugauuuggagguuuaggcccgaggauugaaguuugaagccugccugaaccucacacagugaguugaguagucuagccaacuugaaaagucccucuuaaaagaaaaaaaaaaucuggaaaugcagcuuagugguagaggauuugccuagugcaugccagacugugaguucaauuuccagcaccaaaaagaaacaagacaagccaagccaaaacccaaaccaaacaagaacaaaacaaagucaacaaguuuaaaaagaagagaaaaaacaauaaccuaucauugcaguguucaagaauaaauacaauucgauuauuucgucauguguuaugagguguuuguaguguuuacugaauagacacagaggcacaaggaugggugaaacucuccaacaguagccucaauucuaguccuccaucugagaacuacucugccuucgaaacucagcaggaaauguauuaaaguacguuguuggguguauuugagcccauacaaacuaacuaacuaacuaacuaacuaacuaaccaaccaacccuacuuugguauucuaugcucugucauaaauacuuaugagaaaauaccauauuuggucucauuaauacaauuuggacaguuaguuucaaauacagcuuuauguaccugcuaccauaucuuccucuuccuauaguuagaacagcuagcaaucuacacaaggauuccugcauggguugguccaguuuggaacucauguuaguguauauuucugagcauugcuggccagcagaauuuugcauaaggagcuaggguucugcucuauauuuacaguugguuguacaaauuuuggucugcugaggaaaauucaugcuguuuaagaaauguugucgcagccuggaauuauucucuagaguaauguguucccauucagcucccaauuucagaaaguuuacaguugcaaauugcuauuuucauaguuuuuauguucuuugucuucuugaagugagguaggaugggagaauuauuauaauacaggaaggcaaagugugaugaacucuggguacucuuuuguuuucagggcacccaugcuuuuaaguccaagugggauuuauagcauacauuugugaaacagcaccagugccaauuuacugacuauagaacagaagacaaaaccccacaaaacaaauggcugcauuauauuccuucaaugaccuuaaaacuauauguuaacugaguaggcuaguaaaauacuaaaugauacuuuucaaauaacauacuuuaccuccucugcuguaggaugcugaguaugcauacuucaauguccccgaacuucugacacugagaacugcuuuaauucugcaucuucagaagaauaccacuguugaaguuuggacuaaguuuucuaacugcuugucagaagaguggaauauuugcuugggucagaguugcccauauuucuugauacuggcugaugaaggccugaacgaccugcagacacaucuuuucaacuuuguaguuauucaggccugggcagcaaaggucaauauugugcucuucucaggacagacaucugacauccuucgucuuuaugcauacuuuaugcaaagcucucauggaaugcagauguucuucaaggagguaauguauaucgaaaagaccacguucuagaauuuuacacacauuucuaaauaaacucaggaaagauggcucagugauuaagagugcauauuagucuuggauccauguuucauaguucacaacuaccuauagcuccagcugcaaggggauuugacaacucuggccucuguauauacaugcacauaccuacagacagacagauggacggacacacacacacgcgcgcacacacacacauacacacacaacuaaaacuuaaauaaauauuuaaaaaaauuaacucucuugauucaauauugacucuaccugcaauaaagaaauuguuauagauuuaauuauuauagauuauaggaauauauacaguuuaauagcaauaacaaugaauuuauacugauaacauauagacauuugucaaguacuccuugucauauaguaguucucaacccauggauuauucacauuuaaccgucaccgaaaucccuugaggcaagcauaagaaucaucuacauuuaaaaauaaugaaauagaugcuugaauaaguagccuguucaaaaucaauaccaaaugaguaguagaauagaauauaaacguuaugagaagcaauaacacccuguccaguguauccuaacauugugugguauguuaauaaaagacaugaaauuggaggccaacguaugucucugcugcugagaucugcuagucaaaugauugaucgugugguuaccuuuaaugagaacgcacuggagcugcuuaaagaaggaaaagacagaaauggauuuauuuuuuuuuauaaauaacuucauucaguaaaucauuugcuuuucaaacaaucaguauucuauauugcuauauuugagaacuaauuggcauuuucagagucagcacgugugcaggcuuuauaaauaaaucuaguuugcuuacuuuuuuuaguaguuaaggcaaauucugcauauagauauuauuuuauaucuuauugaaguggcuuagcuuuagaaacaguugacaugugucccucuuuaagaauuacaucauauucaucaucauacauuugcauacaugcaaaugguugucaugacuugaugggguaguauccuuugcuuuuguuaggauuccuaucauuaaaguauuccuaacucugacugcuagcugggagcaguaacaggccuggcucuguuuuuauaccuuggggaaguauuaaauacagaguuuauguuguagcucuuuuuucuuuucauagacugggucucacuguguagcucagucaggcuuagaaauaauuaagauccacuuuccucuguaucccugagugcugggauuaaaggcauaugccaccauacccugccugaguuuauaauauucuguugacagcaguuucugcaucugaggucugagaaagcuugcaaaaaaugugccuggaauaaauuuucauuaacauucaccuuaaauaaauuuuauuuauuuuuuaacauuaaccuguaaaaguaacuuuuauucacuuauaaaaguucucaguuugucuuggaggcuuccugccucugucugcuauucuaggccuaguccuagaagcgucaagcccucauguaguauaaucuaggcguagaauacguuuagucgaugagacuuacuauugaauaagaucacccuuucuuaaguuauuuuugaucucuggcuggcugaaucgauucagcuguuccggcucaaacuccucuccaagcugacugauucaaucuggcuuuuuuccacuucugaaucgcucugauuggacucaaacuaacugaauucacuccaaucuucuggcuccucauucccuggcuaauucagucuucaccugugucuagcucauucucucucugaaaccugucucuguacaacucaaacugucucucugucucugucucugucucccugucucucggucucucucucucuguacugccucucacguaucuucccauucccauuaugagagcugggcagaucuuagucugucagaacuuucucugauucagcacuuuguguaccacucaauuagucaccacuuucacacauagcugcuuccaccuacaaacuaauuuuaccuucauuguuugggauuaaaagugcguacuaagggcauguuugucuuucagccagagggauuaaagguguguacaaaggcugagcuacaucacaacuagaaacaggguuuuccaguaaacaacacaaucucggguuucacagugugaacaaauauccugcaacauuaaucaauuugaagcuuacuugaaauagaauuuaaaauagagugucguugaaacuguugaccagaacuguuuccagugccacuggugccuauggagagagagucucaccucuucuggugccuguggggagagagucucaccucuucuggugccuauggggagagagucucaucucuucuggugccuguggagagagagucucaucucuucuggugccuauggggagagagucucaucucuucuggugccuguggagagagagucucaucucuucuggugccuauggggagagagagagucucaucucuucuggugccuauggggagagagucucaucucuucuggugccuauggggagagagagagucucaucucuucuggugccuguggggagagagagagucucaucucuucuuaggugcuugguugaaauuugugcuggugaaacacagugaauuuuuuuggaggggagguuuguaaauguaucguauuaugaucauggucaauuuucuaagucauugaacuguacauuuaaagugacuaaagugccagacaggugguggagcaugccuuuaaucccagcacuugggaggcagaggcagguggauuucugaguuugaggccagccuggucuacagaaugaguuccaggacagccagggcuauacagagaaacccugucucgaaaacaacaacaacaacaacaacaaaauaauaauaaaauaaaauaaagugacuaaaguuuauauuauuuauaccuuuguuaaacugcuaagauaagguacuauuuuaaaaggcaaagauaaauaauuauugccugaaaaugcauauaaaccuugcugaccauccucaguuacauuagugugaauuuuaaauugagaacugcuuuguaacgugaguuuaccuuaaauuucugaguuuagccauugggaaauaauaauuuuauuuaugacaauuuucauacuugguuuugcagaauaagagaaugaucaugauuguuuacaaaagccugauucaacagcuggaaaaauacagagauauggcuuuagcacaucuguucggagauuuaaaauucaaugauauggaagagaagguaauagaacuugaaaaaacacuuuuuaguugaacuaucuuuuaaaaaguguguguguguguguguguguguguguguguguaugcacaugcaugcacacaugcuguguguaugaaggucagaauauaacuuuguauauaacuccuaccauuucaccuugagaccagccaucuuccaggguuucccugguuuaauggauauaguaauaggucuacuguagcaguggugaguaugaaaacuacuagccaccuuuccccuguuccugaucagcauagaaaugucuccccuuuuaaguaggacuaagauaaagauaugucuagacucugguguaaggauacugagauuuuccuauugcuuauauugugaacauacuguagauauagcauagucccuaacauucuuuuugucacauugccuuaacaaauuuucuaauaacugcauucccgguauacauauauuucaucaugguguauuauuuuguuaauauggccuuggguucuguuugcuguauuuccuguucaacuuuugccuugguuggcauugcaauacuuuaauuuucauucuuuguauugucuaauauuuauguguaaggguuuaugugacucaugcaaaauauuagaauguuagcacuuccuuuuuaauauucugaaauacugucuagauaauuggaauuauucagacuucuuugaaauucucuguuugaaacuugcuguauauuuguccagguguuuucuuugucauuuuauguagcucauggauacugguuuacuuaaacuuacuaauuccaagagaaucaguuuuauaguuugcuccaggaaauuagcaacuuuacuuuuucaaguuguaucuauugaaguuucugaaguagacuuuaaaaaaaaaaacuuuguaguuguuuucugacucaguguuauucucucuccuauuuuuauuucauacuuuugucauuucucuuauuaguuuaauaauuuuuuucuaguuucagcuugaguuugaauuagauauuuagacuuuuauucucuuagguuaugguuuugucuuuuacuuuugauuuucuuguuucuuucuuuuauuaaaauuuuuuuuuuuuuuuuugagcagagcaucuucucacuguugcuguuaaaugcuguuuaguguuaggauuuuucucugaacacugcuuccauugcaucacguagauuuugaaaaaaaagacaacaauuuucacuguauuccauaguuuaugguauuuacugauuuuauuauaauuuuaaagaaauuacauacauucaggcugucuuuuuuuuccacaugaaugacuuaauagaaaauuuaaaaucugugacaggaauggugggacagugguuaagagcaguggcugcucucacagcggaccugcguuugauugccaacccucacacggugcuucacgaccauccauagcuccaguuacaggggaucggaucucccuuucugacaccagugggcaucaagcaugcaugugugcaggcaauacacucacacuuaauauaaaagaauaaaucuaaaaauaaaaagaagauuaaaaauuccugaugaaaaaauuucuuuaaaaauggcauuuacauaucuagggcagauucaguacuucuugugauuguucuaauauacucuuuaauaauaccaaucguucuuauucuugcaaggauuuggaaucucuccuuggucacuacaguuucuugagguggacaaguaugacagggaacuggacauccucuccauuucuucauuguugcuuuccaggacuauuguuuucuuucuuucuuucuuucuuucuuucuuucuuucuuucuuucuuucuuucuuucuuuuuucuuucuuccuuccuuccuuccuuccuuccucccucccucccucccucccucccucccucccucccccccuuucuuuuuugacuaauguagcagaggugauuuugcacagaauauccauaaaagugcucaguacuuucagaaaguugauugcuaugauguguguugcuuuuaaucauguggauuacccacccagcuauauacacauguguuuuaagguguagugucauugcuuagagguaagacgcacaugucuuuaagagacaucaguguauuuuacaguaguuagguuaugcugcuugugcauuauuuuuguuacuuuucuaaacuauugcacacauauuuugugacuugauuaaaauucuuacaauuguuauuuuaugggcauauggacauauuucuugaaugccaaacauuuaacaguuggaagguuugcuuuuacaaauaauucugcuaugaacaccuuugugcauaugucuuugggcagauuuuggauuguuccuuaguuuagcucuuuagaacuugaaugagaaauauuaguauauugaauggcgauucaguguauuguccuaugccuuuuccuaaaccuuugccuguuuauaaccucauuaggaaagcauaugcggaguggcauaccuuaauuucuaaaacuguuauuaaaguauuaaaagaugaauuagcacucgauaacauaaaaauaaaaacccuugcaguuguuauauuacugaagaauuuaacuuuuuccuguuuucucauuauuuauguuucauuagagaauaauuauuuaaagagucauggauuuucucauugauuuuaugugcaugcauuuguuaacaguuuuguuaaaaaguuuuaaaacaauuuuaucgcucaaaauuuuugcauauauauauauauauuaguggaacuagcuucaauuucugugucaacucauuucuuacuauauaaucacugaugaauaaauauaguuuucuacaugucacaaccuguuaccauuuucuacugugccagguaugugaaacuguaucucugcugaaacaacucuggccagaaggaucugacauccgaugugucuuuugugucaccucauguucucucuucuuggaaauguaucacugcuacuuagaaagcagagagaaaggagcaucugaggagauguccaaagucaaacaggugugguugauacacugggauacaguuuguuacacuggaauacagauuguuacaaugggauaaagguuguuacagcaggauucaaguuguuacacuggaauacaauauugauuucuacuuuugcuuuuuuauuauuuuucccuaucauuuuccccaugcagcacuggaauuuucucuuguuuauaugaacuucaaaaauaggaaaauuccuacaauuccuguuauaaagaacuaugcucuucaaugauguagaguguuacauacaggucuuucauguaggaucuauuuagcuuaagucacccacaagcaggcaaaggagaaacuaccuacuacaugcuuuggguuuuuucugugcauagugcaugaaauguucaggaaagcuuugcaagauagggauuguuauuucuaguccacguuuucgagaacugacuuuaggcuuuugagaguaacaguccuccaacucaagguauuagauaauaaaguagguugaauucagauuuaucuuguggaaagcucucacugacuuuaaaauauacucucccauuguggugccuugauagccuacuaacuggggagguaauacuguucuuaggugucuuuauugcaaaaagcgucaagaaucuggugaccaguugagauuuagcuaugacuaagcaaacauccaucucugcaucuaugugcucgugggcacauagguaaacacacagcauagcaugcuacauauaugaaaucugaguacugcgcaaucucagcugaagaauccuguuaacuuucuugauuucagaaaugggcaaggacauguuuuuaauauuuugcuuuguaguaucuccuuaaauauaauuuuuaacgaaaccuuucuacaggaugagacauccuguuuuaaaucaccccaaaaucacgauaguaagucaaacuuuucucuuuggaacuucuaaccauuagacccucucuaucauccuauagaucucccaugaaguugucuugcuugacaauaggaugaugcuguugacccagauacuaaauacgucuacuacuuacccuguugucauucugcagauacaccuuuuagauacauugauagccugcugaccucaugcugguagcucauagaauugccuuagaauaugauacauggauagaagagaguacuuaucauguagcccaaccaccaugguccuaugaaaccuuuccuuuaucacguggcuuauuagcuuaaccaugguguuccugaaauacugaaucaugccacgcgccaacugcugcaaagcuagaagcuuccuuucgccuuuuucucaagcauguuuaagugcagccugguuccugacacagaaguaaagaaugugaggcuacagaauucccacauaaaagagcuugcuuacacuuuguacugcugaaaacugaguguauggucucccagccugucguucuuggcucaccauuuuauuucuuucagaaaacagauaauugcuuaacccugaaggacauggaagacuuuuguaagcuacauugccucaguguggcucuuuugcuccauguaccucucucucagagagcucgcucaagauucaucacugcuaauuggauucaggaccucaagacuguccuaaaaaugguaaauauaaucuucauucacuuguacuucuguuuugacuacgugauauauaaaaaucacaauaaccuuugaggcagauuuacacaguguagugauaagcauugaggucuugagagguuggugugcuuaaaucagucacuuggacuaguuuuaacaacugaauuagguagcaauagcaagcaucguggcauguauccaaccccagauuccagagauuuuccuucuuuaaauucuaaccaguacccccagagcucccugggacuaaaccaccaaucaaagaaaacacacagugggacucauggcucuaguugcauauguagcacaggauggccuagucugucaucaaugggaggaguggcccuugguccugugaagguucuaugccccaguauaggggaaugccagggccaggaagugggagugggugggugggggagcaggaggagguggggagcggauaggggauuuuuggaggggaaacuaggaaaggggauaacauuugaaauguaaauaaagaaaauaucuaauaauaaaaaaaagauacuaaaguauacuuaggcaggaauguauaauauuaaguuauacuauuuuaauguaaacuugauagaaaaaaauucuugucaggaucaagguuuuauguaauuaacuaggaaguuuccagugaccaucacauuacacguugagaaggagcugaggacaucaauacaaugcuuuaauuuuuuuuuuuuccauuacagauuauggguagagagaauauggagaccuuaggaaaacugaaagcaaaaauuccuuuagagucuuccguacaaaucuuguuauuagaaccuguuaaccuuucaguuuaccuuuuccauuuucagugcacagauauuucuauuggaaaacugaaacauugcauaaaauaaaaacugaucccaaaaugaauuuaaaguggauauggccaugcuguaaucccagcacuuaugaggcuaaggcaggaggagcucugcaagguggcggccaguguauguuacaccgucaggcucagaacaaccuccgauacacagugagaccgugucucaaaagaaaaauucauuuucuuuuuuuuuuucaaguuuuuuauucuauucuauuuuauuauuauuauuauucuuuaaucuauuuuuacaguccagucauuauuccccuccuggguuuggugugucuucucucacugaggccagaccaggcaguccucuguuguaucugugucaggggccucagaccagcucaugugugcugcgugguugguggcucagugucuuucuuuuuguuacgaauuaaagaaauaucuauugaauuacuauugauuguuuccucccauugugguccaaaaucucaaaaccuacauaguucuucaucuuuucaaugugccuuuguucucuacuuagguuucccuguucacguuggggcugucaagaguaggguugcuaaggauauccguauacauuucuuucuuuuuuuuuuuccuuuucuauuuuuuauuagguauuuagcucauuuacauuuccaauguuauaccaaaagucccccauacccacccacccccacuccccuacccacccacucccccuuuuuggcccuggcguuccccuguacuggggcauauaaaguuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggagcccugugauccauccauuagcugacugugagcauccacuucuguguuugcuaggucccggcauagucucacaagagacagcuacaucuggguccuuucgauaaaaucuugcuaguguaugcaauggugucagcguuuggaugcugauuaugggguggaucccuggauauggcagucucuacaugguccauccuuucaucucagcuccaaacuuugucucuguaacuccuuccaaggguguuuuguucccacuucuaaggaggggcauaguguccacacuucagucuucauuuuucuugaguuucauguguuuagcaaauuguaucuuauaucuuggguauccuagguuuugggcuaauauccacuuaucagugaguacauauugugugaguuccuuugugaauguguuaccauuuauuucuuuuaaacacuuuauuaugagauauuuuagguuaauacauuaacucuacugaugucuguaaaguaaacauuauagcaguaguuuugcacuuuggcuuuugucauaaacuuauuucucaguuaaauuguuuuguaauugaaaucuccaguucgugugagugccagacgugcaguacagacuugaauggaugucuucuauggacaacuguuauuuaugaagaauuuucgacauuuuuuuuaacacacaaaggaagugcuuuaggucagaagacauuauaagaaucuuuacauauguggcaguguucuaagguggccuggaaggauggaccuggucacaaauggcagcuucuuuuucuuccucacgcugagaaucauuacaguguguauuuuguuuuauuuuacuauuuauuuuuaaaauucacuuuauaucucaaucuuagccgcacccuuacaaaucccuuccccccacugccuccuccccuucucccaagagauggagagccccucuuggguaccaccucacccugaggcaucuauucccagcaugucuaaauacaucaccucucacugaggccaaagcaagcaguccaaguagguagggaggggauccaacagcagggaacagagacugagagagccccacuuccaguuguuaggggaaccacaugaacacugagcugcacauuugcuacaaauguaucagccaaggguuaguuccaacuccugcaugcuccuuguugguggcccaggcucugagccccaugguccuagguuaggugauucugugaguauucuugugguguccuugacgccucugaauugcucacuucuaucccccacucuuccacaagacucccaggcuuugcaugauguuuaacuguaggucucugcaucugcuuccauccgcugcuguagaagacucucaggaggcaguugugcuaggugccugucuguaagcaugguagaguaucauuaauagugucagggcuagcucucucacauggaauggaucucaguuaaguucuagucaaagggagaaugggugaagagaccucaaucaggaugcucucauuuugacucuguaaaccauaucacugaaagaagacucaucuacccagaaguaagugcuuuuugugcggacauucuguguuauaguggaauaucgaugcacaaacuuacauugggugaauaaccgucagcguggguauaugggaauauccgaguuugaaagguuuagugcuuucuagaauccuuggcagcccaacucuugacagcccaaaagugaacaaggaggccuaugaaccacauugagaagaaaaggaauuuucuuuuugagacacggucucacuguguaucggagguuguucugagcccgaugguguaacauacacuggccaccaccuuguggugcuccuccugccuuagccucauaaguguugggauuacagcauggccacauccacuuuaaauucauuuuggaaucuguuuuuauuguaugcaacgcuucaauuuuuaaggaacaaggcauaauccuuauucaucuuaaaugcauuuacauugcuaaugacaauuggggcaguccuuccauuugccuuuccuuaggcuuagagagguaaaugggguugcucuuuguacuacugugggcauaaaagcugucaauaacuuuguuuuacuuuugauuuucagaaaaaguggugcgaguauuuuauccuaaguaauuuggauauguuugaaucuuggagucugaauuuacuucaccuuucugacuuaagugaugagccuuuguugaggaauauugcuuuuuacuaugaaaaugaaaauaaagaagguaucagugaacuauauaaauaucaccuuccuuuagagagaaaguucagaaagaauuuaaagcaucaaaaccauuaaaaauucuuuuuuuauuuauuuuauauuccaauaucagccccuccauuacccccucaugaagauccuucucccauuccuccuuccccuucuccucugagaagggggagucacccuuuagguauuaccccuaccccucacuguggaacuaggugcauucucucucaccgaggccagacacagugacacaguuaaaggaacaggauacacaggcaggcaacagauucagggauuguacuacuccagugguugggggauccacaugaagaccaaggugcauaucuguucuauauaugugggaaagggguggggugggguccaacccaugggguauuugcucuuuggugauuugaucucugggagccaccaaggaucuaggucaguugacuuuguugguuuuuccuguggagucccuguucucuuugagucccucaauccuuccuccaacucuugauaaaacucccaagcuccauuugauguuuguuuuggggucuuugucaaaccauuucuuaaaugucuguuguauaaauaguuaucauuuucuaguuucccggucuuuguuuaaacuuuuuauuuagugguaaucagaaugaauauaguaauucaaauguuuuucaacuuaauauuauuccauaaguauuuuuguuaaaagcauguguuuauguguuagauauuucauaacaguucauuuucacccaugguauacaauguuuauuauaaaaucacucucauuaauaaaaacaucucacuauuauuagauauuuagagauuuuuaagucuuuccaagagauaaacgauaaucccuacacuuucuuuguguacguuuuuuguuguuagaauacuuuuuucuuguguuuuuauagucaauggaaaauaaaacacauuuugagagacaaguacuugaauguuauugaaaugucuuuuacaucaagauuugguuucuucauauuguuccauuguuaugcauuggaacaaauuagcuacuuauaaacuaacgauucuuugcuaauuuguauuuuaguuuuacuuaguguuaguggguacaggguuauguguggcauaauauuuuuauuaucuuaaaauaagucuuuacuguugguuauuauuaguuaagacaguuuuuaauauuaagguguaaaacagaaaagcaagauugguuuuaagaugcaucagggguaucguccacagagugaucauuuucauuuagauucagucugaagccuacugaaaauuccacuauuugccucguauuucagagcaggcugacuugaaugaagauguauguguguguguguguguguguguguguguguguguguauguguguguguguauguguguguguguguguaugcuucuaggcaugagucagugguacugaguaauuuuaauuugguccaggccuggauuugaaugugggagaugccaucaugaacgaguauguacaucucugggacacugugucaaaguuggucagaaaguuugaugugggaaaaccaauuccuuugagaacaacaaaaguucauuuucuugaaaagacaccaucaccaaucaaagguaauuuauucccaucuuaauuuugaggaaaaacaaaaccuuaacaucuccaaguagaaaucauuuuuguguguuuuaaauaguugucauguucaugugcuagugugugcuuugacucauauuaaaaacuuguauuuuuuuuaaauuuguguguuuuuuuguaaauaaguuugccaauuuaaaaaucaaaaacagaucugagugaauucuauuucuagcaacugaagauuuucuuuguguaauaguaguggaugaaagacacucagauucucuuacauaaugauaguuccacuuaaaacaauagaaugggagaagccagcaauguaacucuggggaagcugagacccaccuaugccaguucagagucuacugugaugccauacucagcaucugcuuuagauaguaacaaaaacaacccauagccgugcguuagaggagaagaaagagaagcugaagaauaaaacgaagccagcaaucauuuuagaaagccuuugcccaaaucacugcaagcacagauguaaagaugguugugucuucccugguggcaggcacaggagccaaggccagagccagguggugguggaacucagucuucacacagcccaagccaauaagaacauuaauucaaagguuaguguucgcuugaccagccuguaaugaacagaggugaaaggagucacacuaggucuggaggauaauaaaguacucuugagaucucuaccuuggaagacaggagguagauugcauugggaaucuugggauggaauacacucuaguuuagaagcaucuucagugaagaacaagaaagguaggcuauucuccaguuccuauuaugacucuggcugagagcuauucucuugcuucugguuuauucuuuguggaugguaaagagaaaaguacuuaaacuaauuguuacaaaagguaucugggaaaacacagaaacagagagcaucaggagaauuaugaaccacauguuaaauaaagaguauucauuaguccauuauaauagccauaaaaugcuugugauuugucuauuuaucauccauacaucuauauuuuuauucaucuaucauauauacaucuaucuuuuuauucaucuaucuaucuaucuaucuaucuaucuaccuaccuaccuaccuaucaucuauugaucugaucuaucaucuauuugucugccugccugccugccugccugucuuaucauuuugucaucuaucuaccuguuauugcacaugcuuguuuauaaaccaaaaggaaguucaaaggagguacuguaauaauaucaaucacauaaccuuuguuuuucucucauuucaauuucauuucuugacacuguguaugugaccucucaaauugcuaucuuuagauuucuuaucucaguagaaaaugaugaaaggacuaagcauuagaaaguaagcaccacaggaauuaucuaucuacuauuauauaucucucuauuaucuauuaauaaucugucaucuucaucaucaucauagccuuauaucucacaauguaucugucuauucacccagaugcauaguuaauuuacugaccuauuuacuuagauuuuauuuauuuaucuaucuauuuauuuucuauuauguuccaaaagacucaaugugggaaauaguuuuaugugcaugauuagaauuagaauauaaaauauaaaugaaguaaauauaaaauguuuuuaaaugugaaaauuuagaaaacaauuauuaucuuccuaucugaaaauuucacauuuaaauugaugacaauuucuccuuuacagaaaguucccaggagaugaugccaaauuuagguuuuauuccaaugucauguaauuuaguugaugaauuuacuggagacauuuugaaagacuugccuuuccuaaugagguaaggccuaaauauguuuuaguaaauaccuguuuggaauggauaaguuacuuauuaaagguucuuugaaaaaaaccucuccugaauaaacuccaaaaacauggcagaucuaaaacaauagauuauaugugcaacauauugucuguugaccuucuuuaugacaucuauaugauuuuaauuggaaaacaaagcacaucaccauuaugauaaauuauugaaacaagcaauguuugaguguugaagacaugaggagguccugguuucugaaacuucuaauaaaaugcuuuuuggauucuaucacacaucuuguaucccaggaagaagaaaaggaauuauaguuuucaacguuuuaccagguguugaauuuggaggcaugaaguaugaaauaugccuuucuuuuuguuuuccagugaugaccccauuguuacgucacugguaaagcauaaggaauuugaugagcuugugcacuggcacucccacagaccucucagugaugauuaugacaggacaaaggugaauucuggaggugagcaugcagauucagcugaaagaauuucaaucuauuucagucuucccuuuguuucaaugggaaacacauuaugaacacaaaugaaaaguguugaggaugaauagucauuaaggcauucagaugugugacacggagaagguuaacagggaauuaucacuuugauucuuggugguugguuauucauauggaacuuguaggugucuuagggagaagaaugcguaugugaucuuugguucaugagcuuaucacuguguuaaggaaagauggguugcaguuuaaggagucuggauguucuuugaagucuaauaaauggaaauuaagcucacaguuuuauggcagugauuuauugcccaggauaagagcuuuauauuuuccuacauaguaauucaaggaaccagauggucuucuucuugauucuuccuucuuuagcuuauucauagcauacaugcugggaauuauuaaaaaacaaaaaucaaccaccaggaagguuacucauggagcccugcucaucacuacugaacuauugaauacugaaggauuauggaggaaagacacucauuaucuucaguuguguaccauugguaguuguucaaacucagacaaacaaauagucaugauuaaaaugaaugggucaugaaucaaaacaaaaauauaugaguuuggaaaagagacuucagggagaugggagagaugacagaguaaaaagaagauaaaagagaauagggguaaguguggugguuugaauaugcuuggcccagagacuggcacuauuaagaguuacguccuuguuggaauaaguguggucuucuuggaggaagugugucacuuugggccugggguuugagacacuucccuagcugcauggaagucagucuucuccuggaugcagugagaucaagauguagaauucucaacuccuucuccagugccaugccugccuuggaugcugcuaugcuuccugccauggugauaauggucugaaucucugaaccuguaagcaaaccccaauuaaauguugugcuuuaucauaguugcuuuggucaggaugucuguucacagcaauggaaaccuuaacuaagacagaaguugguaucaggagugggguaaggcugugauaggccuggccauguuuuuguuugaacgaauguggauuuugagacuuuagauuuggaaagucauagaaugcuuuaagugagacucaauggacuguucuagaaggaauauggugcugagggugauuugaacucuggagaucauucuuaugauaucuuggugaggaaugcugaugcuuuugcccuucucugaagagucugucugagacuaagguaaagagucucagauuaauugcauagacaaaggaugucucacaaaugcccagaauaaacuuugucuucugguuuacucucauuaaaagcauuuugaucaagcauagcaagcuuaaaaagaaacaguacaaaauguaugguucacggaauaaagggaaguaaaauugagcugaauccaaguucagggagauaugaucucagugcaagauuccaccuagcaaagcuuauugucuguguuuguaguuaaauaagaaauaguuaugucauguuagauguuauuaccugguuacuguuuucauuuggaaugaacuacaauccagaaaugaagggcauacuugugauccagaucuuaaggcuggaagacacaaucuuuugauccagaucuugaggaauaguggccaugaaaugccagggaccagccucagcauugagaggguuucugaaagaaggggugucugggagcagagaaaagaaugacuagaagucaaauuguggguccaagcuggcagccuagguucugcugagaugguuuuccagaccccccuccccuucucugcuucuuuuccccacccccacccccuuucuguguguguucucuguuguagacaguuuuuuuuguuuuuguuuuguuuuguuuuguuuuuugcuauuauaaaaacucucugguugagacagcugucucugcuagaaaaauucuaaaagcuaucuggauaguucauggguuuucugaccaaagucaaaaagcugcuauaaaaaaguauuggaucuuuugaccaagucagaaaucuugcuaaugcaaaauuuuuaaagaguuauuuuguucucuagacaucuccagacagcucagcucuugcuagagaaaaauucugaagaagaacugcuaucacuuucugcuagcucauuucaugcagaccaaaaguccauuuuuaauuuauauaucaauucaguuauuuauuccagguucccuucugaugauccuaggaaucagcauccugugaccccagcccuuugauucuuaggaaacagcaagcacacauuuucuuuuaauauugcaaaagaauuuagaggucuucuuccugucucuguuaagaacagagaauaaacuagcugguugagacccugucuugaaauuaacauuucuaccacaccugggucuaaccuugcugugucccaggcugaccuugaauuuaggaaucugucugcuuuguaucuuccugccuuuuaucuuucugacaagcuugcucauuaaugcagcugccuuuguuccuuuagccccucauaaaauucauauugcauccuucuauucuuugcauaguugaguaauuauauauuuucaaacucguguguguauccaagcucuuugccuuaagggcugucuugaagguccuaguauuuacuauuuugcugagacauuagccacaucuuccacuccuagauucaugcugucucugauuaucaugaagucauuaauguuaacagagagaacauucauuggaggaaugugaaaauaugugcauuauaggcucuuaccagggccuugucccaggggcaggaaccuggucauucuuuccccaccagggcuucucagggcucagcaaugaaaaguuuaggccaacucaugguaguacacaccuuuaauccuuggagacaaaggccagcagaucucugaguucaaggccaaccugggacagagcaaguucuuggugaagaaaaguuuaauccaggcauagugacucccgccuuuaaucucaggauucaggagacagagccaugcagaucuuuggguucaaggccaauuuaaagaguaaguuccagguuagccaagcuuaggcaguaaaggaguuggaaaagaaagcuguaaaagaaaggggccauguuccagacucugcugcuuuguccacauggcuuuagagucaagaauagaaaggacaacugggacaguuguugcugguuagcuggagcuaagaaauuaguugugauuaagaagagacuagcaucacugaagugaacucuucugggaaguguuuucuaagagaacaaagaagcuguguuucagagauugccaagguuauacuggugcugcagcuggacuugguaauguguaagaaucacccagguggcacugguuuugaaggcaugaaggggucauggagagcagcugaggcuugggacugugagaggccaagagaggccacuagugaaaguacagccucaguugcaguugauggcccaggacugaagggaucaugcaaagaaguugaggcuuggcaccaugaagagagccuaugagaggcuauuggugaagccuaguugcaguugaagacuccaguguauuggagaugccaguaccauagaacagcaguggcauuggaguggaucaaccugagcuuagugugcugcagagggcagagcugaagaagugaugauagcaccucggagaagccuugaagaucacauguggaucccagagaucggaacaagaacauguaaaguugaagaacaugaagaugcacaguuuguaguuugcccagcugucuuuaggucuugcuuugguccaguauuuccucacuaugauguuuuagaauugucauguauaucuugugaaguuggagguaugugaucugcuuuuugauuuuugacuuuauagggaauuacaguuauguaauuagaugaaucucagaagagcuuuugagcuuuggacuuuuaacagacuguuagagacuaugggacuuuugauguuggacuaaauauauuuugcauuaugcuaugguuagguauagcacucacagacuuauguguuuaaacaagucuaugcgugccaaggaguggauuguguugguuugaauauggcucagggaauagcacuauuaggaaguguagccuuguuggaggaagcaugugucuuuuggugggcuuugagacuuuuccccuugcugccuggaugccagucuucugaaugcaaucagaaaaggacauagaauucucagcuccuuuuccagugcuaugccugccuagaugcugccaugcuuccugccuugaugauaauugacugaacuugaaccuguaagcaggccccaauuaaauguugucuuuuauaagaguugacuuggucauggugucucuucacagcaguggaaacccuaacuaagauaguaaguaauuagaguacauuacauacauauaugaauugucaaaacaacaauuaaucaauaaaauuaaaacaauauacuugguauuucuuuuggaaguaggcuaugaaaaauugucuuggaaguguuagagcuucugggaguuguugaccagugguagcguccuuaaccugugugcauggauuacuagguuuaauuccauagaccaaaaaaaaaaguuuagaaaauugucgcucuuuuagauauauuaaaaguuauucuuugaaugagagugccuaauuuaagauaccuucucugacaaaacugauuauauaaaauuacuguucuauaauagaaagaauacuguuuguauauagaauggcgugaagauuuagagagaugcuacuaagaaaccguagaaauuguauauaaguuuuuuuucuuuucucagacagaagagaccccaaucaucuuaaaagguugcagaaguaucauaguuuucaacgauuuuauggggagucauuagaaucagucacuucaaagaccaucacaacucaagguccuaagccaaagaaggauuguauuaaguccaagagcacaaaggcacauguauguuucugucaacauuuuauuauuauaaaaagcucuguuugcuauuucuuauugaauuguuauuugcucaucccauugauggguucuuuccauagaugucuucauuuauuacuuaugugcguguagugguuugaauucaaugucuccuacagucuaaauguuucuauaugucucucaguuggcaacacuguuggacaggcucagaaggcaguccuugcuagagaaagcauuucacuggaggcuggcuuugaguguuuauagauuugccccuuugaguugauucucugcuugcaguuuaagauguaaacuuucaacuucuagcuccagauguccugcuuugauucuuggaugcccugacaucauguguaggaacuaaaaaggggccaggggaaagaggcagggaggggaggauaacccacaucuggccagaguuccaccuauguucugggcaggcagacaugggagggcugccagacacuuucuacuuggccccuggugggcaucuaagccucugacccacucaacaggggguggacaagggguagccuccgaaaucaggggcccagggcaauacccugucaccccgggguuacgggaaagagggcuuagggagagugguuccuacacaggugagagucugugcagcaggccuugaugagaagacugucuaugguuuuuagagcuuuauuuuagaaaggcaagggaaaagagaaaagguaaaagagagagagagacuggccauggccaagaggagaguguuggggcaggucagcagcucacauguccggguucaaaccuggaaggcauuuuggaaucuggaagagggagccuaggcggguugagaaauaauggaaccaagacauacuagucugcucaagguucaaauuuuuaaugguggacaugcuuuauaaaagaagggggaaguccauucccgccaauucauccuuggagccuggaaacagcugcaggugaugacaugcagaauagggcauaaucuccagaauagcuuggggugggggugggguggggaguggggguggggccucucagcagguagcaguaucuugaagaggaacagaggcaauggcagaacaauagagugaucuagggaggaaggcuccacccuaaauaaucuccuuaguggcagcaaggucaaguucuggcuagccugcuucaggcuuaugggaggcuacaggagagaagggagaaaaggagagagagaagaaaggcuagagaauaagaaagagagaggaagagggagagagaggaagagagaggaaagaggagaggagaagacaaagagagaggagugugugagagagaauaguaagagagcaaggaggggacaaacagccauuuuuaugguaugcugcuaucuuuacuguugccagguaacuggggaggaguuuagccugaaggucagaagcuugggacauugccuaugugaugucuaaccauguuucuuuuuugggggcuggggaggggcgguaacuucgacaggagccagaguccaggagacaugagagaacuccuucaaucucauguaggugaauuaucaccaccggguccugggguucaacaucucagcucaacuggagaccagacugucuuugcauagcccaaugccccacaaucaugaauucuuauucuuaaauaaccucuuucaucuauaaguugucuugguccugguguuuuauugcagaauagaaaaguaacaaacauaaaaaguaaucauauuuauuaucauaccuucuuagaaagucugacauguacaaaaauuauuauauaugaucuucucuauguaaugauauauauguauuuagagaagcaaauagaauguuaggcaacuaaaggcuugauuuaaaaauuugcaauaacauuaagauauaguuuauuaucuaauaagaauuagaaugcuuuucauaaguauagcaaaaguaaacaugaaacauaugguuucuuuacuugacuuagauacauuuucugcaccuuuuccaaaguauuuaaauaauuacugcacugaccauguuuuucaggugcaaaguuaaagcuguuuauuuucuuuuucuauccagguaacauccccuuaauuuuuaccacuuaccauacuguucucauuuucuaucaauuuguauccaaagauccuaauugaggauaaaauacagggaaugaaaucucuauuuauuucuauacuaauauacuaguaucauguuugaaaauuauauguuaauauuuaugaucacauuagugggcaaguacagauuauuuuuuaaaacuugacuuauuaauuugaugacuuuaaaugaaaguauauuuuaaaaauuaaacucauuaguuuuuagugggcuccaaagcuuagaaggcacuuauuucauggaaacucuuuuagugccaguuguuuugauauauuguaaagagcaaaaucuuaacacauccaaugggagaggaauuaugauaggucaaccuuaucaaagucaguuaguguggcaaagucaucagaaguaaagccuuugaagagccuucacaaagaacacaaaacgauuuuuuuugcacauauuuauuggauauuuucuuuacauacauuucaaauuucaaaugcuauccugaaaguuuccuauacccucccccccccccccccccgccccgcuuuccuacccacccacuccagcuucuuggcccuggcauuccccuguacuggggcauauaaaguuugcaagaccaaggggccucuuuucccagugauggccgacuaggccaucuucugcuauauaugcagcuagagacacgagcuccgggggguacuggcuaguucauauuguuguuccaccuauaggguugcagaccacuucagcuccuugggugcuuucucuagcuucuccauugggggccuuguauuccaucuuauagaugacugugagcauccacuucuguauuugccaggcacuggcauagccucauaugagacagcuauaccagggucccuucaucaaaaacuugcugguguaugcaauagugucuggauaugguggcugauaauggguuggaucccuggguggguagucucuggauaguccauccuuucguuuuggcucuaaacuuuaucucuguaacuccuuuccuggguauuuuguucccuauucuaaggaggaacaaaguauccacccauuggucuucccacaaaaaauuuuuaaacuuuaauuucuggaggcuuauguuuuggagaaaaaccaacagcaaaugcuauuucuuugccagguauguaacuaaauaacaggcaggaaauugaagaguugcagcucucaaaggcagcuaccacuugggggauuaacaacagcucuuucauauaaucauuaaaauaaacacacaacauugcagugugucucuuguuaaugccaggggaaguccuuucucuuugaacugccucaaagaugcacugaggaauggugacuggcucauccuccuccccucccugcccugcccuggaucaugaaaagcaaggcuaauaaguuccugcuugccaucacugccucuuucucauggucagggcuuuuucaguuucauacucaaaucaaugaauccuuucucauucauuuaggaacaggaacaggaacaggaagaggaggaggaggaggaggaggaggaggaggaggaagaggaggaggaggaggaggaagaggaggaggaggaggaggaggagaagaagaagccuccuccuccuccuccuccuccuccuccuccuccuccuccuucuccucuuccuccucuucuuccucuuccggcucucucugguugucucccucuguguuaauaagcaggcaaauccuccuaacauucagcaaaaguagacugaaaguauaaauuucacuacucccaaucuuaaaaauuaaaugagucaucaaagauauuccacaccauuaguacuuuauagauauccucuaugaccaacaggguaaagagucuucccaucugagacaaagcgagcucuguguuugacaauauucuaagucuacccauuguuuucuguagaaaaacuauggcaaauggaccaguaggggacacuuacuuacaaaguuuaagugaugagaaaucucaaauauuauugaugggaauuaaauaguuugagaaggcaauagcuaaaugugacccuauuauaggugcauguuuaguuauuauucccaugacuaaccugaauaauggaguuuuugucagaauucuuuuacuaacaaaauucucuaauuugucuuucaaaaauuauuuuauuuauuauuucuguguguuuguaugaugaacgugggggccaugguauguauaugaaggucaaugggaggggaugcuaucauguacaugugaaaguugaugaagagagugucaugguguauauguggaaggcaaugggggagaugcugugguguauauguggaaggcaaugggggagaugcugugguguauauguggaaggcaauggggagaugcugugguguauauguggaagucaauggggagaugcugugguguauauguggaagucaauggggagaugcucugguauguauguggaagucaauggggagaugcugugguguauauguggaagucaauggggagaugcucugguguguauaugaaagucaguaggggaaacgcuauggugugcauauggacgucaaugggaagauucucugguguauagaugucaauguguguauguggagggcaaucaggagaugcuauaauguauauguggaaaucaauggggagugccaagauauguauauggaagucagaagaaagaucuguggaauccucuucuuucauauuuacauagacucuggggauugcacuccagcaucaggcuuucaagacaaucaucuuuacuugcugaaucaugacacuggcccucuaauuuguccauguaaagugaauuaaaaccaucuaauaaaccaaaauaaaaguggguccauacuguuuuuaaauuaguuaaaaacauuuauucagguaagucgaauuauaugugucuauguacuacgcacacacauauacacacauauacguacauacauguacacauauguguguauaugaucccucuccacuccucacuuucagccuucuucucuuauuuacucauuaaacauuaaggacuaaaugccuuuggcuuaggcaauccuggcaacuuugguucaauuuugugucaaggaucucagucuagagagaaagaauuaggcauguugguaaaccuugagauagaguaaaccuugagaaauuugauagaucauuggcacaggaauaccguauagguucagaaagagaucacaauagaaauaucauaaucaaguaggcaauaggagggugacuugauaggaaagguggcagaaagucccaaaaaauucuagagaguaaguaucacugcauagagacaugaaagaaucuuuucaaaguaucuuugauuguauuacauuuacucuuuuaucuuuaacauugccuagacauuuaaaaaguuaucugcagcaggucuuuauuuucacugaguugaauuauuaaguuuuuaaucaacagcaccuugauuaaaaacauauuuuuaugauuauucaaguauaggaugauagucaaaaucaucagugcauacuuaaaauguuauuuaauucaagaaauaucugucuggaauaguucuaucucaccaugagaugugugucuuuccguuugggcaggagaccaaggcugaaauaauuaaaagagaaaauaagaagagguuaauugcugaggaagaacaaaaagaagagcaaaaauggaaugcccugucauuuucuaucgaggaggaaaugagaaagaauguagacucaggaaugaagaaacuggaagaguuuuugaaaucauguaaaagucgcucaguaaaagcucagguugaaagaguuggguuacaggcuugcuugaaagccuggaaggaacauugccaggcugaagguauguggugcauaauccucuuggcuuacuuuggacuggagaguucauagagaugcgaugguggugcuuugucacccgugaacuagaaaucuguuuaguaagauguacaaaggauuauugccucuguaaucaaucagccaugaaaucuccaugaggaggccaacagcaaaggcauagagcauuccuaagcacaacuaacaauagguuuauacuaacugcugacugggcauuguuaacagauccaacagcagucaggcacagagaacccauuacucacuuuugaguucugaagcuuaaacauuuucuuucuagauagguugguguguauguuucccuacuaacuuaguuuccccuuaguggcugugauaaaauacuuugauaaaagcaacuuaauggagaaagauauuauccugucuaccagcuuaagaguauaggguucaucacgagguggcauguaucaaaguagugggaaguugaaucacuggucacaucauauucacaauuggaaggcagagagggauggauaaaugcauguuuacuucaguuccaauuuuauauagcccaagacuccuguaaaggacaugguuccaccggcaguuaggaugggguuuccugggucaauuaaucuaauaaagauaaucgcuuacaagcguguucagaggcccaucuuccaguugauccuagauucugaaagauuuacugucaacaccgguugguuguugacaguacagacuucaacugaucaccccuacucuacagacguuucccaaggucaaugaggauuccauguauguuccuuugcaaguucuguggauggaaaaaaaacacagaaagauuaggauaaaguagaauugaguagauagaguguguaaacugguuggagguauaugauuuaccuuagcauauauuuaucuuucucuccaaccaauacacugaaccaggauuugcaguuagauguaacuuaaaggauauaaugcuguauuucauuuaaaggucacuuguaggugcuguaaaauuaaagcaacguuccuucugggauuuccagguucuucugucuaguaacaagaaauugggcaggaccaaugguuauugguagaagcagagacaggcugcuaaggaacaaaaugcuuccaggagacauccgaaauucaguguucuuguucucaugcccagaguugugaccuuuuauaagucauuuagcuccugcuuacucuccauaugcacacugaaguuuuuagcuauuuuaguuauuugugugugugugugugugugugugugugugugugugugugugcaguggauuagcagaggggagaaacagaugcauaagaagauauuacauucucugaagcuggaauuccaggucacugugaggcuuccgacauuguugcugggaauccaucuguguaagagaggcagcuacucuuaccguggagccaucucuccagcucccuagcucuccuuaaauguacucuccaggccaccaaaaucuuuuacucagauaucauuaguuagaucuuaguuauaggccacuuuaaccagaagggguaccauuaaacauacuuucuacauacuuagguauguagaauuagcaauagcacagggacauaaguaagaaauuuuuggaacuacauguuagauaaacuaagaguaaaaacuagcauagauguccuuauuuuucauacaaccaaauuuuacuuauccuccacauccaguucuugaaauguauuuccauaaaugcuuccucggaaauccgacuccuaacaagugugguuucuaauguucaaugugagccaaucacauaucauauagucuuaaagugaaccugaugcuccuggaggguaugaccucuauuccauuuacuugguagacucuuguauaacagcuuucaguaugggauugguaauacuuguuaaguaggugagagugugcacuaacuaaaagaaaagcagaacgaggacagauguggugauaaugaaaagguuagcagaggggagaaacaaacaguguauacaaugcuagagaagugggcaggcuuucagagucugauaugauagcuggaagagauggaucacacugaaugaagggauucagggcuuacaucugggaugacugguggaguauaguaaggcuaaaugaauguugcuaagauuauaaacuuauacuuaaaaaucacacaaccauuuuucuugaacagagaagacauggcacuacgagagagaaaagacauacaauucacuauaaaguuuuacacaagacacauuuuaauuuugaacuguaagauucccaucuaguccuuucuauucuaaaauauucauuaauggugaguaagagaguaagugucaugaaguauagaagauugauaagcuaggugguugagcuucguuaauuaacauuuguuauuuugauggcuuuuauaacaacuuuauuauuuauauuuugcaccaaggugaaaccacgaaagacuuaagcauagcugucaauaugaugaagaggauccauuccuuguuggacaaacacucugaacuucugcaagaagcagaucagaaacucauagccagaugucuuaaguauuuaggguuuugugagcuagcaguuucuuuauauccaacucagguaacauuuugugauagcuucauuuuuacugaauuguuauuugcuauauacaaagcugccaaagaccaaccuucucuuggggagguguucugagagaaggggugucugggaguggaagaaacaaaagacuuuaagucuaagucaaauuguggguccaaguugguggccugugugcugcuggagaugacucccuagacagcucucuauagauagcucuuggcucuguagugugcucaagacuauugucucauccuguucugcucugcccuagacagcuuuucagacugcucucuaaguguuugguucugaucuagacagcuuuuucuugcuauuuuuaaaaaaaaucucucugcuuaagacugcuagcuuucugcuaguaaaaauucuaagagcucucuggauaacucguggguuuucugaccaaagucagaaaaaauucuaaaagagcuguguuugcacuucagacagccuucucugaauagcuucuugcaaauauucuaaaagagcuguguuugaucucuaaguaauucuugggauuuuuugaccaagguuggaaauacuauuagaaaaaauucugaagagccauggaaaacuuuaaaagagcuguauaugcucucuauagauuuucugacuaaaaucagaaaucuguuagaaaaaauucuugaagagcuguguucgcucuucagagaucuccagauagcucagcucucacuagagaaaaauucuaaaaaagaaaugcuauuguuuucuguuagcucaucucaggcaaaccaaaaguccagucuuuuauuuacauaucagcucagucauuuauuccagguuccauuuugaccaucccaugagucagcauucuaugauauuaggucccugauucucaggaagggacagcaagcacaaauauagacagugagauaguuaagugggagggaccauacccugauauuaucuuuucuacuacaucugggccuugaccuaauuuccuucugucccaggcugaucugaacucaggaaccugucugccuuuguaagcauaaacgaacaaaaacaaaacaagcagacaaaaaaacuuagcuggaugggaucuugccuugggauuaccacuccuuaaaucucuuuaucuccuuccuuaguaucuuucugauagcuggcucauagugcagcugccucuguucccuuaacucuaugaagguccucauauaauucauauugcauccuuacuguugguccugauccagggcugggaaccauuucauuccaccccuaccaagggcaugcuggacauggcacaaugcauccuucaaauacagucaucucuuuuagguuuauuuuuaauagaaaauagugucuuaauccaacugccaaaaguugaauuaaucaaguauuagaaauacuuuauacaacuugacugugcauacugaaugucagaugauuuaugcagacuuuaaaaaucaacccuaugcuuaauucuagcaaaacaacugauaucuauaaugguuguuuacuuauuuuaaauaugucagguuguagccauaaauauuagaguaaacauuugaaaaucuugaaaucuacuacuuuauuuguacuucagaaaagugguaaggucuucaugauguuuaaaagaugauuaaaaaaugguuuucauauagaagaauuaagucacaauaauuucaacuauuuaaauugcuuucaaaauaaucuuuuaaaacaauauaggaugcaucagauggcauaaaaaugaagaaaaagaauaaauauucaguugggauugggccggcucgguuccaacuacaauauaugggucauuauuuaauacgagaagaaagaaaagacccagaccccaggguccaagauuuuauuccugacacauggcagguaaaaauacgaauaaaaacaauuacauuuuguaaucauauaugacuccaggaguuucuuagcguuaacguuguuucucuuuguguguguuaguguguucauauuuguccuuaccaugaacugcauaauauugaguuacuuaauuucaaaauuauuuccuuuaaaauacuuugcuguuuaaaaggucuccuuuagacuaaauuuuuccauuuaaagacauuuaagaauucauuuauuauguagaccauuuccuuggugagguguugaaugaauccauauacauagauuaaaacuuagagauauccgugcugcuaucauuuuguaccagguuccagcuuuucucugucauuugaauuucauauguaaacaauguaaauauucacaaagaaguuuggguauuucaaacagugggaaacuguuuauauauuuacagauuacacauguuaccauucuagauauuuuucugacauaucuaucuaucuaucuaucuaucuaucuaucuaucuaucuaucuaucuaucuaucuaucuaucuaucucaugaauacugauggcuacaaaauuuggaagcaaccucuuuugcacacauugaacaagagcauuauuaacuuauacaaaugaaaauuuguagguucagucuuacuagguaagccacuuuucauuaauauaaugaaagacuugaggcagccuaguuuuaacauaaagauguuuguuugccuuccacuucugggguuucaacauggggcaaucaaauucucuccuacuuuccaugcacccccaaagucuuucuuuggcuuuuuuuuuuacacugaaguguggcuuguggggaggacuagauuuggggggugggcaggcugggauugggaguucuuuguaucgucuguacuucaccuaggguuuccuuccuuuugauuagucaucaucuugaugaauaaaaucguaggauguaaagauaaugccccauauaguccuguagagaggguaagaagcaaaaugaagaauuggugcucuuucugccugccauccauuuucuuaguguugugaagauagggauucgcuguuuccaacaacucuguuucucaaagacacucucuacuccuaacuauuaaaaacaaccauccuaauacuaacuuauucugacacuuuugaaugauuucucucuuuuauuauuauuuauucauuguacaaaagaacagguuucagagcgaucuuuuccuccauguauguuguauacuuuggccacauuucuaccaauauacacacgugauuuccugcccuucucaauggcucccuuuuuuucugaauagucuccuuucuuugugaaguuaauuuuaaucuuuauacuccauuucacacauaaaacccaucucucaacugcucagaaaacaaauaagucacaccaugugagagaaugaguaguccaucagauuuuccuuuuaaauuuucuacaugucugcagcuuucucuuagugagguucagaaaacuugcaguagaaaaagacugaccugccugucuugguaacauggcuuguuugauugacacaaaucaugcucuaaccccugcagcgagagcuccuggaugugguggauaacuaugagucugcaguaauuguugccccaacaucaucuggcaagacuuaugcuuccuacuauugcauggaaaaggugcugaaagagagcgaugaaggcgugguuguguauguugcaccaacaaagguagggauuggaugaauguaauguuuuucuucaugauagaacuuacucagaaauacuagacaugguuauaugguaggauugugugaaauaaaaaaaaagcaccaucccaugaaacaucagcuacucucaggcccugucggucucacugcugucauggcuugccccaaguagcaaccacccaucuagcugucacaaaucccauaaccaguuaaaaucaaaacucuagaggcaaugccaggcagugguggugcacgccuuuaaucccagcacuugggaagcagagacaggcagauuucugaguuagaggccagccuggucuacagagugaguuccaggacagccagggcuacacagugaaaccuugucucaaaacacucacacacacacacacacacacacacacacacacacacacacacacacacacacacacaaacaacaaaaaaaaauccccccaaacccaaaaacucuagaggcuuguaauuuaucaguuagauuuauaucaguaaacuguuaucccacaaaacggccacaaaaugaauuaagagccaacugacauugauauaaauugcccaucuagauuggacaaauuguccuguaauuauccaucccuuguaaauuauccauagcuaccugugacuauuuaaagccacacggaaucuggaucaucuuucucuuccucuaucucccuucuucucugucucuguacucucuguacucaucucuaaaauucucagcccgccuuccuuuuccauugcccaaucacaggcucucaccuuaucuugugcccacccucaccugcauauagacagcaauccacaugguagauccaguuccccuuacuuaguuucacuaguuaaaaauuaacauaaguaaugcacuuuaucaaggcauuuucauacauaguauuuugaggaucugacucuccucacugcuucucuugccuggaugucguccuccuugccugcucccauuugcuuucuuguagccuucaucccacuuuccugucacauauauucuguuaccuuauuucccuuucuugcuuuaugaucauuuccuuucucaugauuccuuuucuuguuagaggaccuauaucuacauauguaugcauauaauaauauacacauacacacacacauauauaaaaauauacauauaaguacacauacacauaacacauauacauacacacaguacacauacccauacauauacauauacucauacauacacuuuuacauaguauacauauacacaguacacauguacauauuuauauauacaguacaaauacacauacauaugcacauauacauauacacaguacacauauacacaauauacauucauauacguauauacacaguacacauacacauauauauauaaacacaguacacaauguauacacacaguacauauauacauacacacaguaugcauacacauauauauauauauacacacaguacauauacacaggauaaauaggacauaucuucucucauacuuggaucauaaauuuuauuuuauuuuauuuuauuuuauuuuauuuguuugguuuuucgagacaggguuucucuguguaguccuggcuauccuggaauucacucuguagaccaggcuggccucgaacucagaaaucccccugccucugccucccaagugcugggauuaaaggcaugaaccaccacugcccagcauaaauuuuauuuuuauguauauauuuguguauuuauguauguguacuguauauauauauauauauauauauauacauauauauauauguauauguaugugaacuguguguauguguauauguauguguauguguacuguguauauauguauguguaaauucauagcagaacaguuuuugauaucuccaucauucuauuaaaauuugcuuuacagauuacaaauaaaauuauacuuuauuugguaacuacuacaucauuucucugucaaucaggcucuuguuaaucaaguggcagcaacuguugaauaucguuaugccaaaaauaugccagcuggugaaucucuuugugguguuuuuaccagggauuaucgccaugaugcccucaacugucagguuugauaugcuauucaauaaacguguuaucaaauuauacaacaauauuuuaccuuuuugacuagaaaucuagcaucuuuaaaggcccgugaaaauaauuccuuugaauuugugagggacaaaacugauucagagaaaauacaauuuuguuacauuguuaaagaacgugauaaaucaaggucauuuucuguaaagaugcuuuugauuuaaaguuucagguuauagcucguucauuuacaaugagauucacaaugacccaaagagcuuuacaagcuacaaaacuuagugaacggcaauuucaaucacaauuaauuuucuuguuaaagacacuuauuuuagucaaaaauguuauguuugcaagcaaaccuagacuuaauaaaguuguaguuuucuuucugauugaauuuucacaucagagauuaggauaaaaugaaaaaaaaaagacauguuuuuagagugucauguaauaauguagugaugugcugccuggcuugccuuucaaagagacaucuuccaacacaaauccuguuacuguuagaugugaaggaaucaacaugguugaaauaaugacucuuauucuuacaucuuuuuacaacuauuuauuagugaaaacauuucuauguauucuuugauaccuucauacaugguugagauauaugaugauccacucacuuccauuuuccaucuccuucccuguacuccccccauccuuauccuuuccauuaucaugucuccuucccagaagccaugggcugccagagacuccucuacuggggugggaccuugugagcggguuccucauuccugcugggauuuugacugguuugauguucugcaggucuuguacagaugaucacagaggcugggagcucaugagaggaacuacccucccugguucagaagacagcaguucacuguacucuacacuuuccaccucugucucucgugguucccaauggggucaggaaagacaucaaucuaggugucccauuuagcacuagacacaguuggaaugcucauaaaugagaaucuacccuucacuuuggauauuugacuguuuugucucaugaaaauagaaguuucacaugcuucaaacuaauaaguauaucacaagucuaacaaaucuaacucuuagaaguagcaucagauuuuaguuauuagacgauacauucaggacucauaagcuuuaccucauguaacuuuagaacuacacauauacuaagagauaugucacaugguacuguuacuucuaggugcuuauaacuguuccugccugcuuugaaauucugcuacuagcuccucaucgccaaaauugggugaagaggaucagauauguuauauuugaugagguauguuugauaucacuucucagacuaaacuguaaugaaggucuuugcagcuuugggacaucugccccuuggaugaaguucagauugagaggccauuuucuuccaagcauuugcccucacugaaugacuguuugggcuugcuucuucuguugugauucaguaguguauauuggugugaggaauggguuuucauuggggcugcuguuguggagagauaggaauuaaucucucaugacacaaguuuccccugauagaaaaauccaacuugauuuccaaaagaaaguuguuuuuuucuuaacuuauaauguucuuuuaaaauuucacaucgugcgucccagucucacuuaucucccguucccucauaccuguccuccacccuuucaaccucccccuaaaaagagaaauaaaaucuugugcaagcuguagugugucacagugugguucacaguauaccuguuuguucacacuucuuagccugcugauguucauugcuaugaguuguugaucuuguuugaggccucuggcuucugcuacacuauuaauacuggacacucacuguugcuccucuuagauauucuguuguccuguauuguggagaucauguaguguuagaucaguaggaccagccccccuuuaugcaguaugguaguucauugaugcugggaugggccaacuuaaagcccuggaucuuggcuugagaggugucugagcuggucaguccaccagcucccccacacccacaccaucaguucuccugccuuaccccaguuggcccauccaguacuacagccagcaaggggcagauauagcauucuugcuccucccauggccucuuggcuggcuuauucagacccaugccaccagggccuguucuccugagugcugcagcagcagaaggcagggauggcucuccugcuuucaugacucaagggccagcuuuaggagaggcuuuugugcucuagaaagugaugcugauuacacaaacaaucuuguccaucaugaucucuaaagaaaacaaauggcucauucaaaguaugguuuuaaaagcaugacuuuaaaaagacauauuugaggaaauccagagagagggacuuauugcuagucuuaaagaaacaagauaaggaaguuuuuacuucagguuccaaaggagagucugaucaaaugggcuccuuuucaaggagugaaccuuuuuguacaguucuggcccaaaggagugaaccuuuuuguacaguucuggcccaggcagccugggaggggccaacagaaaacugaucucaacgaauuucuucauuuucugagcuguagccaauugaauauguuggucaaaucuagagauccagagaacaugggagucucauugaaauacuaucuaugguucaguuuccuugggcagaauaguggguaaaaugcaauguagacggcagcgucuucuaguccaucugugcauagacacuucaggcgucagagaaaaggagauucuuuuauuccuggauuuuaaacugaaaagaaaaaagaagcccauauuuagcuuaucuuuacuuuauuucagcagcaguaauaauaauaauaauaauaauaauaauaauccuggaaauuaaagucaagucuuggaaggaguccacuacugauccaaauccccaggcuuuuccuccauauuauaacaagcuguuuuuuagcuguuuuuuuauuuauucgaugacuugcuauguuuacuuuuaguuaaccugcauauuuugcauucugggggcuuuggauagucuuauuuaaauaauacaaagccguacauacauguagguaaaacacucauacacauacaaauuuaaaaguuucaauuacaaggcaaucuagaauaccuaguuuuagcuuggauuccaaacucuggaaugauauaacacugagcacuucaguuguuccaguucuauaagagggaaaccauuaaaggauuuagcaucucuucugccagagucagguaaaauuguuaaauauugcaaagcugaaaguuaauguuuagcagugugguaugccauuugaccaagacaaagucagaugggcagaagaaaaaaauauauauauauauauacacacauacagcucucuacacacacuggaaagcugccuaauugauaucuuucagguguaaaauguaacuucuuuaauuaagaucauguccgagaaucuuuuuuguaucuuacuuaauuugacuaugcauucauuuauucaguuuccuuugagaaaugccucccaagagccaggcauggugucaaugcuagaguaauacagauuugaagacccagauuaaaugagaaagauuaguuaaggcagggaaaacacaaaugcuuauaaacugacacuagugcuuacacugaaggucaagagugucaaucaaaauucagcaguggcagaaggcaggcuggaggaccacugggaauggaugcucggcaaaucuuuuaaaacuagugacucugagaugagcuucacagauuaagaggcugugguuacuuuuguuggcuuuuaauuuuccuggugagaauauuuuauacaggagacacagccaugugaaaucucugggguagaaagugugugccgaagaauggagaaaauagcugauguguacgggucucaguaagaugggaugagugacuuuggaugcagcuggaauggcagccauaagccaacugugccaagcauuauguaucccauuaaaugcuuaaauuuguucugcaaggaaugggaaaccguugacuagugacuugacuggauacagcuuaucuuugaagcauaucuuuuugucuguaaugucaagaauggcacuggucacuaaaguacugaaucguuauugagaugugguagaggcuugauuggcagugaacauggcaaggaauacauuggccuuguauuguagugaaagucaaauaagaagagucacaggugagugauuaaagguauuaaggaaaauguaaaugccaagauguccuacaucuggguuuuuuucaauaguuauuuaaacuuucaugguccauuaaaggugauagaagauaccuaugaccaguuuaagauuccauauguuauuuuaauuugccauucuuaaaaacuaacucaugaauugaaaacauuuuuuuucuuuuauagguccauugccuugguggagaaauuggagcggaaaucugggagcaucuccuuguuaugauccgaugucccuuuuuggcccuuucagcuaccauuagcaacccucagcaucucaccgaguaugaauuugguucccuuuuggauuucuuuugaaagucuaaauuucagacuuccuugauggguuuuacagucaccaaaauuucugguuaacuuacagcagucccugaauuuucaaguuauugucuguuuagcucuuucugacaaaucuuagcuacucuccaugaagaaauaucuagauccucuugggucagaucugcaguugaaugagaaguaucaugucauagcucaaaaacuaaaacaauagcuguauauucauuucccccuauccuuuuacuaggaaacaaaaaucagggugcuagaaugauacacucagccauaguuuccaagaucacaauuuuuuuugauauauucaggaagagagcaaagcuucauuaguugaaaaccacacaucuucuggucauuggaguggcuugaaugaugacaacguaucccauagcgucuccauguaucacauacuaaguagaauucauguagcaauuuaucuuaaaugccaucaguauuuguauuugauaacaauuuccauuguuauccuuagaugauaguacuuuuguuguucuauuaacuuuuaaacaagaaaggcaaggcacagaaauauuaaagauucaugcaggauucagaguuaauaguaaggcagcuagaauuuuauuucagguuaugugacucuagaaguaauuccauucuaugaaaguuuuaagacaaacaaaauuuucuuuuuaauuauuuaauuaaauaaauagcaauacauuuaauuauuuaauuucauguaacuuaugucuauuuucugcuuaaauaaugucugagcuaauuuuguguugaugugaccaaaggauaccuucagagaguuauauuuuuauuuagauuuaugguuuuagaaagauuucaacucaucauaguggggaagguggggguggggugggggaugauucaucccuggaagugggauugaagggaaagcuuguucaauggcaacaggcaagaagcagaggugaaagaguggcgaguauaaacuuugugauggcuaauauugauugucaccuacaaagucccauugcuaguggcugaucuaugcuaugcuguucccacauuuuaauggcuccauggaguucaacauaauaacaaagacuggggaccaagcacuuaagacaugaaccguaauggacauugcugauuaaaaucauaaauaaugucuguuuuccuuuaagguggcuucagucaguaaagcgguacuggaagcaaguagacaguaccauggaggaaagaacuguuuccaaaagaacugguaccucccguggcagcuauuacaaagaucaagcgcaagccagacaguccuacaaaguuagacuugguacgaaugcucuguguacuuguacaacggugcuuuuuuuuuuuuuuuuuuuuuuuuugguuuugcuacuugcuuucaaaauaaccuacucacugcauuucugaucauuuggaaaaucucaccuuccccccuccagugcucuauggagagagauacaaugaccuagagaaguauuuguguuccgugagacagggcgauguuugcuuugaucauuuucaccccugcgcugcacuaaccauagaucacguaaguaauaaccucugccacagcuguuccaaguaacaccacugucuggcuuauuaacuuauuagcuggcuuacaauacugugaggaauguuccugaugcuggaauccagaggaaacacuacaucuuggauuuucaaaggaacagcaauguucuaguuuccuuaauuucuugauguuaggaucaucaaagcuuaaaaacuacuaaauauuuuaacuugaugguuguguuguuugggggauguuauuucugccauuuuccaucuccccucuuuguuaacacuuaugucugcaugucucucuuaacuagcucacuucuguaccacuaaugaaguagugaguucaggcuuuaaccucuccugugcacacagcuuuguguggcuguggcuaauaugugagaacaugacuaaugcguaggaucuuaagccgggaacacguccauaacaaucacguuacaacucuuugguagggacuuugcagaauagagaccuugaaaacagugccaccugggcuacugagugguuagagggggaauacuuccuuaaauauguccugcauauacuucccuuucuuucuccguccacuuccuugacagguucauuuaaacucccauuggcccucaaaauaauaccuacuccuuuccuuccuuccaagaccugaaaaaugaaguauauuagauauauuuuuuuuaaauaaaaaauaaauacuuuuuuuuaaaauuagguauuucauucugauacuauauuuauggcuccuuaauuauaguucuagucuuuaaagggcuuuauuggacuuuuuaaaaaaggguaacuguacagcccuuaacaacuaaagucuucugagcuuguccuacauugcaugugcugaauguguuuugcuuggaaaccuccauguuauaacucauugguuccaaaugucaaaugcuacugccuugaccuugccgcuucuuuugaagcucuuaugaugcgaagccuuauuuauaauccuucugugacuuccucaacuguuauguaaacuucuucauagcacuuaauguuuauaugccaucaaaguccgaucuccccugaaccuucacacaugcgucuuugaguguucagaaauaaccacuugagggugaguuucaagugcuuagaguuacuagcaaacuguugugugaauaccauuguuaacuggcuauuuuuaaaggauagcugauuggaauuguguuuuucaaauauuucacccauuuccuuucuuuuaaagaucacaacaauugcaugauggagguacuacuucaguuuuuauuucacaaauaauggaauugagacauagacagcuaaguuacuacugcagcacugaguaaauggguaaaugcuucagaccggacugcgucucagacccguugguugacuccauguugaucugaaagauuugucuaccauguauaugaaugaguuagcaccaugugauagcauuuggcagucaguauguuggaaugacuuccuaaaccaaugaaaugaaugugaacaugggauuuucuuuaauaaagaaacccuuuuguuuccucccucucuuccucucuuccuuucccccuuuuguguacugguucugugcuugcuccaagugccuuugcucuccucgguuucuauucauggagugugcuaugacccuaagugacuuuugaaaggucacgcugcuauacaguagcaaggauacagaguaaaugcuaggcuuggguauugcuaaaugaauuuuaacaaccacuggcauggagugugcuuguguaggccauuuccuaaagaagaauagaagugagcagaacuuccaaaugaguaaauaauucuaaacauuguuuaguauacucagacuaaauagaagagcuaagugauuuauggaugcccucaaacuugaccaauuuuagcaacauaaaaaaagaaucaucaucuaaguagccauuuccuuuauggcuaugucagagaaacgauucccaaagggccacgaugggcaagugcaaacaagcuggccuuaacccaacagaagcaagggaucaccagugaggauugcccucagccauauaugucuuguuucuggcaaacuccagccuuguuugaccuuugccaucaauugucaugccguucaggcacagcugcugcugucuggagggcugucagccccgggaaacacuugaaagaauuguuaucucuugcucaguguggauugauuguuaaugugaccuguggagguagagacacuugcauuugcaaaauaaccuuauaccauggugacucagugacucagugaugcuucucuuccuuuucugccagaauaguucagcuuuuagcaguuugccgguuuauagugggaaacaacuagauugaaucccaucuuggaccacagaauuguuauuccuugaaaguuaugaaguaugaauuuauuaauuaaaaaaacacauugacuuuaaucccagcacucgggaggcacaggcagguggauuucugaguuugaggccagccuggucuacaaggugaguuccaggacagccagggcuacacagagaaacccugccuugaaaaaccaaaaccaaaccaaaacaaaacaaagcauauugauggauuauuuaccaccaguggaaugccagacauuuggcuaagacucauaucuguuaucuaauuuauuuugcacacagacagaauuaaucauuauauuuuagaaacaaggaaacugaauguguuuaaagggggcaaagacuuaagcaaucccaagcccgugaccaaacagaagauuuaugcuauagaauuuguggggauucuuggacuuguuuuuguuucauuauaguuuggcuggaaaaaaaauacucucaagugagaauuaaaaagugaacacaaggcuaaugaugggaaauggggcagagauguguuucugcacugaagaagaccucacagacgaucugacaucauuucccagcacccacauugggugacucacaagagcuuaaacaggggaucugugugggacagaaucucccacacauacacguaauuaaaaaaaaauuccuuuaaaaaauaauaugugcaagcagucuucaauuuuccacauuuuaauaugcaaacuaaccauuucuagccaauguuuauauccuauagauaaaauaaaauauuaauaaguuugauuuuauuuuaaucguagauugaaaaguauggauuuccuucugaucuugcccuuucaccccgagaaagcauacagcuguaugacacuaugugccaggucuggaagaguuggccccaggcccagguagagaaucgucauaguggugcugugguagaacccaccauugcuguucugaaacacagugucaccacuugcauuuggcgggggcacccucuuagaggcaaaggggagggcacaugggauggggguuucaggggagagagugggaagggggacaacauuucaaauguaaacaaauaaaauaaccaauaguaaaagacuagcagauauuucccaaaaagaacuaucuucucacuuuaaugaucuagaaaugguguuuuaugucaaugccugaaaaugucccuucuuucuguagacacugugguuucuaggucuccuuucccacacugggcuccuggcucucagauuuguuuccucuccauuguucuguguccuaagcauuauuugcuuucuucagaggccugccugcucuaucuguuccuauaugauuuuaaauaccaaaaggcauggggaagaaugagaauucuaaacauuucuaaccguaaacaucuccagccacaagagccuaucaaacugucaaugaaaaauauaauugagaaauaucuuuaguuuuucaugcauuauuuguguggucuuccuuuuccagagccuauguccagagaacuucacucaauuuaagaauaaaauagucauuaagaaguuggaugcuagaaaauaugaagagagcuuaaaggaagaauucacgaauuggguuaaaaaugggaacgaggaggagguaauuucacacagcauucuguauuguuuuguugaguuguaucauucaaucaauaauaccauuuuuuuccucuccaguuuucaauuuuuaucauagauuuuaaagcucaacuugauguguagugauucugagcuagaauuaaaaaaaaaaaaaaaagaaagaaauuugacuuuuaaacuucuucucuucagugucuccuaaaacauaggcaagaggcuaccaguuccucguggauuugaugacagaccaggaagaacacagggcucauguuuggaauuaauugauuuugggggguggugguguggggaacagcauagaaaugcaacucaagcagcagaaacaaauguuuacuuuucuuuuuuaguuuuuguuuuuuuuuuuuuuuuuuuuuuuuuuuuuuuuuuugguuugguuugguuuuuuguuuuguuucguuuuuugguuugaagauuuucagauccacucccaaauccucacccuccaauuucucccauaucccucuaccaucuucuccuucuaauuuuguaggcuccccaucaaugcugccagugugggugugguugugggguuaucugcugggccgccaauucaugaagagcgcugccauuuucccuccuacagcagccaucccaucccguggcagcagcuccccagccuuugggagccuuugggagcuuuugggagccuuuccucgcucaggcugaagucugaaggacuugauuuuacaagcuuucccccccccagguauccacaggggcuuugaguucauguuuucagugucccugucauaucuagagacgcuuuuuuucaacaguccuugggguuuucuucuccaugcuuuuaaauuuauuuuuaauuguaagagcuauuuaaguauucaaaucuuacuacaugcuuacacauuuauuuagauuaaacuaauaaacuuauagucucauuuugucaagaaaaauugugauuccugauuuuuauuuuuaggaaucacuuuccuaauuuugcaacucuuuaauaacaguacuuuagguugugcugacccguaaccauaaaauuauuuuguugcugcuucauaacuguaauuucgcuacuguagugaauuguaauguaaacaccugauaaguacguacacuaauuugaaaccccaaaggguugugacccucagguugagaacugcugguaugcauuauauuuuucuugugugauuucccccucccccacuuuguacuuugauuuguuuuuauuucauuuggaaacauaauauaguuauguaguaucaccccucuuuguuuaucuugucacuccaaaccucuuagucagguuugagucuuauuuucuaugcagcaugggaagggcuccuuucuccuguugucguggaaacagcaucagugacugagccguccuuuacugcuggacucacacugucucagacauuuacagauguguacguagaguacacaggcagauuguuaucaaguguguggugugugugcauccuucuugugcuuaccauccguaguccuguggcauacucucauaggacugcacuuuaaaggauggcagcugugaaaggauuugcgucagaaugcccuuuccuuucacugcugugaagaguuuaguacacaugcuugccguucacucccacaggccaggauggugcugaagaaacugagcccugauuaccaugagcacucagggaggaugcuggauuucuuuccaugucuuguugagaagcuaaggaaaauggagaaguugccugcacuauucuuuuuguaaguuauuuaacuuugugagguaauuagugucaggccguuccuuuaagguagaguuuaugcuaccuuuuaugcuuugauccaguguuuauuauucuucagugcucguucauuugucaagaucuuaugacuuauuuaaagucauacaauuuucuaauucaacucuuuguuguucugcuucuguuuguuuaagaaaggaucuuggugucugccccaggcugucuuccggccucagccuccuuugugcugggauuaagauagguauccacccuuacgcccaguuuucguuacaugcuuaagaauauuuuuagugcccuauuaaauuuuucuuuauuaguuuugagucucauucucauuuuuauuauugcuauaaacuaucauuuuuguuucuuuuaggucuuacuaguaauuuuaaauacagaucuugguguuuugcagaacccauugaacauauccauuaauguugcuuucccacacagaauuuaaauuuuaauaacaugcuauaauauauauguaaaauauuuucguucuaaaaacucauuauaaauagaaauuugaccuagaaucagugauaucuugccaaauucagauuauauagaaugcaauaguuuaaaauugaacauucuaguuuaauggguccaguucugauaaaauguaaugugauaauuuaguuaguggauaaaaguauguagcuugaagcaaacagcaaauacuuuauuuacugcggauaaguauaauuuacucuaacaccaugggaucaucaaauaaauaaaacuauaggauuauaaaauauaaugcuuauuaacaugugcugaaacauaguaaugaaucauaauuaggugauagauacucaaaauaauggugauaguagaugcaggguucuaugugauuuauaucuaucuaucuaucuaucuaauuaucuaucuaucuaucuaucuaucuaucuaucuaucuaucuaugagauuuaauugcagcaaaacuguccuuuuuguuuuuguauguagaacaagagaaacacucuuucugugauaagaauaauucauacagauuaucuauuugcuuccaagcacagcuauggauguuaagagcagagacauucuuugucucugagauauguuugcaagcuuaacuauagcguugaagucagaaaauaagucuuuacuaucuauauacucauuugcauaugaacauauauauuuuccccuguucuuuugagacaauuaaguuggcuaaaggugaaaagcauauguacuaauuuagaguaaauaguuuauggugggagcuucaugaggaaauaaugacccaaugacguuauaaauagacacuuaaccuggaacugaacagaacgaguuauaaaucugugacauaguaaguaggcauaugccaucgaguuauuggagaggagaaauggcugggaagaccggcuugugcagaugucuuuuguucccaacuucucgccuuucuaguuuuaagggugguauguucugaacugugaguuccugaggcaucugggaaggguaauauuaacaaaauaugauagucagaguucuacuuauagagcucuaccuuggaaccucuuaaaugaauaguggguuaucuguaagacaaacugugaaaauccuuucuuacauguugugacuucaucuuuagcagcaccaggucauaaaaagaucaaagauugcucugggaccaagccuuaacugucagagcuugcuuacuacuuauuaauaguacuauuacuauuaguaguaauaguaauagccccaacuuucugugcccugaauggauaaguguguagaacauggucagagguuggaaauguugauauguuucuaacgucaugcauugcaaggcuagcccuaagcaaaaauucuacuuuucuuuccuuuagcuaugucauugauugacaaccacuuaaugacuaugugaucauauauaggauuuugaugagacuaaaauaaaaaagucaugaauguguaauccaaugcuauaaaauauuaauugcuaaugugcaauuucaagaacacuuucaauaucuguaguuuagagagacuuagacuuaggaggcacagcuauuuccaagagauguagauuuuuaaaaaaagagucacacucugauggaaaugauuguauuuaacaaauuaugauagauucuuccucaagaacuugcacaucauauagucagaaacaugaauuaggagacacacucuguuauauaagucuguguguacuucuggggggcccuuuaaucucuuuauauccccauuucuuaccuguaguacagggauaauggaguugguauaaugccugguguaauuguugauguaucaaaugauguaucaagucacuuagaauugcaccugagagcaacaacuacacuauauuuacuucucuuauuauuguguuauugauguagcaguggaacauugguugccauuucuuguagugacaaucauuucuuaguucugacuucaucagaauggcuuauuuuaucuaucuaucuaucuaucuaucuaucuaucaucuaucuaucuaucuaucuaucuaucuaucuaucuaucuauuuaucuaucuaucuugagacacugauugggaaaccugcacauacuagaaaaccauuuggucacugagcaauagccucagcugucauuuuuccuuuuuauugucuuaagaacaccucaccaacguacccuggcugguuuaaacccauucuguauauuaggcuaaccuuaaauuggugauuauccugccuuagacucccuacuagcuggaauuauagaaaagccuguggcaauauguccaauuucacauuuuuuaaauacuguuuuuguaaaguuuuacuuuuuaaagaaaaucuauugucucaagcuuuaaguuuaaacuuuauuauaaagucccuaacuguuauuuguucaaauauaauauagugguguuucccaguagguacuucugacauagcuuuuggcuccuagccagagcuguguaauaaaaugauuuuuccucagccugcuugucaucaaaagcucuauauuccagauauugugaaacacaugugaugcaaacuuaagguguguuuguuuucacucucucuggagacagaauucaaccagcccugcugguugcucagaucugagaaaucuaaguuaugaagauccagaguaggucacuaggcugagccccaggguuccaaguaagcuacagcuuuauagccucaauauuuauauuuucaaagauuauaaaagcgaggacuaggagacauucuggauuuuaaaagccaugaccucuggggcuuucuagaucaugugacagugagaaauuauagcucuuuccacuuugccaauugaacaacucuuugguugccuaaaaaucuuucaucuuucaggaaggugugcagaagcuuaugcgcauuuuucucuucuguuuacaaaucacuguuucucuugugccugggcaugucugcccugaagaguuuuaguaagauuauacuacagugucaccugaguacagaacugugagaaacucaaaauuacacuucauuacaaguuagaaguauggggauugacccagaguucagaaugaaagucauaaaggugggcuucagaagcccuggagggauaugccacugcugugguuuggguagaaguguuugccauuagcauguguuuagacauuuggugcuggcuggcagaggugucgacaguuguggaaaguuugggagaugccaccuuacucagggacugugaugucaccauuuagacuucucaggucagagcuacacaucaaacaaagugcugaagauaagauucguccagaucuguaagccuaacugggugcuuuaguuacuuuucuguugccgugaagagacaccauaaccaagacaacuugucgaaagaaaagaguucugugagacucacaguugcaacaaguuauaguccguggugguggugagcaacauggcaaaagguaguagguagccauaauacuuuagcaguaggugagagauuaucuuucaaaaccucaaaaccugaccccauugacauaccuccuccaaggauauaccuccuaguccuucccaaauaguuucacuaacugcaaauuaaauuuucagaugcaugagaugaugggggccagucucauucaaauuacuauacuguguccugaggucaagccuagaaguuuaacacccagaacuauuuucuguuuuucucugcuuccugauuauagaaacaaugugacuagccaccucuuacuuuugcugccauguuuacuccucucccuauauaaggagguguguguccuuucaaacuguaaaucaguuuaaacacuucuguaauugcuuccugucaggcauuugcucacaaccaugaggaauguaacacacaaccagaacagagagacugaaucuuauuauauuuuuaauacauguucauaugcuuccagauuuaaguuaaauauuguagaagaaugugcugaaaaugcuuucgaauuucuggagaaaaaacaggaagaaaaaagaccucccaaagcugacaaagaagcucguaccacggcuaacaaacuucggaaaguuaaaaaaucucuggagaaacaaaagacaguguaaguauuucacuaagcaacuuggcuacauguggguuuguacaauccaaauguccuaggaggaagcaugcauugaaaaugcucuauaacgaaguucuacuugcugcuuagacuguucuuuuuaaauuucagagggagaacuggguaaagacaagugaccaccauuacauacuccuuagcugcguagaucauuuaaauuuaugauuguuaggaagcagguccagauucugucagucuuuguguauugcagaacuugacaggaucaucccacguuguccagggacugugucuugauucaugaccuacuauugcagggcgagccauaggcuguguuugggacuggauuacaaucccaauuucacacuuggaagcucauugcucucagcauguaguucugccaacucuauggcaguaauaauaauaauaguaauaauaauaauaaucucuuuauguuucucuccuccuuccgugauugugugggcugaaaacucaucauauuuuccccaggucuuuaucaacucgggagucuccagcugaauuccucuccuuccacuguuaaaugcuuauaaacuuggaaacugguuagauuaccgugugugcugggcauucucuuuguugcccagaggauggaggcuaacuucuccuguuggacauccagcauguuucauuugugcuuuuacuauuccuacucauuuuccauaacuuccuuuuaggagaucuauggcucuuuucacuucaguuacuccuccaccuuuuucuuuucaugagccccacuagcuguuucuucaguaccuucacucucguugcuuccagaguguauacucauaaauuuguuaucgauucucugaaucuuguacugauuccucagcuuagauuuauacuuucuugccugccuuacuuuguuuaguuaggagauaaauuuauucuguauuuuuucaaaauauccacagugagcaucucuuaugugaaaaauccaaaauccaaaauuguuuaaaaucugcagcucugugugcucaugugacacucuauauagaaauuuuuacuugauaaaauguuguuuuauguauaaauuuauuucacacacacacacacaaaauauuugccuucagucuacauguaggugguaguguauauaaaaccuaaauaaaauuucuuauuugacuugagcaccaucccgagguaugcuguuauuuauuggccaguaauccaaaauucaaaaacagaaauuuaguucccaagcacuuuggauaaggaacacuaagucuuacuaguuucucuaaauucugaguuuuuuuuuuuuuuuuuugcaacaagagacauuuauuuuguucuuugcgucuccguagccuguaagaugauuauuguuccaaggauuuuuuuuuucucuuuaagacagaguuucucugugcaguccugguuauccuggaacucacucuguagaccaugcuggccuugaacucagaaaucugccugccucugcuucccgagugcugggauuauagacaugcaccaccacugcccggcuguuccaaggauuuuuaccuuaacacuauuuuaaaaagauuaaugaugaugaugacaaugauugggcaauuuaugcaugaguguuguauuuagaucauuuauccccauauguuuucuccucuggcuccuuucuuguuccuucucucucaaauucaugaucucuucuuuuuuaauuagucaaauacacacagauaugaagauauccuaucaguuuuauuuagugugguuauauguauuuaccuuagaaggcuacuacugagucucccucuuuucucagaaaauuaauugccuagaacuccuuaucuaggugcgguuccuuaugagauuuuccucauuuauguuucuuaucaacuaguauuuucauuugugcauuugggugaccauauuguuaaguuucauggaugcagauuccuuauuguauauagaaggcccuaucugguagcagauguccuguuccucugacuuuuacaaucuguaugccccauuuucucaguguuccuugagucuuagguguaggaguuguaguguagauguauaaaauggggguaugcaucccauuguuaguuguucuuugcauuuuaaccagcugaugauuucugcuauauaggcccugucuacugcaaaaagaaguuucuuuggugagggugaaagcuauacuuaucugugcauguaaggauaagaauuucaaagacgguuggugguuaguuauacugguuuagaaagucuuuucccugaccuguaaauucaucagccacauucacuaagcuuacagaaccagcuaugaaucuccccaguauugaguauguccuuaagucuaauuaguuguugcuaauuaucucaugaaguuaacaggcacggcagcaucacuggggauguauugccaugcuacuguuguaguuuguaugcuuugcagcuggguaagucucuucaucgauuuguucccuuggcagcuuguagagcaccuucaggugcuaugaaagcuagugccuauggaggucuagagauauuuucaagugaggagcuccgauucacuuugaaguugaaacaaacuuuuagagcaucucugauucaaauauugcaaauucuagaguaaguuagaauuugcuguggauccuuuugugcauaaugccucugcauguuucacugguuucccagugguguauuuauuguaaguagugaacucccaggagaauaugugcaggaaguauaagauuucuugguaaaugauccuuuuuaggauagcucgguuucagggauuuaagagcugugugucaggguggguuagugagcagcaacucaagcugucaacaugaaagguguuugauaucuucaacauucucacuguaaggaggaugaguagccugaugcagacccuaugcauuggaaaauaccauucugauucuucucuaucugcauccauuucugacacggaggggaacuacuaaagaaacaugcacaccaacagcucacucuuuugggaucauguuuguugaucugaaacgacacuuugccuauuuucucuagcaguuuuuauuaacaguuaacuuauuuaauaguuuaaaaauagaguuagauagcaaccuacauuucuccguaagcacuguaugagauguucugacaacauagggcuggguccuuaaauagucaugccauuucccuccuuguucaaugauagcuggaggugguguauucuggauguaugauauauaccacucugugguagaauacaaguaacuucaucuucuuauguucagaaaugucuuauuuacauauuuaagagacaaagauugugaaggaaguauacaugacccuagcgaauguaaacaccuggugcauucagggguccugggggauacgauuacuuaagggccauggccagauuuauggagguguauccuaaguuuuauucccucguagcacaugcugagaagggcuguacaugccuuaaugaagacgugugcucaaaagcaagccugaacuuggucccuuugagaccuccagagccaucccaucccaucccaucccaucccaucccaucccaucccaucccaucccaucccaucccaucugauugcuaugcuucacagcaggcagucucucagaagagcuuucauuaauggaggcaaauucucuagaggauaguacaucuaagcaccuuuagugaacaugcagagcagcuccaguguccaccucaaggaggcagaagaauagccugagcuggcaaagcaaacuggaaagaacacauuaccuccaacuugagagucagaaagguugaaggagagaaaaugauuaucaugcuagcaagaugaaggaagggucguuuggagaaagggaaugaguggaggcaaaaagaaaaucacaucuauaauggauuuaucuugagggauccauuauggagggauggucuacagagacugacaagcaagcacacugugggcagggcaccgagucaugauaauauaaaugcacgaaacagugacucugguccauaagcaggacuuaguuuacauugggcuuccuguugugguuggauacaaauauugauuuccuaaagcuguauuuuuuuucuaaagagaugaaaagggccagaaaucuuccagaagauuggaugaaagcguuaugcaugaaacagaacacaauuaccuccugcagacucuggagaagaaucuggagauucccaaggacugcacauaugcuaaucagaaggcaauagaugaucaggucaguuccuagaagggaccacuccuccuggagaguacucuggucaucagagaagccucuccaggcagccagugguggccacauuguacauuguacagacaguacauuuugcuacacacagcucucauggaccuuguaaucuacccucaggaaggauaggcuuagaauuuguagguugauuuuugucuuguugacacacucuuggguucaaaaccaugucugcuuuuguguuaggucauguauagaagucuguauauuguagucagaauucuagacuucagugucauauacccauuugaaaacuuggauaccuguagagcaauauauuuagaaccugacagcauuucuuaaaauuggagucuuucuaaaauuuucaccaaagugucacuaagauaucugaaauugguuugccccaucauuguuagacuuuuugcccuuugaacuuguuuauaaaugacauauuugacaauacaaccaguuucaacauacacacuuacacauacauuuacguguguucauuguaucaugaaucauuuuuuuuugucagcuucauaaucuguuucaugaccaaguauuuauacuauuguuucaauugauccuugacauucugucuuauaaggagcuauguaaucaaaauagcuagguacuagccuuuuacuuuuggagacuuaagucuucucucuagauauugaucuuuauauauaacacuggacacaacuggauuuccccuugggacacagguaauuuuuaaaaaaauauuuauuuauguauuuauuuauuugcuuuacaucccacucaucacccccucuccauuaccuccuccuacaauucuuucccuguccccucuccucugagcaggugggggccuccauggguauccuccuaccuuggcacaucaaauaucuggaagccuaggugcauccucucccacugaggccaaacaagacagcccagcuagaaaaacauaucccauauauaggcaacagauuuuaggaauucaacccccccaccccccacauguucaggacccacaugaagaccaaccugcauaucugcuacauaugcacaaagaaaccuaaguuuagcccauguauguuuuuugguuggugguucagacucugagagccccaacggucuaggcuaguugacucuguuggucuuucuguggaguuguaucccuuuuggggccugcaauccuuccucuuauucuucuauaagaguccccaagcucuauccacuguuuggcugugagugucuguaucugucugagucagcugcuguggaaccucucagaggccugccaugcuagcugucugucugcaagcauaacagagcaucauuaauagugucagggauuggugcuugagacaugguuauuuaaaaaagucaucaguaugucguuuucaaugggaaggagccauuucguggccuuacacuacaaagguuuugcuuuacuuucugggggaaguuuaguaaaauuccauaggcacuugauuuuguucaggugggagugggccccucuuauaccucccuugaggcuugacuacuccuuuggcagaucuucaguccgagaacugaggugcaacuggguuggucuaugucaaggggaguggaaguuuuuuuuaaauggugauuguugcuuccauaaaauguuguuauuguuauauagaagaaaggccuaauuauuauguauuauaucuacuguuuucguuaaacauugaauugcuauagaaccugauaagcaauguucuaaaucuuugguuucuuuuaguuauugcagaggguguuucaccgggugagauucgaacguaaaggugaaacacugaagagguuggcagaaaggggcauuggcuaccaccacaguuccaugagugccaaagaaaagcaguuggucgaaauucucuucaggaaaggauucaucagggugggucaauuuuucauuguaaaaauugagacugugaauauauaaagccacucuuuuauauauauauauauuucccucauguagcuaugucucaugggcuguagauuugguuuccuggaugugacaguuuugcauaugcccuuugacauuuaauuggggaaauacucuaugcuggucucagcugugugucuuacuuuuuaguucucauauggaagguugguugaugugguuuugcuacagauauucucuccaagauuuggaggggauuauaauauucaaguuuggggcagaucuuuuucuacugugguagcugaaagaagcacaugguuaucuaucugccuccucgggggcuucugguuaucucagcagagcuugcagaugugucaguagcuacugaagcuuuuccuguuacugauggggaacaagaggaagauugcaaugaauaacuuucaguccacauccuugccaucuuugucuaguacauccuaggaaggcucaugacggugauccagacaaguauacagaaggcccuuagaucauuacuaacucaaucugaaucuugacuaauauuuaaacacugacccugacgacuaaacauuauccacuuugacuuuugugugccauaaaguaaaugaaggggaggauggaaagaagagagagaaaaacagaaagagaccuggccaaaauacuacugaucaguaauuucuuagucacuauaaaguuaugaguaacagauacuagggaaauaugauagcuucaucagagcgcacauuuucagaagguacauaaggcuguuccuuuucuauauguaaaguuucuacucuuucaaaguuugugcuuguuaaagggauuugaaaaauaaauauuuaacaauuagcauguuuuauuuugacauauguauaagccucugugaaauguaauuauuaaaaaacaagccacacuauugcuggcuuggcaccagccaguggucucaguauguugccugagaccacuuguucccccuugucaaugcuggcacacuccuaaauuucugaccuagcugggggaacauucucccaacucacacaguuaccuuucuccuugagcucaguugagucgccagaaaauggaaaacaccagacaaucuuaguuuagaaucaacagauagcacauuugcuggacauggaaucuaucacccuaaacucaugaacuagucuauguuagaaaucuucuggugauggauucugcaaccagaucuaagaguuccugguauacauggugccuucuauggcucccaccucgcaguccaaaaaaguucauuucuccuuguguuccuucuuccucucucgggccggaaggacugccuccuccugauccagugauuggcuucuugucgucuuuauuauccaauuaauuagggggaaauucugcuacaagccucaguuacaaaacaauuagaaaacaucaauuuauaaccauaaacaucaucagaaaacaguacaaacagccaccaguauaaggagacagcaaaagucaccauauguuaacuacaucaggaaaaaaaaaugagcaagaaguuagaugauaugaauaaacuucacacucucaucuaguucuuauuagugaucaugcaaucuaacggcagaaaaagugaacguacuuuauuguuauaucauuucucaaugaacuuugguugaucaaauauuuaccaggaaguagccuuauaaaagauuuauugcccucucacagagaaauuucucuucucauauuuuacauacaauguuuccugcaguacuuaucccaugcuggauguucuuugugacucuggauauacaacuaugaauaaugcuugcacuuuuauauuugaaagguaaacugagguacuaaacagagagguagauggggaugggagaagauaauuauuuuagaugugcccagaaguuucucugugacauuugugucacacaauuaagguguguguguguguguguguguguguguguguguaugccccaaccugcagggauaaucagcagggacccagggcaagggaaacagagugggagggacaagaaucaugaagaaugagagcaagucaguuuccugaucaagcucugaaaaacuuuauucaggaguggcaauauaagaaagaaaagaggaggugccaagggaggggggaagagcccagggauucucugaaggucaggcaaucuucagcaucuggaaccuacggacucaguguccucucuauccacaaacauucuuacuguuacgaccacaaacguucucucaggauuguuuauauaagcuagaaaauuuccacaaagccaugacugaggccauggcucccagcaucuccucccuuuuaauuauuuucacuaaggccccauggaucuggggugauuaauagucaucucauccuuggaugaguggauguuaaccagcagggggagcauugaccugauuccucucaugaguuccaucaauacccacagucauaccucuuuguauuuuguggggaggggaggcagaaccuuagaaaaauccuuaggauuagguugaaaacagauaccaaccuccuuacaaaucagguuugucucacggggaauucagugaugauccaugugagaccguccccuguggugcuuagccuugcaacccaugcugaugcccauaguggauucauauuaucaaaaaccaguaugcacaggucugaaucguaugcaguuccugaaagagaauuaucaaccucagguucagcaaggccucugucagccaaaucaagucuauaauaaugaauuugcaaaggucuugaugucauggaaucaaucugcuguuuuauaaaaccagaaauuuguuuuaaaaaaauaaaaggccccaaaguuauuaauaauaaaaugcuuuuuaaagguccaaggaggggcaucaagagggugaacauagaggacuuccagcaauuagcagcagcagcugaaaacuguguucucuggagcuccaaauuaagugaauguaacuguuguauuggaguucccacucauucagagagaaacuuauuccucuuucagaaagagacaggcgccaccuuucucagugguccgcaaaucaagugcuagucaauucucuaaggcaacuugggugagggaaguuaauugucucuguaaagaagcuaaugauucaauggaggcuuccaccgccaauggguuaaaguuccuccagccaaacaggcagccagagguuaccaaggaggcgcuggccacuacaggaaggaaaacagcuugcuuuauccuaauauccgggggacuauuccagcucaaauacuuggagggaguuagcaaggucaacugaggaacuagggucacaggaagacacagcaauucuuuauuuauguuuuuggaaagaguuuuaguaaggguaccacuacacuacaccaaauaaauaaauaaauaaauaaauaaauaaacaaacaaacaaacaaauaaauaagaacccucaggggcaaucagauccugacuaggugagcuagucugauugcacaaauuaucacugggacuaguauagcaaaauuuaaauugcuguuguucagggaucaauaacaaggauaugucagaaauugaggaaaaggucuuaggacuggcaccagacauauuaaaagggaugagauaagggauagcugucaauggagggcauccuaaugcugcacaaaggaagcaggcugagacauuuucuaauucaguaauacuggcaaguaucaggcccucucuuaagagagauagccagggaaaaagggugauguguuuacaauguggagagagcucagcuucuuuucuuuauucuguauuauuguuguucuaagaagcucauaauuuuuuucuugcaaaacuagggcagaaguuccuguagcugcaccucccacaaaagcauauggagacuuuaguuuuaaaucuuaaguaacuaauuucccuguugauagugaaauuuccuccagcaggcauauccaucaacuuaguguuguuuaccauuaccacaacuucuaggccuucccauacuguuggauguaauaaagggugaaucagggacaaaggcccaauacaacuucuuuaucaucagugucaagacacucucuacaaacucaugaucagcaucauucuuugucccagcaucagcaugucucauuaaccacucuggccgcuagcaugcuccuucagcaucuugcagaaaaaacacagacuugcccucuucccacacacagagaguuccuuuacauugaaauuuuaaaaauuuuugugguguacagggauuugauuaccccuuuuuugguauucaaaagcuaauuuuucagaaugcaaugcacacaugcaacaauuccuugucccauggauuacaaggaauuccaguuuuauguucaauuccaaauuccuuacaaaauugaauaaagcuauuuccaguauaagcagggccauuaucuaccuugaugauuuuaggcaaucccauagcaguaaaagacuguaagcaauaucaauuacauuucuagaagcuucuccuguauguagagaagcaaaacugaguccugaacaagugucaaugcaaacauguauauauuucaauuuuccaaauuuugaauaaugaguuaccucuauuugccaaauaugaucgggcauaaccucuaaaugaagaacuugagacaauguaagacacucaggacauugcuuuacaaucauucuagcuugcgccuuagugaucuuaugucauggaaccuuaaggugugacuagaaagaugaaauuuaucaugaucaucuuuacccaaaacucuaggaucugaaacuaaaccuucuccuauuaaagcucugucaauacaauuauugccggcagcuaaaaguccgggaagaucagaaugagcucuuauaaaaccaauauaaaaaggaauuuuuuucgagcaagaaugguguuuugugacauaccaccuccaguaggaucugugugacaaguuccacaaacugaggcaauugaccucaaaaggcccuguagguguaugaguuguauuaaaaaaucaacaaauguaaaggcaaagaauaaucuauauauguaacaaauuguuuuucaguagcucucucuacuuguuguaaggccaacaacccuuuugaagguaaaacucgaagagagguaggaucagauuuaauucuccuguaaauaaggacaaagccaaguaauaucagcuaacagcuuuugaaaaucauuuaaaguuuuaaaauugucccuacgaauaauuauuuucugaggaaaaccagcuugaucuguaagccuaaaaccuaaagaauuauaaggaucuugaguuugcacuuuuucuggagcuauuuguaacccuuuaucagauaaugccuguuguauuucucaguaacauagaagcaagucuugaggaucuuuuccugcuaguaagauaucauccauguaauguauaauguauauuauuggccauuccugucuuauaggcugaauggcuugugccacaaauuuuugacauaauguaaaacuguuagccaugccuugagaaggaacuauccauugauaccuuuucuuuggcucuuuaaaauuaauagaaggaacacugaaagcaaaccuuucacaauccugaggauacaaaggaauaguaaagaaacaaucuuucaaaucuacuacuauuuuauaauauccuuuaugaaugucuccacuugcuugauuuuuuucaacauuucaaaacauuggauacagcacacaauucaauuaucugugcugaagcaccaggaaacucaaaagaauaaacaugugauccaaucacauauacuucucucccauagaagggcuguuuauaaauauaguagauguauuauuuaugggauguaugcauaaauuuacaggaaauacaaaagcaugcauagaagcaauuuuuaacaacuuaucuuuugcauuaugauuaucaauuuuaccuaaaaaguuuacuaugcaauagaccaacuaucaauauucugcaauaaccaauuuaauugauguuugagacaaagaauagacaucucaucagguuuuuaagacauuuuuuucuaaaauaucuuaugauucuaucuuacaauucuuuauuaacaacagcuucauaauaggaugcuaaaacuuuguuuggagaugaagaaagaugauuccacauuaauguucucuuuugucaaagaauugcugugggcacauugaguaacaauaacuaaaauaagcagcuaauguuugauuaccauugauuacaaugaauaaaaauugauuauagaagcuuccucuacucuauauggaguaggcagaucauauuguaaugccuuuagaaguuccacagccucauugacaauucauauaucuuaaguuuaaacuuuauuuugagcaacaccuggauagaucuguaauaauguuguuuuggcuuaaaauuauuccugggaagcaaggagaggugaggucccaaaacuucccuaggcaggguuuacaaaacaaaagaaacaccacacaaaccuuacuguggcugcucugagcuuuguauuaacucaaauauaaugugagcauacugcccaaguccuggcccaaagauuauacuuucuguagugagaacaaauuccagggaaacaauuugacugucugucuaugccucuaauuauuggacaaucuuucuucuuauuuuuuuucccaagacaggguuucucuauguagcccuggcuguccuggaacucacucuguagaacaggcuggccucgaacucagaaauucaccugccucugccuccuaagugcuaggauuaaaggcaugagccaccacacccagcuggacaaucuuucuuaagaugauuuauacuuaaaacauuccuaauaacuuuagugcuaugaaagcauugcuuguacuguaguccccugcaaggcagcaaccagagccaaacugauuguaugaggguccaauuucugcaaaaacauaaauauauccacaugagucugucuuugcuuuguauggauggauggcugcagggagaugcauuagcauucucauaagagaaauuauuguaaucauccuaauuacaauauauggguuaguuaaaaauccuaagcuugugaucaaacugcagucaauggaacacugacaauuuaaaucauaauuuaaaguuucuuuugcaauauuagaauauauccauaacuuuuggaaagcaaaacccaauuuuaaacaacccauucucuuuaaaaucaaugccaaaaucaucacuuacauguuacaaaguuuggcugccagcucuuauauaugaaugaaugacagugaagcuuuuaauacaucauuaaagagacaucguuuuaaauucuacccucuauaaaucuaguuucuagaauaagaauuacauaaaauauuaucccaauuuagaaguauuuuaaaagaccuguuuuccuguuaccaauguuacaagcaaaaagcuguuggcccuuuuaagagcugcuuguguaguggcuucagucucuagcagggcuuuuccagcuuugcuugacucccagucacagugaaguguaacuuaucaguuucugcugugcaaauugugacaaguuaaacuaaaucaaaagauggacagccagcagauaaguuuuaaccauuucuuuuuuuuuuucaacauggaacgcagaaaaacaaucauuaaacaacaaaacgaaaacaaacauaaauggacagacauauggcaaauuggugcaccaaggacagacaauagacagagagagaauagaacuugaugucucaaagggacccagauauucuaagcaaaacuaagaauaucuccauaggaaccagagaggaagcaagaugucucccaauuuccuccugucuauaggagagcucugaaauagcuuauuuccauuuucccucuuuugcuaaaaggucccgaucagggaauaacugcuuuucagaaaucuauucucucucucucucucucucucucucucucucucucucucucucucucucucucucucucauguucaaagucuaacucauuaucuccuucuucugggaauucugacagagaagggagaggaggcacagugguagcuacugauaguugcuccccagugcccugcuuuucuaacuuuuccuaauuacuccuuaccuugucuaauucuuucauuuauauauuuaccauuccuacuucugggaauuaagaacaacauaaauguacuugagcuaagacuuugucuaacaucuguggguuuuuuuuuuguucuugucuuguuuuuuacucuuuuuauuuuauuuuauuuuaaacccuauuccuuucaccuggagcagcucuuggcugugaacaaauuuuuuuaaccugugcuccuugugucuugagggauuccuugaaaacaauucauguuuacuuaaugcuugacccauagucuagccacccuuccuaccuuucuuggaucaaucucacagugcgggugacacuggugauuucugugcggaucuucacucacuuccugacaaaguggugguucaguguggguuuucacucaccucuugacgaagcggcgacccacacugaagaguggucucucucaguccccaaacucagccacacggugggcaccaguuugccccagccuucagggauaaucagcggggacccagggcaagggagugagagagugggagggacaagaaacaugaagaaugagagcaagucaauuuccugaucaagcuuuaaaaaacuuuauucaggagugucaauauaagaaagaaaagaggaggcaccaagggaggggggaagagcccgggggcucucugaaggucagguggcaaucuucagcuccuggaaccacuggccacagugucuucucuacccacaaacauucuuacuguuaugaccaugaauguucucucaggauuguuuauguaagcuagaaaauuucauccauggcucccggcauauguguguguguguguguguguguguguguguguguguguguauguguguguguguguguguguguaugcauauaaauauaaauguauauuaaguguaauuaaauauauauuucuugcaaacuaguauuauaauggacucuguuaaagaauuugcugcuuguguuuacaaaauaggaagaaacuauguauuuuguccccuaguuuuuccacuguaauuuaauuggugucuuaauacaguuugagcaaucacauggaaauauuugcauucuacaaaaaugccagugugaggacccacuguuuuguuucuuuuuagguggugacagcuacuggaacacucgcuuugggaaucaacaugcccuguaaaucugugguuuuugcacaaaacucagucuaucuggaugcuuuaaauuacagacagguauuauaaucuauaguaacuuacucaauauauuaauacuauauagccaugaauaguaaaaaauguuacuuuguaacuaauuucuaagaugccacaguuucuggcagagcgauguaagggccugucugguaucgaggaagcacagggcugugagauuauuugagugcugcugggaagugugcaaucuuggauauguuaucuaaucuccucuccuaucugggugaccaucucuaccccacagcagucacucaaacuaaagagagugauuuuucaaaagaaaauccauaucaaagauaauugagaaacauuuacuuuuacaacaacugagcauggcuuuucuaguguagauccaucuuuaaugcuuuucuggacucuugauacacaccgucuccaaaccaccuuccauggucccugguugcucuacaagcuguacacccauuauugccacacuuugcccagcuccagggacugaccuaacuagggcagcauguaguaagaaaggacagauacacaaacacacagaagagccgggaucaggaagacuugccuuucugauggcaaaacuauauaacuuggcagcacaguguuuuuauuauauacaguuuuucagggaaauaggauuauugcauauagcugaacaaggagguaaguuuaacugaucuccuuaugagcagucucuuuaggagaacagucuacaggcauaacuaucuggaaggagaaagcuacaguagacuguuucugaacacacuaucaacauccaaacauaaagaggaacgauuuucaaucccucuuacagaauaaagauauuagcccagaaacuuaggauacccaagauauaagauacaacuugccaaacgcaugaaauucaagaagaacgaagaccaaaguguggacacuuuacccuuucuuagaaaugggaacaaaacacccauagaaggaguuacggagacaaaauuuggagcugugaugaaaggauggaccaucuagugauugccauaugcagggauccaucccauaaucagcuuccaaaugcugacaccauugcaugcacuagcaagauuuugcugaaaggacccagauauagcucucucuugugagacuaugccggggccuagcaaacacagaaguggaugaucacagucagcuauuggaugggucacacagccccuaaugggggagcuagagaaauuacccaaggagcuaaagggaacugcaacccuauagguggaacaacaauaugaacuaaccaguaccggggagcucuugucuuuagcugcauauguaucaaaagauggccuagucggucaucacugcaaagagaggcccauuggacuugcaaacuuuauaugccccaguacaggggagcgccagggccaaaaaggggcaguggguggguagggguuggggggggguggguaugggggaccuuugggauagcauugaaaauguaaacgaggaaaauaccuaauuaaaaaaaaaagaauaaagagagcuuugccauucccguggggcugaggcaucgaguccuugacauaucuguucccacaucaaugguauacauuuauauaggauuuuguucauucccccagggccuccucagcuccccacacauucacuacaaagucuugaccuugaauauuaagcauuuugcuugcuuuggacucuccuuguucuauuuuguucugcaaauagcaaaguuugucugcauaugguuuaccuuccugcauauaguguucugucaauauuucugcaggcagccucaaauuuagaauauauccccuaacuuucaaauuauauauaacauguauaauuauuauuauuauuauuauuaauacauuaucauauacuguuauaucauauaauguuauagcauauaugauauaucauauauagaauauuguaucaaguaauugccagaaaguggcaauuauauauauuauacaguauauaauauaucuauagcauuagauauaugauuuuauaaauauguguaauucuauauagcauuauacaaauaugugguuugauuaaugaugcaugggaugauagauacauuauuuaaaauagcucugcuucagauguagucaguuucucagauuugaaauagguuagucuuuaguuaaccuccauaugcagcauacgugcucaaaagcaauguaaaaggcuuaaucucuucaacccccccuuaggugauucucacaccaugauucugcuauauuuccagaugucuggucgggcuggaagacgagggcaagaccuguugggugaugucuacuucuuugauauuccacugcccaaaauaggaaaacucauaaaauccaaaguuccugaacuuagaggacaguuuccccucaguauuucacucauccuaagacucauguugcuggcuuccaaggcggaugaccuagaggauggcaaggcaaaggugcuguguccccugcuugggccucggucuucacugcuggccuggcugaaauuagcucugcugugcuuuuauuuggcuugccaugacuuugggguccucuagagagggguggaggaagcuggggagcagagugacaaauuuuguuuguuuccaugaucagacaaaguuuaugacugggugggcacaaagcuuugcccgugaucagucucuucgguaugauaggcaccauuacgcuguaccaaaggacucuagcuguaauuuguuucuaucauucagaaacaagaaugauuuuuuaauaauuguaaaguaacaguuuuuuucauaagacaaaauccaaauucauuaagaguguuuagaaaauauagaaaacugaaaaacaaaacaaaacaaaaaggucucaugccugguucuaccugauggucacaugauuauuauuuugcuguucuuguuuuucagacauuuuuccaagguauaauugcucauuuuauaaggcaauggacauaaaaaaaaauaaucagaacauugucuugaugcuuuggggucagauuacagagagucugagaccgugaauuggaaucuugcaauuagaugauuugauuuccacuuuaggaacuaggacuuguguucauuuucugucgguuguaacguaauaccacagguggagugaauuaugaagagaggucuguuuugguucaugauucuggagguuuaaugcugaaggguggcaucuacugaaguucauuuuguuugaagugccccaagucacaaaaaguuacaugcuaaacaggaagcaugcaggccggauugucccccuccccugcccccauucuguuacucuuguaaaaucaugaggauuccaacaaagaaacccuccuuugauuucuauucacucccuuaagucccagaccucaauaugcuagccaacauggagaguagauuucaggaugaucuagggaccacauucagaugacagcaggacuuguucuuccuaauucuauauaugaauuauaaccaguuuaaucagagacugccuacuggagugaaaauuccuggauauuucuaaugggucugcugguuuugcaaagcauuguuuugggaaauucuucacuuuugaguuuuuaaaaaaaugucuucucucuuucccucucuuucucucucccucacucagccccaacgcaccccccccauguguguguguguguguguguguguguguguguguguguacaugccauggcacacacauggcaggccagagaacaagcagaggacaauuugcaggaaggaacuuguuucucuccuucuuccuucuggguccuggguccuggauaucuaacucugguuguacaucuugaugacaagugccuuuacccacugagccacuauauugguuugguuucugguucuuaaggacaucuucuaauaagacuuauuuaagaguagcuuaauauuauagaauauuuuauuucacucauuauuuacuuauaaaauaaaauauuuuacuuauuuuuauaguauauuuaugauuguguucauauaacugucacacaagugucagagagcacacauggaguucagaaggcaacuuuuacaaggauucaugggauugaacucucaucuccgggcuuguacacaagcccccucacccgcugagcuaucucucugaucccuuacuauuuuucagauacuuaauuggaagguucauuuucugugcuuugggcuauuugagaaacgugauaugaaaucucuguuuacuugugcccacuuuagaguuugggcauaaacucuucagacugcgcuuuuuaacuguauucuuuuuucgugguguguccugacugugugucauaugcuuugaccacacacucucuccauuucucuguuguauuucucaauuuccuagcacuggucuccuuccucauugcaaacacucucucuuuaaccuucacauacauacauguuuaaaucuagagacucaaugagagaaagcacguauugugcugcucugccuagcacuuagcucuuaggacugggguugccuagagcacauuuguuccaucuucuagcuagggcaauuaggaaaucccauuccucauacaguuaauuucacuguuuuuuguuuguuuguuuguuuauuuuuguuuuuugcccacacaguaauaugagccuuuuguuuuugcuuauuucaauuuuucccacaagcucuaccuucugaaaaguaauuuaaacaugacuacuuagcuguuuugugaugauacgguucugucuuguuaugcaaguuguuuuuacggugaggaaguuacaugcguuccccacuacugaccuauacacaugauggggccccaguggagaauauaugcaaccuuucguagcuauguucaaacaguuguugaacuaaaaagcucuuaaauuuuauuugugucaauugccucauuuuauucaguuucaguaaguacauacauacacacacacacauauauauauacauaugcauauacacacacauacacauauauguauaaagccccauuuccuuuucuccuccauuauguuuuuuaauuaugagagaacauaacacuugucuuuuggauuacuaauuuagaccuuuauaauaucaacucuguuuauuuuauugauauuguuugaggcagggucucauguaguccaggcuggcuuugaacucacuucagagcuaagggugacuuuaaacuccugauucucuugccucuaccuccucagugugcugggauuauaagcaugcgccacugugucuggaucaacucuguucuuuaggaacaccgucauagauucuaauuauauuuuacuucugagagcauucauagagcccuccccagggaaaauuaguaugcagaacagcaguagaaaaaagagggcacuuuuuaaugcaggcuugcugugagggggcagccucaucacugcagaccuaguguaauagagcuaggcaagcuaugcauugaaacugcuucuuuuucuucauuaguuuauuuauucacuuuacaucccaaucccaugcuuacaaauccuuccucccauuacccccucgccuucuucucaaagaaggggaagcccccuuugggugccacccuacccugggucauccagccagagcaggacuaagcucauccucucacacugaggccaaaccaggcagucuacuuuuaaaaccaugugccacaaauaaauuguuccucauuuaaguugcucuccucagguauuuugugguagcagugaaaauacaaauacaucaugcuaguacaauguuaaugacaaggucuguggacacagugaacuacacaguuaguuccucuccccaaacacucucuugguucuuuguuguuuuccaguugcugccuccucugauuucagcacacauggagaagggugugguaucuuccauaaccuacugucaaggagguggagagcucacaccuuuucacccccccaccgccucuccguacucucuccacccccaacacauguauggacaauauaaccaaagaaguaguucuuucuuguuuuguauguuuuuuuuaaaggacagcugugauucuuccuguauucuagaaacucuccaaccuagagcagacagguuugcauuugagugaggcuaagaaucuuugcguuuauucugaucucacaaguaguuuagagagaaguugaacgccacacacacucagugcugcuugacacuugaaaugaagcacucuuggcuucaaccagacuccuucuacuccuuuuugaguaauauugcuaauacaaaauaguauaucuagcuuccucccacacccacucgccauaacuugcucucuacaagcucugaaacuggaaugucuuuuaugcucauauuguuugaagacaguuuugucuuagucacuuuucuaucaauguuauaggaccaugaugaagacagcucacagaagaaacaguaguuugcuggggucuuuaaagucaaugaccaucauggcagaagcagggcagcaggaaggcaggcauggugcuggaguaguggcugagagcucacaucuugagacaguaucaugggguagagacagagggauaacugugauugucaugggcuuuuacaaacucagagcuuacaucuccucagccuucccaaguaguuccauccacuggggagcgagcauccgagcauaugagccugugaguucauuuucauucaaacugccacggugcucuuuuguguguguucaagaaaauaugggcuggguuagaggacugcuguagaauaaaggaaauuguacuaaaucuaacugaaauuuguguauugcugcuguguuuuaugguauuauucauauucuauacagucgggaaccaaaaggagccuuuaaggacaucccuuuuuccuugugugcuguagacaggggagacaacauuugaaagaguagagugauaaaaggaagcacucacaauguuucauuguucuuuagagguauagaucuuauaauucauauauauauauauauacauacauauauauacacauauauacacauauguauauuuaagauaauauaauguuuguguuuuuguaugugugacauguaacuaagccuguguuauuucuuuuaaagacauuucauucacucaguguugcuaaauuaaaaugcuuuuuuuuuuuuuuuuuuuguaggcacugucagugcugaagcauucauuguuauccuucaaacaaccccgagccauagacauguuaaagcuuuacuucuuauauucuuugcaguuccuggugaaagagguacgaaccaacccugccuuucguucucccuccucgcccucuguuuguguguaauagauuugcugcuaucaagauuuguuuuuaaaguagcagaacuuugauuuuuuuaacaucuauuuuuaaaaguuuguuuguguguguguuugugugugugugccuguauauauaaggagaagguaugagaagccugaaacuggaguuacaacuaacuaagaagcucuauguggauucuggaaaacugaguucagggucucugaaagagcacaaugugccccucaugccgagccaucucuccaguccuaguuugugggguuuuaaccacauugcauuguuguaaucuucagaagacaucacuuguaauucauauaauuauuaaaguugaccaauaguuacaaucuuauuaacaugauggacuauuugaaacugacaaugaauaauugacuuguuguuaguucugugaguucagccaagcuaacaaauuauguuuguucuuuagggacauauagaucaagaagguaauccuacaggguuugcuggccuugucucccauuuacauuaccacgaaccuucuaaucucguguuugucaguuuucuuguaaaaggccuuuuccauaaacuuugucagccaacaagggaagguaaguuuuaggacuguguugucugucuguggguagguguagcauugaaguaauauuguccuauuauuagaauauaaauaauauauccuaauuaguauauggggauauauaaaauaauauauaaugugauauuuaugcaauauauauguaauagguauuuuacacacacacacacauacacacacacacacacacacacacacacaucuucccauguugggaaaagaccugauagauuuauagaaaauaagaauuucagguaaauguuuauucaacuauuacuuaagagaauacuaguuuagaauaaugauuuuguaugaaagcuuuauuauuguguauuuaaaguaaaaguucaaugauaaaaaauagaacaacacuuuuauagacaaauuauaggcuuaaaaaauaagguaaaaugaaguuaauuaaguauuaguagggguuuuauucuguuccaaucauuuuaauguauucacuacugcaaauuguaaugugaaaaguguacugccauuaggguucagaacauauugacugauauacaauaauuauaaaacauuuacuuguaauuaacuauaauaugugauuacuuuugaguaaugacauaagaaagcauuguuaaaaauauaaaacucaaaauucuacucacagauaaucacuauuaauaucugugaucauuauuugcaauaccauuuucuuugaauauaauuguauaguauaggucaauaacuaauauugaauucuuuugugaucuaggucaacuuauacauauuaaauguacccauguuggacaaaaaucuuuagaaauaaucccauaaaguuuuuuuuuuuagaaaaaccuuugaauccuacuuuucaaaauaaauucuuuacacaacaucucugaaguaaauauugcccucuuguaauauguguacuuaaugaugugugugacaauaacuucagugccucuuacuuugccuucugucacuagcagauggaaauacuuuguaugauaccugcauucuuuaugcuuuaaaagaauguaucauguuguggcuacucugaaaguuccguucuccaaaaauguguaaaagaagucauuucaggcaacaggaagugugguuguguuuauuguuguugacagggggaacuaaaauggauaacuuuauaaacgaugcauagagaaguuagauugacugguucuugcucaaacauaacuagccugaugcuacuagauuccaaguuacugaccaugacaacuuuuuagcacucauaguauucuugugcugucagacugcggugccgcaugugagccguggcuccguuugaguguaggaagguuaucuguggguuuaguuuuguauauuuuguuguuaggcacugagauguuguugaauagaugagagaggcuguagagguuuaaaugagaguaggccccauaugcucuauacuuggucccaggguguggcacuauuugaaagaaucaggagguguagccuuguuguuggaaguauguaacuggggagagggcuuugagguuucaaaaccccauggcaaauccagagucuuucuccuuccugcugccuguggaucugauguagaauucuucagcuacauguccagugucaugugcucuugagugucaccaugcuccucaccauaaugacaauggacuaaaccuucgaaacuguaaaccagccccaauuaaaugcuuuuuaaaauaaaaguugccauggacaugaugucucuuugcaacaacaaaacaguagucaagacuuaagucaguacagaacugugguauugcugugacaagccugaucuuucugcuuguggguagaauguggacuuuggauuaggaaaguuuuuuaacauuuuaaguggggcuuaauagaccauaguaguagaaacaggaaagacaguggugcugagaauaauguagauuauaacagcucagcucaagagguuucagagaagaauauuaguggccuggagaccauuugugauauuuuggcaaagaauuuucuguucuuauucaaaaaauaugccggagacuaaauugaagaggucuggauuacugacauuagcagagaugucaaggccaccgaggagugacugugccuggugguuauuuguaguuacucuuaggcagaucuauaaugaaacgagcaaccugcccaaagagaaggacaaaagauucaguuugaggagaaauggagcacagggaaguguaauggagcuaaguccauuuuucaaggaaaugaagacuuuaaagaaaagccagaugcuaaaugugauaaugggagcagugagaaacacuccacccugcuaagcucccaacuugugaaaggaguuaaaaaaacauuugaagggaaccagcagcagcaggaagcuaaugcaaagguaauucuaagaaaggaccaagguccagcccuagcaaggaguagaacucagucacauaguucuggcuuuuaaggagcaaauacaagaaagggguuguggaaucucccucugggacuaagacaagcugcugaggccugguguaugucaggguuguuaccacauggaugcucagagaggccauuucaugaagcugugauggugaagcauggauuguguuggagcccccaagaauacggauaaggcucuuaaauuguuacuaaagaacauuauaggaauuucagaauccauagggguauucagggaaagacacugcugagauuugcugguaguaacgcuacagauggaucuaaugcagcuccucauuaguuuggcaaguugcaguagcaggaucgaguggugaucugaauaggaauggcucccacaggcucauauauuugaaugcaugcucauucaggaguggcacuacuugagagggaccaggagguguaucauuguugaaggaaguaugucacuuggggugggcuuuggggcuuugagaucucaaggcaggcccaguggcucucucuucuuguugccugaucauucagauauagaacucucaacugcuucuucagcaccaugucugccugagugucgccaugcucccugccauguugguaauggacaaaaccucuaacccuguaaacagccacaauuaagugauuucuuuuauaagaguugcuguguucauugugucucuuggucacagcacacugaccaacacagaggcguuguuauaaauuugguuauuuccugggagaugggccaaagugagugaaauguaaaucugagcauggaguaauuugaagcugggaagagaaggauguuaaugaagguaauaaguaugaauguaaaugcugacaugagaagcaacugcaggaaagguuagucuauaguugcuaggaaauaagcauugcaauuuaaaugugaaagaccugaccuaacaccuuuuuacauauauggcauggaacuuuucuuuuguacaggcccaaaacguuuuucugaagauguaauggaaaagcugguuuugguauuggcaaaucuuuuuggaagaagauauaucccagccaaguucuaugagguuaacuccaaguuuuaucaaucaaagguaaaaaucuucugauaaaauugauaaguaauaguacacagagucugucagaaaugugucaaaagcaauuggauuucacgaauaugggauaauggauauauuuuguauauuaaucuguucuguccagaaauacuguagcauuuaucuguaacuccaagucccucugugagucuauucaaaguuuacaugucuugaggauaaauagagugaaagcacauucaacucuuuacuugacugcuuuaaaaugcagcauuaaugaaaagguacacaggggcuggaagaugacuuggugaagugcuugccaugcaagccugaggaguugaguuuagauucccaguaaccacaugagaagauaugaacaguggcaaguauugcauucccagagauagggaggcaagaaugcagggcucccuggaccucgcuaggguagcggcgccuacuuggagagugccuggugcagugggaagccuugcuccaaaaaaauaggguggagagcacccacauacauauuccuguguauaugcacaaaauguagguaauuauacauguaaacccaaaagcuacccucauugcugaaugugugucuugagauaugauuguaugucgcagugcugucucugaggaacuguugcaaaguuaucugggaaauuguccuuugacuccuagaguuuaaaucuuagaaacauuuguuuucaauuuuaauauuuuuuucuugcuuuuuaaaaguucuuaaaaggugcauuugcccauuuaauuaaaacagugguggugcacgccuuuaaucccagcacuugggaggcagaagcaggcagauuucugaguucgaggccagccuggucuacagagugaguuccaggacagccagggauauacagagaaacccugucucaaaaaaaaccaaaaccaaaccaaaccaaaccaaaaccaaaaaaccaaaaaaaaaaaaaaaaaaaaaaaacaaaacuaaaacaaaaacaaacaaaauacucauuuauuuaaauuaauuacaacaugcauuuaugugcaugagaucauauucauagcacccuuacuacucuuuggugcuuugaguggguucucuccauaauauucauguaacuuccugauggcgccuuuauggcauggcugauagaggcagaauucuuuuauuccuaauucuucagguccagaagucuucaacaaaggugcuucgugggcauaugcuuuuacauuguaguuuacuauuaaccuccuaccugccacccugcccuccaaagaaaaggaaagaaaagaaaauuagaugcagagcacuuucauguguccagguaaaaguccuuaacaguguuaguacaguggacacaggugaagguuuccaaaccucucgaccaggcacaguugauucccagccugcaaauaugcguuaucuuccuuguucuacaaauguauccuuugguccuuugaaauuauuuaugagaccaguggcauuugagggcaugcuucuauuuuuacaaacgucguaucauuuugacuaaguugugucagacuaaacguugugaggagagauuuuauuuuuacacgugcauauauguaagaauaagaauaguuccuuuuuuuaauaccucaguucaaccaagaagugaagaaaaugcagcuuuauugaaaacaauaaauuauaguauguggucuuuugcuuucauugcuuuaguuaaucgauguuuuaaggaggguauucaguucucucugaaaaccucugacuuguagguguuccuugaugaccuucccgaggacuucagucacgcccugcuugaguacaauacgcaagugacagaagacuucgcuuccuuucugcuaaugguaucccgauuggcugauaugaaacaggaguaucaacucuccuugucaaaaaucgguacguguauuuuaguucacuaugaagcaauugaauaauagucuugcccaaggacaugccagguggaugcuaggauaacaggucaguaguagggcuccaucucucccauauuuaccucugaaggcugacauucuagaacagacagccugccugagaacaauuggauucuuucugcuaaaaaaggaaguuggugauugacaguuaaaaugacaguggagaaugaaacucaaaccaaauauuaucauuuauaaaccauuuucagggcagacuccaggugaguucuugaaaguugaagaaggcugacuccaagacaagagaaacgaggaaaucuaggaguauuuucaggccaggcuugauguugauugucauagaccuugaucagggucccugacucugauacuucugacucuggaauuggaagaagugauguccuaaucaugucuuugcuuuaucaauggaccuuggagacagagaagaguauuauuuuguacuagugugcaucaaaugacuaguuucaaaucauucguggacaugaauauccugaaggagggcuuagcauaugguaaaaugguuugcuuuuguuguucuuauucauaaccaauagauggaagcuuucauucaucuauuggaucauaaacagaaaaaugagugacugagauauaaaauuuugaguuggggagaaaugucuaugauuuguuauacccugauaucuccaguuggagcaauucauggauguggaauauguacucucugagacucuauaaauguaggaacauggccaagagcauguaguaaaggugagcacacaccucucgggccagcugagauuggagcagggagacagucugccucagugacacaccagagcccacauuggcguguucuaaaaauaggaauggguaauguacaugucucauaaccauuuccaaacguauugauaguggacacuuagaauagccuauuuauucuauuuccaagucacucuaaacaugccuaaucuugccugaucuggaagcuaagcacaguuagguaugguuaguaccugggaagagucuaaggccgagucucaguucaguggggaaaagguuauaaauguacaaguuacuuuagacaacuuucuaguuuaauuaacuuuugagugaucaaaaguacaguauguauuugucacuaguaacacuagcaccaauaaccucuguuuaaugaauauauuccaucccacacugucuaggcucuauguaucaauucaaucuucgcucugguaugguccuugcuagguucaaugccuucccuauuagcaucguuuagcucucauacaaggaaaugagguuuggcacaauggcugcauucaaaaaugaaucuuccaggcaugcgggagccugccuaaauuucuaguauucagagacaggauaaucucuguaaucaaccuggcuuaccuagagaguucuaggcuuccuaaggauauauagugagacuuugucucaaacaagcaagcaaacaaauaagaaauuaaaauaacaagaaaaguauuguaucucaacucauucugcucagaguucacagguaaagaaugugaagauucgccacuugugucucacuugaugaacugcaaggaaggaaggguggcgguuucacccuuuguuugucugucuggaaacuuugauguggauuugcuuaguccaggaguuccaaaucauguacguaaagaaugaugcuuauuaguuagucucuguggggcuuuugcucuaguuugugugguuaucuuaucaaacugcuguugaagcuuugaaaaucuagcauacaaaugauaaaaaauuuauuuuucauugaaaggaaaaauaauuuuuaaagguuuuucuuucuuucuuuuuccuuugguuuggaugucuauaagugauuaauuggacauauaagaaauugguaguuaaguauauuuaaaaaaccuaauauuuuuuaaaaauuuuaaauuauuuauuuauuuauuuuuuggacuggauauuuucuuuauuuacauuuugaauguuugucccuuuucagguauccccuucagaaaaccccuaucccacccccaacccccaccucuaugagggugcucccuccucuaucuacucccauccuccugcuguggcauuccccuacacugcgacauugaacauccucagguccaaggaccucuccucccauugauguccaacaaggccaaccucugccacauauggggccagcaccauggguugcucuauauauauucuuugguuguaaaacuuaauuuuuaagcauuauaguuuuuuuuucccaagauggaagugauggcucaugccuauaauuccagcauuggagaggcugagacaggaggauggcuagaaauuuaaguauuauauaaugagguucagcaaucccuuuucaagacaaggaggaggaagaggaggaaagcaaaauaauuucccuuuccauuuauuaugcaauuaauucaauuuauaaaauauaacaaucacuuuuauuuucuuuuuacauguaaaauuuucauggggauucagaggguuauugaugcaaugagaauagaccaaaaaguuuguuucuuguuguugcaaaaucgacaccaauuagaagggaccaauuagucgauguaucaauuagcgugugcaucaacucauucucacucacucuugcuccccuuuccuucauuuugaagcagcuggcauugguauuuagauucauguuacuugauuauaaucugguuuuugcuugauccaauucacuuuauauaaauuucauuuccuuauauuacuuauuacaguuuaguucugauuaaauuacauucuaguuaaaucuucauucuaaugcuucuagauggcuuauaggcacauauuagguacccaugaacuaaggucucauaaaccucuccuuuauuacauuuccuuguauucuacuaaaauuaccuaaauuuucaaagucuuccaaaaguuuucacuuuacacaacuuuuuauuuaugcuugcguuuuauuuuuacagaaguaaagggaugguuuguuguagucuaaugaaaguaucuuuuccuguguuuaguuuuaugucuguaagauccauucauguuuugaagugaagcucuaguucauuuuucaagugccacauaauucauaacauaaaacuaggcauuuuucugccuucugucaauguuuggucuguuuuuaguucuuuguugcuacaaacacgguugguaauaaugucuauuacauauguucaaauuccucuagguuuucuggguuauaagaaaauagggauauuaaaauauuugagucuauuacccaugucucuaacccacucuagacuguaguugggccagcuuacagcaucauuaacccuacaucugagcuccuguugaugggauaaggcaguucgaaaaaaugaacagacauagaaaacuacugauuugcuuucuucauuauucagauuuuucuucuaucaccucucuacucuuuuuauucugguuguugauccugaagaucauuagauuuguucccucccucccucccucccucccucccucccucccucccucccucucucucuuucucucuuauuagauauuuucuuuauauacauuuuaaaugcuaucccgaaaguucccuauacccucuuuccacccugcucccuuacccacucacucccacuucuuggcccuggcauaccccuguuuuggggcauauaaaguuugcaauaccaaggggccucucuucccagugauggccgacuaggccaucuucugcuacauaugaagcuagagauacaagcucuggggguccugguuaguucauauuguuguuccaccuauaggguugcagaccccuucagcuccuugggugcuuucucuagcuucuccauugggggcccuguguuccaucuuauagaugacugugagcauccacuucuguauuugccaggcacuggcauagccucauaugagacagcuauaacagggucccuucagcaaaaucuuucuggcauaugcaauagugucuggguuugguggcugauuaugcgauggauccccgggugggguaguggguauuuuauucccuauuuuaaggaggaauaaaguauucacccauuggucuucccucuucuugauuuucuuguguuuugcaaauuguaucuuggguguucuauguuucugggcuaguauccacuuaucagugauugcauaucuaaugucuucuuuugugauuggguuaccucacauccauccagauacauccauuuguccggaauuucauauauccauuguuuuuaauagaugaguaauacuccauuguguaaaaguaccacauuuucuguacccauccuuuuguuaagggaugucuggguucuuaucagcuucuggcuauuauaaauaaggaugcuaagaacauagugaagcauguguucuuauuaccaguuggcacuucuggguauaugcccacgagagguguugcuggaucuuccaguaguauuauguccaauuuucugaggaaccuccagacugacuuccagagugguuguacaaguuugcaaucccaccagcaguggaggaguguuccucuuucuccacauccuugccagcaucugcugucaccugaauuuuugaacuuagccauucugacuggugugagguagaaucucaagguuguuuugauuuacauuauccugaugauuaaagauguugaacauuuuuuuaggugcuucucagcccuuugguauuccucaggugagaauucuuuguuuagcucugaacgccauuuuuaaaugggguuauuugaauuucuggaguccagcuucuugagcucuuuguauauaucggauauuaguccccuauuagauuuaggauugguaaaaauccuuucccaaucuguugguggccuuuuugucuuauugacagugucuuuugccuuauagaagcuuugcaauuuuaugaagucccauuugucaauucuugaucuuacagcacaagccauuacuguucuguuuaggaauuuuuccccugugcccauaucuucaaggcuuucgccuacuuucuccucuauuaauuucaaugucucuggucuuauguggagauuuuugauccacuuagacuugagcuuuguacaaggagauaagaauggaucaauucauauucuucuacaugauaacugccaguugugccagcaccauuuguugaaaaugcugucuuuuuuccacuggaugguuuuagcucccuugucaaagauuaagugacuauagguauguggauucauuucugggucuucaauucuauuccauugaucuaucugucugucacuguaccauuaccaugcaguuuuguuuuguuuuuaucacaauugcucuguaguacagcuuaauaucaggcauggugauuccaccagagguuauuuuauuguugagaauaguuuuugcuauccuacguguuuuauuuuuccaaaugaauuuguaaauuguccuuucuuuuuuuuuauaauuuauuuuauuuaauuagguauuuucuucauuuauauuucaaaugcuaucccaaaagucccacuccccuacucacccacucccacuucuuggcccuggcauuucccugaacugaggcauauaaaauuugcaagaccaaggggccucucuucacaaugauggccgacuaggccaucuugugauacauaugcagguagagacacgagcucuggggguacugguuaguucauguuuuugcuccacuuauagaguugcagaccccuuuagcuccuugggugcuuucucuagcuccuccauugggggcacuguguuccauccaauaguugacugugagcauccacuucuguguuugccaggccccagcauagccucacaagagacagcuaucucaggguccuuucagcaaaaucuugcugguguaugcaauggugucagaguuuggaggcugauuaugggauggauucccggguauggcagucucuagaugguucauccuuucgucuuaacuccaaacuuugucucuguaacuccuuccauggguguuuuguucccaauucuaagaaggggcaaaguguccacacuuuggucuuuguucuugaguuucacguguuuugcaaauuguaucuuguaucuuggguauucuaaguuucuggucuaauauccacuuaucagugacuacauauaaugugaguucuuuugugauuggguuaccucacucaggaugaugcccuccagguccauccauuugccuaggaauuucauaaauucauucuuuuuaauagcugaguaguacaccauugaguaaauguaccacauuuucuuuauccauuccucuguugagggaaucuggguucuuaccagcuucuggcuauuauaaauaaggcugcuaugaacauaguggagcauguguccuucuuaccaguuggaacaucuucuggauauaugcccaggagagguauuguggaauccuccaguaguacuauguccaauuuucugaggaacccccagacugauuuccagagugguuguacaagccugcaaucccaccaacaauggaggaguguuccucuuucuccacaaccuugccagcaucugcugucaccugaauuuuugaucuuagccauucugacuggugugagguggaauuucaagguuguuuugauuugcauuucccugaugauuaaagauguugaacauuuuuucaggugcuucucggccauucgguauuccucaggugagaauucuuuguuuagcgccgagccccauuuuuaaaugggguuauuuuauuuucuggaauccaaccucuugaguucuuuauauauauuggauauuaguccccuaucugauuuaggauagguaaagauccucucccaaucuguugguggccuuuuugucuuauugacagugucuuuuuccuuauagaagcuuugcaauuuuaugaggucccauuugucuauucucgaucuuacagcacaagccauugcuguucuauucaggaauuuuuccccucugcccauaucuucgaggcuuuucccuacuuucuccucuauaaguuucagugucucuguuuuuauguggaguuccuugauccacuuagauuugaccuuaguacacagagauagagauggaucaguucccauucuucuacaugauaaucgcuaguugugccagcaccauuuguugaaaauacucucuuuuuuucuacuggaugauuuuaacucccuugucaaagaucaagugaccauagguguguggguucauuucugggucuucaauuguauuccauuggucuacuugucugucgauauaccaguaccaugcaguuuuuuaccacaauuacucuguaauacagcuuuaggucaggcauggugauuccaccagagguucuuugaguauugaggagaguuuuugcuauccuagguuuuuuguuauuccagaugaauuugcaaauugcucuuucuauaucagugaagaauugaguuggaauuuugauggggacugcauugagucuguagauuacuuucggcaagguagccauuuugacuauauuaauccugccaauccaugagcaugagagaucuuuccaucuucugugauuuacuucaauuucuuucuucagagauuugaaguucuuaucacacagaucuuucacuucccuaguuagagucacaccaagauauuuuauauuauuugugacuauugugaaggguguuguuucccuaauuuccuucucaguccauuuauccuuuguguagagaaaggccauugauuuauuugaguuaauuuuauauccaucuacuacacugaagcuguuuaucagguuuaggaguucucugguggaauuuuuggggucacuuacauauacuguuauaucaucugcaaauagugauauuuugacuucuuccuuuccaguuuguauccccuugaucucuuuuuguugucuaauugcucuggaaagaacuucaaguaauauauugaauugguagggagaaagugagcagccuugucuagucccggauuuuagugggauugcuuccauuuucucuccauuuaguuugauguuggcuacugguuuacuguagauugcuuuuauuauguuuagggcuuugaauuccugaucuuuccaagacuuuuuaucaugaauggguguuuuauuuugucaaaugcuuucucagcaucuaaugaaaugaucaugugguuuuugucuuugaguuuguuuauauaauggauuacguugauggauuuccauauauuaaaccaucccugcaucccugguaugaagccuacuuggucaugauguaugaucauuuugauauguucuuggauuuaauuugcgaggauuuuauucauuauuuuuucauugauauucauaagggaaauuagucugaaguucucuuucuuuguuggaucuuuguaugguuuagguaucagaguaauuguggcuucauagaaugcauuggguagaguaccuucucuuucuauuuuguggaauaguuugagaagaguuggaauuaagucuucuuugaaggucugauagaacuccuuuuguaguaguaucugaugaaguuuuggauauucucagguucuguuguuaugucuccuuuuucauuuuuuauuuuguugauuaggauacugucccugugcccucuaguuagucuggcuaaggguuuaucuaucuuguugauuuucucaaagaaccagcuccuuguuugguugauucuuugaauaguucuuuuuauuuccacuugguugauaucagcccugaguuugauuauuuccugcugucuauuccucuugggugaauuugcuuccuuuaguucuagagcuucuaggugugcugucagccugcuaguguaugcucucucuaguuucuuuuuugaggcacgcagagccaugaguuuuccucuuaggacugccuuuauugugucccauaaguuuggguauguuguggcuucauuuucauuaaacucuaaaaagucuuuaauuucuuucuuuauuucauccuugaucaaggaaucauugaguagaguguuguucaguuuccacaugaauguuggcuuucuauuauuuauguuguuauugaagaccagcuuuaguccguucugaucagauaggaugcaugggauaauuucaauauuuuuguaucucuugaugccuguuuuguaaccaauuauauggucaauuuuggauagguacuauguggcucugagaagaauauccuuuuguuuuaggauaaaauguucuguagauaucaauuaaauccauuuguuucauaauuucugucaguguccaugugucucuguuuaguuucuguuuccaggaucugucuacuggugagaguaggguguugaauucucccaauauuauuguaagcucacccuuucuaacuuuuucugaagucgggcuggcugguucaacucagcucuuccaggccaaaguccucuccaagcugacugauucaaucuggcuucuuuggacuucugacugaauugcucugcuuggccuuauaaauaacaacuuuucaauauguucuaaucuuuuggcuaguucucauuuucauucucauucugucuucaccugcaaccuuucucuguaaaacuguccugauaaaacugccuuuucucccucucccucccucuuuccuucccuguuucucccccuccccuuuccccugucccugucccucucccccuucucucucagcugcucucucagauugccucuguuuucaugagaguugggcauauccuauuucugacucauucugccagauauuucucugauuugucaccuugucugccccucaauuagauguuacuuucaaacauggcugcuuccuucuacaaacuaaucuuaccucuauuauuaaggauuaaaggugugugcugagcauauuuauauucuagccagauaauacuguaauucacugucuguauucugacuggaccacacagaccuagaaagucuuuggguaucaucccuugccugaucagccauauuguuggauuaaaauuucucuacagauaacuacaaguucuaaguuguaagccucuguccaugugaauaacuaaaaacuuguauuucuuuaggucauucuacacacacuugguaucaaucacacacaagccccggugcuguggccauacgcauuggauagucaaggaagaaaaauuccacuuaaugccuaugcacuugauuucuauaagcauggaucccuuauuggauuaguccaggacaauagguauguuuuaucuugaaaauuccaagaaaugacuauuccugacaaacauauuagauuuucacuuccagaacaaauggcacagaugauggcauauuuuauacauuuauuucuaguuuagcagcaaaaguuuagcacaugggccaacucacuugaucuaaauauaugccuuaaaugugucuuuguguauaucaaauauaucuuuacauuacaguucuauuuaugcaccauuuaguauuuuagauauaauggcagauagcaaucuggcauuuuuuuaaugccugagagaauauaaagugucuaguuuacauaucugggucugacacuuuagcuugucagggaagccauuuuuauagguauaaauagaagcaggcauuauuuaggucauuuuucauacaguuagcauccaucacucucaaacuccaguauuguggccacaaaacuuggauaguugaggaagaaaacugucagucaacacauaggcuuugacgucuguaagaccaggucaauagauauguuuucucuugauaauuucaagaaguaguuagucaugccaagcaaauuagauauucacuccuagggaaauauccaggaaacuaucccugagcagggagauacuugucucagugcuaaacaccucaucuaguggcagauauauuaaggaauuaaacaugcaguagacauaaaaauuugaacauucuuuacuaaguuaagguauaaaaaguuuuaauaguccucagaaaccuagaaaauuuuuacuuauuaaggcugauuuauuuuugugaauaaaguugcauuuacauuaguugauaauauuuuuugguuuuaaaacuuguucauugauaauuucauaauuguauguaaaauauuaugaccauaucuccccguuuauucuuguauaccuucucaguuguauccccuaaccccagcaagucagcuguccauguuuguguugucuuuaaauuuugguuuauuuucacuuugagucacacugaguuuuacuagggcuaucugcaugagugugucgccauccccuggaagucaggagacucaucagagaaaacaauacugaagaaaaaugacucuccuuucuuuagcccauagggccccugccuuuccugggaacucuuguccuaggagcuugucucucauccuuggcugauauuaaugguccugcucuugugcagacccuauucagacagccuuugcugcuguggacgcaugaaucacaucaggcccagaagauagcauuucucagcacuugcuucacuuagcucuuaauucucucugucucauuuuuuugugauucuuucugagucuuggugaagugacauagauguuccaaauagguguuagugcucaacagucacuuauucucaguagucugauuaaucauuguauaacagcagcagcagcagcagcagcaucuuugaccaugucugagccagcucuaauuuauggauauaaacaucaauaguaaauaaucguaucguuaauuucuguuuuccugucccuuaggauacauccaggggaagcuuauagccuguugaaagauuuuaaucuuaucauuaagucuaucagguacguuacauguuuaaauguuacuuuuguauuuccccaaauuuaauugucauuuugaaauguugagauuauuaccacccccccccaugauccaaguuaaaagugucacugcaucuguuacauaccaugcauuucaacuucccagagggucuguagagucccccaucccuacaaccuuuugguuauggucuguuuuauaauuaauuaaaaaaauguuuuuuugagauuaaguuccaucaagauagagccucagacuagggcagugcacauagcucaaaaccauuccugagcaucccugauccuagauauucucaaugauccccauugcaauaucguagcaaauacacguuucagaaaucucugaggugccagcagcucuccaauuuauaacauuugcuugcucuugagucuccugcuacagucuauauuuuucuucaggguuugucugacuguaaauucauagucacuuuuuauucugaucuggaacaaagcccaguuacucacaaagcaauaucaaacucuuugugaucacccccauccuuggcuccauuggccauauauugucaccuaguuaaauagccccuuaaccccucauauucauauguauuccaacacuuugacagugacuuuuauuuugucacauguguauucaagugaccauaaaucucaucauuauaggguccuuaaaaacaguucucuauuuuauuuccuugaucagagccgaaucagaccuuuauggguguuuuuuauacagagagcuuuauaauuuauuuuauuauuuuuauuauuuauuauuuuaaucugauuuauuuauuuuuauauaguuuuauuauuuauuuguuauuuuauacacagaguuaauuugagguauaugggagcagaagggaaacgcuuuguuuaucugcaguagugguucucaaccuuccuaaugcugggacccauuaauagagugguguguuucuuuucccuuucuucaugccuguucacaaguuucuuaaugcugguguaacaaauugucauucaaugguaugaaccucuauaaauguaucaucuuaccauucuggagaccaaucaucaaagugugcguucaccagacaaaauuagaugucuggauguucuaagggaaaaccuuggcucuuucccaacaguuagagguugucugcaucuuugggucagaguuuccuucugacuuggaggccagggauguucaauagagaaaccugacauuaugaaucaaauauccacauuucaccauuuugacucccaucuucuccuuccucgcacucaugagcaccuuugagaauuccauuagucauaccuaaagaauccagaguaaucauuuaucuccacugaucauuagcuguccucugugggcucaucugugaugguaauugcccuuugucauggagccuaacaugaguccugguuucuggggauuuaggugaggucaucugaauuagaugagguguauuacucugcugacaacaccccagcuuuguuuuuguuuuuuuguuuuguuuuuuuuauccccuaccuagauaaagaaaggaagcuuucuuucuccaucauagucuucagaaaaugcuggacacaguaguugaaaaaccacaaaauguguccaugagauauguagagaaaagaaauuuguguuguauugccuaagggaucaaggaucaaaguaauaaaauuugguguccuuucaaucacccuuugcugaaugugacacauugucuucuuuucuuauuuauuuuuuguacaaguauuauuuuauuaauaaauuuguuucuuaucaacauuccuuauaaauuccuaauauuacuucauaacuuuagaggacagcccuuuuuuauauuauucaauguuacuuaauugaauauaucuaugcauauauauauacauauauuauauauuuguauuuuucuauuuauagugucuccuugcgugaacugugugaaaaugaagaagacaauguuguuuuagcauuugaacaauugucuacgucuuuucaagagaaguuugaauuagugugaaaagaaaaacuauguaaacugcuuaaacuaucaccauagaaucauugugaauuauauaucuuuacucuuaugucuuacucaaacaaucauacaugaugagauggaaugaauaagcaaauagaguugccaucaaacuucuugugguugccucuaauguacuuggugguuucucaaaaaguugacaaaaaugcuuauauuucuaaauuauugaggauugaaggaaaaaaaauacaagaauauuacauauauacauuuaaagacaguuuuuacacuccaugagacccaaucaaauauugcauuuuacauauuuucacuguuaguaugucuaaaacuacuuuugaagauagaaaaaaaugauuuuaguauccugaaaguguaauauaaucuauacaaucaacauaaagggauuucacugcuuagauagcuaguuaaugaaauaauaccucuugauauaauaugaaauguaaaauauguauauuuucauugaauuuuugugaugcuuuuaaagaaaacauguagcuaauauuuuucuucauuuuaauuguauauaaaugacuguugaaauaauga

SEQ ID NO: 4457 - RNA, 1157 nt, Mus musculus
uuuuuuaaagaaaggauguuagagagcuggggagauggcucgguuagaaaagugccugacgcacaagcagaaggccuagacugagaucuccagcacccacagaagagucaagcaucugauggacaguugcaacccuagaaaugggagugccggcugaccagccaaugagcaagcucccagaucugggaaaagacccugucucaaaaacuaagauggacagccauagacggaaacaaacaguaucgaccuguggcccccaaaugcaugugcacuacgcaugugcacaaaugcuaaaaaggaaaaagaucguggaaaggggauaaucugguaagucuaagaggcaggugggggagaggacuggggagcgccaugacacagaagacagguauccccugucucacagcacaggacacagcggauucccacucaaacucuguggaacccaggcaaaccccuucucuggccaugcaauauggaaguccuacagcagcuggaaaauauuguaagugaaaauuagugauaacaauaaucacaggagaguguugaguguucagaacagaaacaaauggacucuguucuaaagcaaaaaaaaaaaaaaaaaaacuucaugguuuaacaggcaagagcuuuauaccuacaugaccaaaucaggagcccaugggaugucucagugagaaaaugcacugcgcucuaagcuaaacagccugacuccaaccccagggacccacauaguggagagagagaaucaacucccuuguccuguccuuugaccuacacacauaugaugcagcaagcacauaccuuccucagcagagacagacagacaggcaggcaggcaggcagacagacacacagacagauguuuuaacauuuuuuuuuuuuaguaauuaagaggggcuggaagaugacuuagcaguugcgagcauuugcugcucuuguagagcaggguucgguucccagcacugacacugcaccccacagcuaccugccucaggagauccaacucuccuggccugugcuggcaccagccaugcacacgggucauguacaugcagguaggcaaaacagccaugaaauaaauaaaccuuuuaaaauuaggauuuucgagugggugugguaggaacacaccuguaaccccagcaucucuguaaacugag

SEQ ID NO: 4458 - RNA, 13415 nt, Mus musculus
agaagcuccaggacaauuuuauuagacuuuaaucaacaacauggcaggugagcuggaaauuacagcagcuaccaggagagaaugaggacguuggagagccaugucaaguuaauguuuagcaaugggugucagccacaaguggaacaagcagcuguauguccuagggcuucagagaaaaagugaugagagcccaagggugagagaaagcaugcucaaguucagaaccauuuuggggaguuggaagggggcggggaucaggacaaaacaaagcaaaacaaccccuccccccuuuucugaggggacugaacuaacaaagcuucaugguaacucaauaguaacugcaccugggcccagcuuucuagggggaaaguacauuaucucauuaaagggaucaguaauccucuaucucuuuagcaucaguuagagugaacuggccuuucuaaggguuuacccagcuggugggccagcucaacuggauuaacucuuaugucuuggguaacuuggccaggaguaaauaacauucuuuugaccaaaaagaaauagauuuccuuagugggccucaaaaauaguuaagaauaaagaaauaguuaacaauaaagucccagaaugcacuuuuaaaaaguguaaggaguaugagcagugggugagucucacguccaacugcucuaccucccgcacugcacggcugucaggucggauggggcacagcuccuuccuugccaagcucucauugcuugcagcccagggagguuuuguagagacuuccaggcugggagaacucuccauuuguagcuuugucaaagaaaagaacuugaggacaagucaacgugaagcagucaaugcauuaaaaagcuagaaaaaaaaaauacaaagaagcacauccacgcaaggugugucugcuuucuuagggucgccuccaguguguuuacagggaauaugcuuacauauucauacacagguaucccugcagguucccaaguuacaguccagagagggauuuacaacaaucuaagagaacaguuacagaacggaaagauuucaggcaagaucugggucucagagaaaacaauauggaguaggguuugcuugcccgugaaaugcaaacagugcagcaaaagaauacaggggagcuguuuaauaugagauccaauagcuggcagugaugcaguuacaaaccuugaaaaagucauaaaauaauuaucuuuuuuuuuccuuuuuuuaaaauuagguauuuucuucaauuacauuuccagugcuaucccaaaagucccccaugcccuccccccacacacacacacacuccuacccacccccacucccacuucuuggcccuggcauuccccuguacugaggcagauaaaguuugcacgaccaaugggccucucuugccacugauggccgacuuggccaucuucugcuacauaugcagcuagagacaugaacuccgggggggggggguacugguuaguucauauuguuguuccaccuauaggguugcagaucccuuuagcuccuuggcuacuuucucuagcuccuccauuggaggcccugugauccauccaauagcugacugugaucauccacuucuguguuugcuaggcccugacauagucucacaagagaaagcuauaucaggguccuuucagcaaaaucuugccaguguaugcaauggugucagcguuuggaggcugauuaugggguggaucccuggguauggcaguuucuagaugguccauccuuucgucucagcugcaaacuuuguuacuccuuccauggguguuuuguucccaauucuaagaaggggcaaaguggccacacuuuggucuucguucuucuugaguuucauguguuuuacaaauuguaucuucuaucuuggguauucuaaguuucugggcugauauccacuuaucagugaguacauaucgugugaguuaauuaucuuaaaguucggaaaagaacuuagugggaagcagaucaccacgcaugguuuccgucacuuggcacucacucggcaaaagccuuuuugacugguacucuccaacaaugaucucugccuguagguacucaggagucaccgaagugugcuuccugaacugauauuugaaagauggauuuguuacuuuugugcugcuguaauccaaauucuuaacuggggggaaacuaaaaggaaaguauaugcugacucaguuucagagggacuucuguuugucacaguuccugcagcaacuugacaaggacuucuugccuggugacagauuuggcuagauucaggguauguaaaaccuucaaagaccugucccuacugacagccaggccccaccucagaaaugcucuauagccuucagaagagcaccagaagguggacacugagggcucaaggcaugagccuacggggacauuuaaaauucaaagcacagcauucuaccuuuggccaucccaaaaugaguuuaguuaaccaccgccacaguucuuuagauagucuccauggucccugaauagucccaacuguucaaaaggccaaacuuucuucugagaaucaagccaaacuuaggugugauucucaguaagauaaaaaaccaagugacuuccaauacacagugacacagaguaaaaaugccgcuuuagacugaaacccaucagugcaauccugaggcggggugaggcccuagggcggugguuaucgguuugguagcacugccccuucugaguacuuuagcucacggggacuugagacagcagucuucacuucugcuuguucauccaucucuacccacccucccuuccacagcacugggauuaugggcacauggcaacagccccuugaucacugugggugcugggaagacucaggcacucugcugcacuucacugaccaggccaucuuccuuaccccuauuuuuuuacauuccccuucuaaaaaauucuggauaaacggccauugaagaccacugcuguuuucccuaaguguuaacuggcucucucccaugugcugauguucagagccaagaggacucuagggcaacauauagaccuuccuguuugcuggcuuccuaucuugccugccccauccaccuccgauauauguuucuaugacuaugauguaggccaugcugugauacagacagagaagucucaucagaacugcacuagguuacuauuuagacucuaagcuaaguucccaguacuggguauuuggcuauaaugaaaagcagacuaacacaaucucuguauuuuaaaagcaauuuaaagagaauucuuaaauaaaaaucauaaaucuauuuuaaaacugcaaauacuuauuugagugaguucaauagcaaauucuuacauacagauaauuacuaaaauaaauuuuauuugugugcaugcauacacacacuucccauugugugcaggugaauuuguagcauccuuucucuuuaacccauggauucucugacucaagcuucaguagucaggcuuggcugcaagcccccuccugcuaagccaugucaccagcccacauauaaaugacuaugugccauggucacugaguagaacaugaaggucucagguauuucaaugagggcugacaggcacuggagucauuucuucauccgugucacuugauucacuugcugguuccaguuucccaucuguaguggcuccaguuggcccugauaguucuaauucuccuaaauccuuuucuauauuuaaaauauuuuucuguuugcgcuucuuaggaacugcaucaucagcacaaaguuuccucauuuugauguuuggcaauuucuucagaucaaaaucccauucccuagaaaagauaagcgcaguguugagugguaauggcaaagccaggaaggccacugucagcucugcccgcugcacagggcagccuuucagcagacuucacauguaugagagcaaaguaucaacauuaaggagggggguugcaacaccccaagccugaagacuugccucuuauugcuacaguaguauuuauuuccucacagaauccuacacaaucuaaacugaaaaagaaaaaaaaaauucacaggaaaaccauaggcucuguguaguuuacuuccccuaaauauuauccuauaccaagcuacauggucucaagauccucacaaguuagaauuaugucauaacuagcaaaccucuaaaauaaaucagcggacagccuucuuacauacaggcacacugcagcugaaucauuaagaaaaaaccauuugcauuuuugucccuaguuguaugacaauucuguuuucagucaucucgugagaggucuggagaccaugucaagcaggggucaccccagcagugcugacaugcuaugcucaucuccucacgguucucaacuucuucagaagaagcaggaaagcaacgaagcauuuuguuuccacuaugccuggauuuaaauuuauccaauuucaauucagaacagacuccacaacauguuuuagugaaauccacaaauauuaacaaaagguauuuucuaauacacagaaucugugcuugaaaaauaaaaaucugaguuucuacagcugagugaucucuaugguuaccaggguagaaucagagcucuggaccaaagauucucaaggauaaaacucucucccuggcauugguuucuauguuacuuuaucuuacgcuccaguuacuuuaagaaauacacauuagcaucaggggagaacagaaacaucgcuaucauauuauaugggauuuuuaaaccauucugaaaaggaaaaagagcuucaccaccaucagucaagugcacacuggguacugcagacagacacaugcacaccaacaggaaagaaugucucugcucucuuuuuuacuaaugucuacacucggggaaguuucugcauuguucauuucacauauaacuuugaagaaauuuagauacucaccggaaagucugcagaguauuagagucuaaaaugucugggaucucugagaaagaaaaaaaauaauauccauuaagcauuuucuuucuaaauuuaguuguuaauaguuuccuucuuaucuuacaacaugcagcuaauguuaauaaaaaggaaaacaauuuaaauauaggcauaaaugugccuaugucuauguaugucacauaugugcacgugccugcggaguccagaagguugguuccccuaaagcuggaguuccaggcauuuaaaaacaaccugaaauagcaguaaguacugcugagccaucucucuagucccaaagagaaacaucuuuaaaucacugcuaugauuaacacaaaagcuacccuuggaaagaagagaguucaguguacagggauaacauaagaauucuguucacagacuuaugaaauaaggcagcauauucaaacagcaaauauggacauuuuuauuuuguaguccuaugaaagacaacuuauuaaguacuuaccuuaugucaaaucuguagaacuuaccagacuucaaagauuauuuaacaugaaaaaaagaaucauacuacucaaaauauaaaaaauuuaaaaagaauuuuaaucaugaggaccuaaaaaaaguucaauacaauuuaaauuacccuguaaccugcaugggaacucacagaaauugccuuugagucugacagacuuuggaagcaauaauggaaucuuuaaaaaaaacgggauuuuuaaacuuggauugaaugcauuuuugcauuagaagauggccauuggaguugagagggcaggaaggcauauuuaaagugauguguuugggugugagcagagaauggaacugugguccuuggucucaacugucaacuugaugagcucuagcuucaccugggagacaggcguaggaaugcucuggggaauuauuuugaucagguuaauugauguaugaagacucauccuacauauugguggcuccugggcuggguugccuugcugugucacccugugccccccaacucccacccugcaauacacagaacuuagcaccaguagccauuguagauacaacauaagacagcuccuacugcuaugaugucaccacuacaacaggcuuaagcucugagcccaaacaagucccuccucccuuacgcagcgguaucauagugguaggaaagacaagaagcacaucuucuauucgcaggcagcaacucuaagugaacauuccaggagcagcagaggcucccugccugcaguggguucagugucagcuguuaauucuccacauuuuaaaccagagaaacaaauccuguuuuauuuaaguguucugagacaggaccucaaacugucuggaacuauguagaccaagcugccaggaacucuuagagauccacccgccucuccccccuccaggcugggaugaagccaccaugcaugccaccaugccacauauuucauuguuaaacugaggaguccccuuuacuaucugguggguuagagggaccaaguguagauaagucuaguucuaaaaaugggcuuuccguuguuuuagguuaagaaacacacuuuaacagugaagaggaaguucagacacuucgaguauuauccagagaaguucuuuugacaucucguauguucaugcucuuuauauuaaacuugaauuuuaauuuuacuauuauauauuuuaccuacuauuuugauuuaaccuuuugauuuaauauuaacaccaaagcccacagggaccaggccagcaacaugaaugagggcagagacaggacaaacuuuaaauuuccucccagcucugcaagggacagcugccacugcacuacuguagacccugcaccagccaggcccucugcuuucucaagccacaaagcugcaugucucaguggaaaucauuauuuucaaaaaauagugacuguaagauagccaaguacuaucugcaggcuguguaugcugugaauagucacugguacccuguccugcucagugaccuucuguguagccaguuaguaaugugcugcugucauuacucugaggaacuguggucugcugaacaagaguuacaauggugggaaggagggacucggaugugacuguagaugaacaggaacagccccauggggagggcaaacugggugggugcuaggaagugacucggucacauuagauggcugucaacugucacaaggaaaagaaacuaauaguauucuaugcaugaagaaaaaagaaacuaagagagcuaggaaaaucgguaaaaugcaacccugaaacucacuauaaauuagauacuguuuugaaaaggcaaagugaaucugagaacacacaccaaagccauagccuucguacugcugccgcucccgcuccagggucugcuugaugacggccucccgggaauggugccgccuucccugccugucuuugaugcuguucuguaacucaaucugcuccagcucacugcugaaccgauccaaguaccugaaaaauacaaacaagaccugacuuacgaugccuauaaauaaacgugggcuuguauuacuuuauuuaaauguagugcccaggugucccuguccuuugaauagugacaccugcaaaccuuucauucccuuaaccuuccuucuccaucacuuuccugaauaauccaaguguuugacuucagugaacaaaaccgcagccugcugaacugaggcccucacacugaaccuccugcuugauuucaucuuuagagcacaccaucucacccuuaacagacauucauucccaugugcccuuucuccugccccaccacagucucuccaucacuugagcucccuacucaggacacaguaagacauucuaggugcgguuuccaggccucucugccugcucuacaccuaaguucuaccuccuaauagcacugcguucuaacuccucaccagcuccuauuagccuaacagaggacaacagucccaucaccuccucccaaguccuccagcuaugucaucccccuucccaggcuguggucugaaagcaugaugaucacaugugcuuccuagaaaaugcccccagagcuucccuauguccuuugauggucaccaaaugcuguucauaagccauuggcccuuacagcaccuguuacacuagccucugagcuugcuauuccaguuacaagaaaugucuggugggguuuuucagcugacagcuccucuuucaccccuaggccuucuagauaccauucucucagucugaagacuauuucaaacuaucuuaccucaaugugcuaacacccauuuccuaaccccaggaaacuaaaauggggccaagcuggaauacaaauuuaagucuuuuguuaaaaaaaaaaaaaaaaaaaaaaaaucugcuaguauccaaacccagagggaagauccaucucuuaagaacuaggcuggaauucuugcuucugacccuuuguucacaauaugcccuguauuuaccuuucaacuaauucacaggcaucuuucuuugaauaucuuguuuuuuucauauccagaugacugugaaaccauugaaguuugucaccuguggagaaguaccaacgaucaacacucuuucacacuuacacaugaaaugaaguagccuacagugagcauuacuaagcauguuauaccuaagagagguguagguacugugaaaagagaaaaccuggacauguugguaaaccugaugagcaauaaaucugacccacagaaagacagagacaaagggggagguagaaagggaggggagaaaagggagagaggaaaaagagggaggcugugcuacuggcaaagacugaacaugugugcaccauacauucagcaagaacccucuucucuguaacccuuaagcugcagcuugcuggaggcugcuuccaggcugcucccaaaggcccacaccuuaacguuuguucucuagcaccggguacacuaggagaugaugucccuuugagaggugaggccugugggcacccuuacgucacugggaaguacccuugaaggggguguugggacucuagacccuccgauguguucuguggccagugugaaguaagcagcucacuuugcacacccccuucugccagugcuuucugcacugcggucaguccuaaagcaacauggucagcuucaugcacugaaacccccagaacuaugugcaaagcaagccuuucgccucagguauguguugugggaacccagccauccccuucauccccuuggcugucagaagacaagauaaagccugagggggcacacaggagugcgggugcacaggagugaaguuucuacaaagcuagcuguauggagcacuaacugucuacucagagucagaugcuuugcuccacuccauuuguauauauguauuauacuuccuuuuuuuuuuuuuuuuuguuaagucugguuaaaaaaacaucugauagaaauaauaaagagagaaaaugguuuagagcaaaaacuucaccauacuguaggcagaauuugaagcccucagaccuacuuaccaauaagguugagacgcaaggccuucucagucuucaaucuugaaccaaaaggugcagagaaauuagauauuuuccaaagcaggagcuuagaaaucugucaaaaauaucgcaaagaaaaacuucccagagaacuuugacauucuuucacauguaauacaaauaaauaaauaaaccauaaugacaauuaucuuuuaaaucaguaggccaagcugucaucaaaaugcuguuucuuguucccuucccccagccuugagcaggcuggcucagaucugguuugccacacacacuagcccaccuaggguggauggagucuucugaccuagguaaagucuauuguccugccacaucugcagcuuuccuccaagaggccacuacuugcugagagacugaaccuguucuccugacacaaagcagggauccucacuaaacaagagauaguggcguggugggggauggguuccccccuuuuauaaguucaaacucuuaguaaacauuggccuugaucagaaaaccuugucuuggcucauuauuucucauuauuuaagccuuucucacacaaaaccccaucuuuccuuucaggaacucagcaaccaauggccacagguggcuauagguggcaccugacaaguggccuaaaagcagaaaggaggacuggaguuacaauaucuucauggggcuccacagaaaacagaggaagguguuucucugcacaguaagcaacauacagcauuaauguuagcgcuacaaauguuaucuuuugaaggcuguugauugcaagggugcaaaaaggauacaggcuagacugagucagugauggcccagcgcugagaucagcuauguaucgguugacaguggaaaauaggauuggaaaacucuaaacaggcauauguccacagucaagaacugcaucaggcaggaggaguaggacuuaacaaaauaaaauaaaaaaauaguaaaguaaaaaaaaggggggggggguagggcuagauauacaaaugacaugagagagagagagagaucaagagagaaggaaaauagauuucggagcucucucagggacagagggaaaaucaggagacaaccugcuuucucuguggccccuacaggagacauccuuaguucugguuacaucaaguucucuacccucuuuguauugucuguguuuggggcaccaaucuguccacgugucaauucgugucuguuuuuguuucguugucugaaugacugcuguucuauguuucguguugaaaagaaaaaaaaguuaaaccuugaucugcuggcuuuccaucucuugacucagucucaguuuacacagcagaggcugauucaaguugcuccacaccuuaggcaggagucaagcacuaacugcuacuuauguuuuuugcucagcucugcaagcucucucuuuggcauuuuauacugugguacaagaacuaauggaaaaauauuuauuaaagcaaaagagggaauggaaacgaggaacauacaccugauaaguagaugcauaaaggcgcuuuccccagugcaggacacuagcgagacugacacucaccuuuccuucuugucuuguuugugagacucucuuguaaucugagcugcuuuucuacuguacggauggaugacuuuuuuuucucguccuaccauuuuuccuuuuaguccuuuaggcuaaaagacaggauacauauugucaguuauguuaagcaacuauaguuacagagaugucacaauaggaaucaggccacaggccaaacauuuuacuaacuccaauggucuuuuguuuccccaugaucauaacagaaaugaucuauuccacaaucuccaaaggcaguagaccaacagaaaccaauagagucaacaccgcucagugacucagccaugccagcuuaaaguaguucugacaacagagggagaagacucguggcugggaaugcuggcuacaguuaaggaugucucuaauguuacagagagcagaaguguaacagguauuucacuguggcccaugaaaagagaguggggcaaaggcacaugcaaaguccaaguugaccaaacucagcugguuccaaccaacaccccauaaacuauaaaggccacuucaaaaucagcacaccuagaagcaaacaaaccacuuccccacccgagccuuaccaguuaaagcuuucagaauccauuccucaaaggcauuauauuuaagggguuucuuuuugguuuuuuguuuuuguuuuguuuuuugcuaugcaauccuguauuuuggcccaucuauauuauuuaaagagucagaauugacuuucuauaagagaaaccaaaaauaaaaauggcuuaaccuaaauaguuuuagucucuucugguucacuuaaggaggcaggcgcccccuaccccguuagcccauaaucucccagacagucugcaagggcuuaaaaccugcccuccacucuagcccugaguggaaaagaaaccucaggaaaguuguccuacacccuuugcccaaguucuacugaccaaaaccuacuguuacauaaaauagaugaauauauauaauuuuuaaucucugagaaaaaaaaagacuauuagggaacagguggucccuaauauuccucuucaauagucacuccucuaaaggccaaauagcucuugaagcuuuuucaaaccugucaguuaccuuuauucaacccauacaaucaggccuagguugcucuauuguuagaccccuuuacaaagaagucgaaaaaaucugucuacaguguuaauccaguauagaguuucuuucccuauugaaagagaucagcuugguucuaagcuuuagcacagaaagccaucucuuccaacuuucuucuccagcauuuccuucacacagcuccuucuccccauucuuacugaagaucacuauuccagaauaaaccacacugcaacuugagacuacacuuguuaucucugucuguaauucuuuccuucccuuuuccuuugcuaagacaaagcucgaaauaaucucaaaaaaacucuccaaauaauuaaaauguucaucaauuccucauucacacaauucucuuagacauuggucauuuuuucauuaaucugaugagagaaggcacgucuaagucugaaacccaucugagguuggcuaugaauaaaaaaauaauaaucuuaaagccguaagaacacacacauggaggauaguggggcaaaugagaaacgagauuaaacaucaaacauacacauggcgaaaacagauucucacaaauuguucuccgauauccacacguacauaaaaucaguuauaaacauaaauucggccaggcggugguggcgcaccccuuuauucccagcacuugggaggcagaggcaggcggauuucugacuuugaggccagccuggucuacaaagugaguuccaggacagccagggcuauacagagaaacccugucucgaaagaaaaaaaaaaaaaacauaaauucggauacugugaaugagcucuuuauaucgcuauacauaaaccguuuauaacacucuuaacuacugucuuaaaaugcaaacaaaacagcauuguugcccgguaggaaugggaguuguagaggcaggacuaaagucagaacagaagggcugcgggccgaugcaccucguggguggcugugacccugggcaggggagaccugcacuugccccagggcagagguggguggauccacaaagcgguauuaguuaaggcccucaggaaaaugagaaaccgggagacguggacaacgccacccagagcgaguugagaacgcgcuggagcacuccgauccuggggcagcaccgggggcccaccaccgccccacgcagccacuccgagucccggcuucucccggguccgagcuuguacuccccggccgcccgaccagagccucccggagaaccuaaggggccgcucaccauggcgaugucuuggccaccgaggccgggcgaugucccgaugcgacaauuucacagagggcagcgcagccgcucucaaguccgcuucuucccuaacacacgugggccccgggggaaaca

SEQ ID NO: 4459 - RNA, 1696 nt, Mus musculus
cuuucuuuuuuuuuuuuuuuuuuuuuuuuuuuauccaugggacaguuuuauuugccucccucuccugacaggccacucauugugagcaggagaaauguccagagguguacucugccuggauacagccuguguccacagugggaaugcugaccagggcagccuguguccacagugggaacgcugaccagggcagccuuaugcccacagugggaacgcugaccagggcagccugaagcucaauaaccugagcagaaguccagacucagcuccacuugauguucuuguccuccucagucauggcugguacaucaguaacaaggccagugccaauggucuuguugccaucccucaaggugaaacguuggccuuucucuaagaucaugggcugccgcaagauuagacuaagcuucaaguccucuccaggcauggcaaguuccuucccuggaggcaagaugacucgacaggccaugucccaggucagggagaacaugacgggcaugaaaugagauacaaaggguuuguggcggccaccuuccuccuugcugaggauauaaaccugggccuccaccuucuggugggguuggauggagccuggcuugaccaugaccaagccacgccucaaaucuucgcgcuuuaagccucggaccagagcacccagguuauccccugccucagcccucuccaggcucuuguggaacaucucaaugccugucaccacagugcggauguucuuguuaugucccagcaacucacacucaucuccuuucuucaaaaugccacgcucuaauguaccugucaccacugugccccggccaggaauagaguagacugacucuacagggagcaggaagggcuuguccaggucccgggugggcacugggauguagguguccacagcauccaggagcuucugcacugacuucacgccuagcucagggucacguugcucaagggcacagagagccgagccuacaaugacuggaguuuccucuccuuuauagccaaacucggugagcagcucccggaucuccagcucgacuaacuccaccaucucugaguccuggacagcgucugccuuguucacguacaccacaacauguucuaccccaaucuguuuagcuagcaguaagugcucucgggucuggggcauggggcuaucauuagcugccaccaccaggauacagccauccaggggggcagugccugugaucauauucuuaacauaaucugcaugaccaggacagucugugugggcauagugucgggcagcagugcuauacuccacaugggcugcauugauggugaugccccgagcucgcuccucuggggcauugucuaucuccucguacuucuugaacuuagcuccaccucccucggcuagaauuuucgugauggcugcagucaggguggucuugccaugguccacauguccgaugguacccacauucacauggggcuugucgcguacauaagucuucuuggccuccacagcuaggccgcgacacaagaagggugaugcgggagccuucagcggccgcagccgaccuugcagaaauggggucgggcuggcgcagagaccgcugaagcggggcgucgcucgcaauagaguggcugccgccauugugguaguacucggugaccgggaccgggaacuaggcacccggggccggcgcgugcagggaaggacgguacagcu

SEQ ID NO: 4460 - RNA, 1696 nt, Mus musculus
agcuguaccguccuucccugcacgcgccggccccgggugccuaguucccggucccggucaccgaguacuaccacaauggcggcagccacucuauugcgagcgacgccccgcuucagcggucucugcgccagcccgaccccauuucugcaaggucggcugcggccgcugaaggcucccgcaucacccuucuugugucgcggccuagcuguggaggccaagaagacuuauguacgcgacaagccccaugugaauguggguaccaucggacauguggaccauggcaagaccacccugacugcagccaucacgaaaauucuagccgagggagguggagcuaaguucaagaaguacgaggagauagacaaugccccagaggagcgagcucggggcaucaccaucaaugcagcccauguggaguauagcacugcugcccgacacuaugcccacacagacuguccuggucaugcagauuauguuaagaauaugaucacaggcacugccccccuggauggcuguauccuggugguggcagcuaaugauagccccaugccccagacccgagagcacuuacugcuagcuaaacagauugggguagaacauguugugguguacgugaacaaggcagacgcuguccaggacucagagaugguggaguuagucgagcuggagauccgggagcugcucaccgaguuuggcuauaaaggagaggaaacuccagucauuguaggcucggcucucugugcccuugagcaacgugacccugagcuaggcgugaagucagugcagaagcuccuggaugcuguggacaccuacaucccagugcccacccgggaccuggacaagcccuuccugcucccuguagagucagucuacucuauuccuggccggggcacaguggugacagguacauuagagcguggcauuuugaagaaaggagaugagugugaguugcugggacauaacaagaacauccgcacuguggugacaggcauugagauguuccacaagagccuggagagggcugaggcaggggauaaccugggugcucugguccgaggcuuaaagcgcgaagauuugaggcguggcuuggucauggucaagccaggcuccauccaaccccaccagaagguggaggcccagguuuauauccucagcaaggaggaagguggccgccacaaacccuuuguaucucauuucaugcccgucauguucucccugaccugggacauggccugucgagucaucuugccuccagggaaggaacuugccaugccuggagaggacuugaagcuuagucuaaucuugcggcagcccaugaucuuagagaaaggccaacguuucaccuugagggauggcaacaagaccauuggcacuggccuuguuacugauguaccagccaugacugaggaggacaagaacaucaaguggagcugagucuggacuucugcucagguuauugagcuucaggcugcccuggucagcguucccacugugggcauaaggcugcccuggucagcguucccacuguggacacaggcugcccuggucagcauucccacuguggacacaggcuguauccaggcagaguacaccucuggacauuucuccugcucacaaugaguggccugucaggagagggaggcaaauaaaacugucccauggauaaaaaaaaaaaaaaaaaaaaaaaaaaagaaag

SEQ ID NO: 4461 - RNA, 1484 nt, Mus musculus
uaauugaaggaaggaauuucaugaaaccaucauauaauacacagaagaaaucagcacuuacaugauuuuagugaugaaaaucaauggaagauauagguaaguauucagcuagaaguuacuaugcugugaaagcacauuuacuuauaauuugagaaguuucagaugcuggacggucagaggguaagaaagcaggguaggaccuguuguuuauguccuaccuucagcuacuucuauuagauuccuuugguaacauauuuaauguauuuaagaaacaugauauuagaauaucaaaucuugacuucagggauauuuuacuuaugggagaaaaacauuauaacauuacacaaaugacuagacuuucauaagaauguuguuaccagggucaucuugcuauaaauuuucagaaguuuuauuugucagauuguguaaucugacggcauucugaugacauaccaagaaaaugcgauguauuccaggguaguuuaaaugcacaguauguccaucauaggggaagcaugaaacucaggcuauuggagcaaugaaguuauaucuauuuauucuuuaaaagacccucuucugaccuccaugggugccaggaaugcaugugauaugcauacauacacgcagacaaaauacauauauacauaauauaaaauauaauaacuauaucuacaagauuuaaauguccucuuccaaccugucauuccucauugauugccuaguaucuaauauaaccccuucuuuuacucagaaguugcaaggagagaaaauuaaaguuggauaguucacacacaguugacuaucugacuguaugagugggagcuuuguggccuccugagcauacuucaggaagcaauccccuccugcaacccaagcuaagcugaaauuuucacagcuccccagcaguaagaagauaaagggcacacuuuguucucuaccuucucaggauaagggaagacgaacgucaauuucagacugccuagcccccuuuaagucuagcuccacuggcaucagggaagaaugacaagucuuuuuccuccaaugaugauugaacacuuuagggaauggucacuggguggauagacucaguccagauacaacacagaggaggaaauguaguuuggugauauuccuggagauagggggaugugauccaaagauguuguaggcaucauuugcguaaagacuguaccuaccgaguaaauugaguccaaacuugaacaguuuggaaacuaacaaguuaacuuaauuuacauuuaaaacuacuuuuaugaagaaacaagauagaaacuguauugacauuuuagagauaugaacuacauuagagcaugauguuagugguggaucuaaauuguagauugugggaauguaaauuuuuaucaugagauggacagauaauucuucaucauuucccaguucucuuuagaugacugaaaauaagcauuuagaagauuaauguucaaggacaucugagagcacagauc

SEQ ID NO: 4462 - RNA, 37741 nt, Mus musculus
ugugguuggcuggucucugggcaugcgcaguggccaccuggggguuggcggcgcccuagugucgccuacuggaagggcaaaaacccgggaccaugucggcccagggcgacugugaguuucuggugcagcgagcccgggaacuagugccccaggaccugugggcagccaaggcauggcugaucacggcccgcagccucuacccggccgacuucaacauccaggugagucagacccggcgcguccgcacgcgcggaagagagcguuuggccgagcccaguggcccugggcgcuuugcgcggccgcugucccccuccccacguugcuccuacccugcuccacaggacaguugaccaaccuuuuccccagcaccugcaaaggcggaaaccauacaguaaauccgggucugguugauccuguacagugcaucuuugccacuagggcccagggcauucauucauugaucaugguagcagccaucuguucaguugcugcuucuuuggggacguuucuacuccacuugauccuagaagcccugcagauggggugaauucugggccaccaggcucucauuucccuucguggguguucugggugaaggcccaccucugagcagugcugcaggugggcuggagcuggaccagcuaccaccguggaagccguugacccugucugccuuguuucaguaugaaauguacaccaucgaacggaaugccgagaggacugccaccgcagggagguugcuguaugacaugugaguuaacugggaucguucugggagcuauuguugauaucugaagggguccucuucagauaugaacaauugauaguagcagucggggcucugcaagaucauccucuucccugguacccagaauucaggccuuaauugccaacaggcguucuacagagacgacuuuuuaauucuuguauuuuaauccccaaauuuguagccagugauuuaucauaggcucauuacaaacauucagacagcaauugauagaaugaaaugugaaaucccuucuaacccagagcuaaguuuugugugucuccauauguauacauacauacacuggguagcugauaaaagcgaggccauucuacccugaaguguacuuucauaacccgcuguuguggacccucugggucuagucuauagagacaacugauguucuuaauggccauguaucauuuucugggugcaugguuaauuuccaauuuauuuauguuuggaaugucagugaguaauucugcacccauauuuugauguuuuguagcuaagggauauguacaauucaucaucuaucaaauuacucuuuaaaaaggauagccuaaauaucuguuuccacaaauuauauauauguauguauauauauauauauauauauauauauauauauauauauauacauauauauuuauauguguauauauaugaauuggcaguuuuccacauuuuugccaaccuguauauguucaucuccuccaccaccaccaccccuguuuuuccuuuucuuccucaugagacagaggaaccucacuuuauugggcaggguaguguugaacucagacccacuuguuccucuuuucuuagcugggacagaggcuaugccgccacaccccaccuguaucauggggaaaaugauaucuuacuauaucauuguuucuuuuuuucccccgagacaggguuucucuguauagcccuggcuguccuggaacucacucuguagaccaggcuggccucgaacucagaaauccgccugccucugccucccgagugcugggauuaaaggcgugcgccaccaccgcccggcuacuauacugcuggugccccucauacgagugucgcugcgacuguucucuuugguuauuucuggccugugguuuaccuuugugaguuuuguucuuguuuuucuuguuguuuuuaauagaguguuauuuuuuucuguugcugugacugauagaaagcagcucagaaaggaaggguguguccugacucagguuuuaaggauacaguccauccugguggggaaggcauagcaacaggagcuggagcugacuggucacaguguaaacgggugaaugcaugaaggcucuuggcuugcuuuuguuuucucuuucugagaccacgucuuuuguguccucuagauugcuguggguucagauuuauuaaaguaucugaggccaggaagugguggcgcacaccuuuaaucccagcacuugggaggcagagggagguggauuucugaguucgaggccagccuggucuacagagugaguuccaggauagccagggcuacacagagaaacccugucucgagaaaagaaagaaagaaagaaagaaagaaagaaagaaagaaagaaagaaagaaagaaagaaagaaagaaagaaagaaagaaagaaaagagccgcucccccccccccaaaaaaaaaguaucugaggaugaccuugaaccucugaucucaugccuuuaugucucaaacacugugacuacuggcauucaccgccacaccugugcuguagaauacaggauuggaacccagggcuuugugcaugauaagcaaucagucuaacugagcuacaucuccagccccucauucacaacaaugucuaaagauuuuuaugaguacucucaaauuuuucaaacugauagauuauuuuuguguauuucuauccuuuguucagacauauguaaucauucaccuaaagaaaaauggguuucucuaaaugcuauuguucuuccuuguuugaguuucacaucuuacuuuaaugcauucauuuuaaaaacagguuugugaauuucccggaccagccggugguauggagagaaaucagcaucaucacgucagcauugaggaacgacucacaagauaagcagacccaguucuuacggagugaguacaguuccggucuaauuauaaauggccacuucuggaauagugcgucugccacaggcaucucagucacaccugucauagugaaacccacuuuacuuuuuauucuaggcaaugaaaguccacagugauauuaacugguccuuuuaucauuuacuuagaacacuuugugccugugugauagucaucugucaaugagaucagaagguugaguguauuuugaacauauuuuacauauuucugaugaugaaaacgucuauagauaaugucuuaguuaggguuuuacugcuaugaacagacaccaugaccaaggcaacucucauaaggacaacauguaauuggggcuggcuuacagguucagagauucaguccauuaucauuaaggugggaacauggcagcauccaggcagacauggugcaggaggagcugagaauucuacaucuucaucugaaggcugcuagcagaauacuggcuucggguauuaaaaccaacacccacaaugacacaccuacuccagcaagacuacaccuccuaauagugccccucccuaugccaaacauauacaaaccaucacagguaagccagauagagcuucacaagagaagaaaaaagcaucaaacuucuguguugauugugauagcuccucaaagacucccaauucuagauaauuagcaagcggaugguguuggccauuucaacuuaagcaaguucaugcuuaggauaguuaguguagucaguggugauggauucugcccccagcaucauuaggccuccaaauguuucauggucauucaacaaacagcuugugccaaacacucuggauuucagaaguaugcuaguuugcagaugaauucugaguacuuuaugaauggaaagaugccuauuuucuuuguggggaaaauaagaacaaacuuaacaggugaaauguuguugacagguuuauuugaaacccuucccggucggguccagugugaaauguuguugaaggugacagagcaaugcuucaacacgcuggaacgaucagaaauguugcugcugcugcugaggcguuucccugagacaguggugcaacacgggguaggcuuggucuuuccuguucuuuaagaaaagacaacaguugcuuagcagucaucuccccagcucauuacacauuucuagaaggcacaguugccacaggccugccuggccuuaagggcugaaaugggaccuagcauuggacgaaggccaaaagacugaugaucuccagccugguaggaaauuuaacucuuucuuauugcucuguccuaaaaaguuagcuauuucuuacuguucugugcuuugcugaagaaacuuaaaucuuuaucucucuuauuauuuacuuuauaauucucugugcuugaguaagcacuggaaaacuuaacucguacuuuacaaacuuacuuuauaauucucucugcucgaauaagugcuggaaaaccuaccucuuacuuacuuuauaaaguuacuuuauaauucucuggucaugaacauaugcuguguagcagcagggaauucaguagagcauguauugcuaaggcuccuuucucucuugcccagaagccuccccucuugcugaccaggugagagggaggcuuggagcaauuaacuuuagggagccaggaaagacaugcuuacagaagggaaaacuuuuacauaggcaauaggcacagaaacauacauuuuuauacacauacacagacauguucacauauuuugucgggccuggccacccgucucagucucauccacuccacaaaaauucaugcauacuuacauacacacacacacacacacauacaugguagauggagcaaaagccccuacaagcaggcuucauugaguaagcaccaucauggaacucagucauucuggaugaaauauaagcucuaccuuuauugcucagagaacgaaaaacuucuuccuuuuuauugaguaugaaaaagcccuguaaccuugucaauuaaaaaaaaaaaaagcuucaguuaagaaaaaacugucuuuuuuuuccucugguacaccaccaacuggcugucaccccaccaguaagguguuacugguauuguaagaacaagccauacccaaagucucauuucuuuguggugucccugaugcuaagauccgcaucuuugacuugggauagaagaaagcgaaaguugaugaauucccacuuuguggccauauggagucagaugaauaagaacagcucucuucugaagcacuagaggcugcccguauuugugccaacagauacaugcuaaagaguugcggcaaggauggcuuucagauccgagugaggcuccacccuuuccaugucauccguaucaacaagauguccagugcuggggcugacaggcuccggguaugcauggugccuaugggaagccccagggcagaguggccaggguucacauggccaggucaucguguccauccacaccaagcugcaggauaaggaacgugaggcucucugcagagccaaguucaagcucuccagccagcagaaguccacaucucuaagaagcgaggcuucaccaggguuaaugcagaugaaugugaaggugugguugcugagaagcagcccauaccugauggcuguggugucaaauauauccccaguugugguucccagaacaaguggagagagcgcacugcauuccugaaggcuuccacaguguucuccuauaccccaccaaaucauguucaauaauaaaucucacauccagucugcuuuaaaaaagagagaaaaaagaagccugccucgugguaagaagaagccugccugcucucucugcucugcucuccucuuacuggcauuguuccucguucuuguacuuuuuuaggauacgcgaucacauggucugcuaagcaucuuuucucaaaaguucaaauauaaauucaaaucuuaaauugaaaagaaguuacaacagaacgguuuacauguguuucuguuaagacuaguuauuuaauuaaacauugauuaucugucacuagcucccacagguucauuaggagucuaaaacaauaauucuuaggucuuaaguuagcacaguuuugucaagaggcaaaucaucugccuuguuucugauucguauugaaguuuauauagaaaaagcuagucaauauuuuaucuucuguccuugcaccuacaaucaauuauccauucccaguuuacgaccucaguuauaaaauaaugguuucacaaccaacccagaaggaauguuuucccugaucaugaauuugcucaagccugcuuucuauccuaguacaauuagcccaugauacaggacgguuuacagagccuuaauugcagccuuuuguauagagagcucaaaauuaccgguauauauuuaggaauucuauagaauccuuauuaagaauuaugaaaucaucaauuugccuguucagcauuguuacaagagaguacaucuuuguugaucugcagaaaaucugcccaguagggugggcuaaugccuaggaauuauuagacuaauuuaauaaugaccagaaagggcauaacagcaauaagaaucaauccagagaugagauuucugaagaccuugcaauucagaauuuacccaucacagaccaugcaaaaacgguggaccaucugcagaaaagucaacugcuagcuuuugccucuccuagauggcuccugacacacagccuuaucagccuaaggaauaguccccaagugucaacaguaguauucacuggcaaucugaauaguagaaagucacuuauuuccauuggguuugacaauguguuagcauuuaagugagagucagagcacuggccagauggaucaguggguaaaaaugcugccaagccugacaagcugagucccaccccuaggucccucaugguggaagaaggaaacugauuacagcaaguugucuuuugaucucuaccuuagugccaugauggugcauuugcuaccccagacccauaaauaagugaauuugaaauaaauaggagucauaguuuauauuuucaaguguuccugcacuucgagccuguuggcucaucuagucuggcacuucccuaguucuaggaugcguagugagugcugcuggcaaacguugguggguugguguuacuuaccccaaagaaacuuaguucuaaauguuacuaacuuccuguaacccaugggucgucacagcucaaaccauucauuccuuuuauucaaagucuguuguuggcuuuuccccugucauuuuucuagugccuggccuaguuaacuuuuuccauauuuccuugacuagcuuucuaugucugccauuauagcacaccagaagugggguauuuuuucacaauucugaaagcugcaaucaauccuaaaggaagguguugguauucccccuaaaggcuccaggagauauucuuccagcggugucaguuauuagcuguuucacuccaguucuuggcucaguuguuaccugguccuuccucuguguaucucucucuuuccuuggcauucuuuaggaugccagucacuacguuuuggcuauuccaaaaugaccucauuuuaacuaacuuuaucuacauagagugcuuuucccugaagaugagcuaugcagucaugaagcccauaaugugauuuuggucaguaaugguuuauguacaugacagugguccugugaaauuaaaccguccggggacaguaugguuugugauguauacucugugaaugaauugccuaaugaugcauuuccuaggccauaccccuauuguaagccacacguggcuauacacagacauauauauacacauacaugcauacacacacacacucacacacauauuauacauacauauauacagaauauauguauucuuagguccucgguggauaugaguuuggaggacacaacucggaccauacauucuuugaucauugcaguggcuuuuaacuuuguaagucaugugaucuuuugcacuguuucgcucucaccucggagaucucuacaguacugcaaagagaaugaauugaacauuugggugcauuuugauaggagacuuucugcugugcuaggacaccuaugagaggaagguggucugaaaacccaagacauuuuguccaguauuucacauacugguggucuucuggggucuccgagaguaagcauuguuagucuugugugucuugacaguguaaaguugguuucuaguuucuuagaaaaucucuccagcuaucauuaucugcuuucccuccaguguuaugcugggguuuccguggacauuuuguuaccccuuuaacucugcgaguucagagcggagugagaccagaauggacagguacucggugaaccugaucuucccggcagugucacugacguacucugguguuucuaguccuuaaaguagaacuguuuguuucuuugaaaacucuaugugauaaauaagagaauacugcugcugcccauaauucugacaucuugcacugcacacauuuaaaugauauuuuauucugaaacagguuggccucggggaggcccugcuggaagcugaaaccauugaagaacaagacucuccuguuaacugcuuuagaaagcuauuugguaagaaacguugaauuuuuauuguuuuuuuuuuuggggggggguaaguggaauaccuagaauugucauuucaggaguuaugucacauauacagcaaaugagcucuuugucauaaaauuuaaucuugcuuuuauauucucaagcugcaaagcauuuuaaacaacucuuaguugaguuauuuaacaugccaaaucucugauagcauguguauagcauauguguacauaugaagccuagucauggacacuugugccuccucacagggccaguggcagaucuguccguggugucagauccacaggcguuuguguuccuuccugcucccuccacugaugucuguuuguacagcugauuuaaacaguugugccacaagugaauuccccuguauguuuuagacacuagguucagugaacaggaaaauggauuaguuucugucugaacucuaguguaaacagccugaugaguccauuuccuccuuccaacaguuugugauguccuuccucuaauaaucaacaaccaugauguccgcuugcccgccaaucucuuauauaaauacuugaacaaagcagcugaauuuuacaucaacuaugucacucgguccacacagucagaaaaucagcaucaagguaggugcaagcuuagacuggcuuugcuaaagucauuuagaaggcccacugauugucacucucuggauauguacuuguuugguaguuuuucuaaaaggugacucuagggaaaaaaguauguaauaauuaagagcugauauuuuuccuacuugacugaaauagucugguugcuaagcaucacacaggugccauaguucagaagccacuuccugcuuugaccagccacuacagucaucccacacgugugcuguuagcgauuuacuguaugaacagcauagguauaccaagcuagaugguauagcccacuaugccaugggcuaauucuauguggaauagcuuacugccucuaagguacagaccaguacaguuacuguacugaauacuguagacaacaguggcacgugguguuuguguaucucagcauuccuaaauauggagaacuccuaauugaacauuguauguaagagacgauccagcugauuguggcacuugccauagguggagcuugcaggacugaaaguuaacuggguguggcaggguucaggggaauugaaggccucauuucacugcaugcagcuguggacuuauaaacucagccuaugcaaaauuuauuaaaaguuuuuuggcuuuuuuuuuuucgguuuuucgagacaguuucucuguguagcccuggcuguccuggaacucacuuuguagaccaggcuggccucgaacuuagaaaucugccugccucugccucccaagugcugggauaaaggcaugcauaaaaguuuugucuuucuuuacuaauaaauuacuauuauaacuuuaaaguuuuuuauuuaaaaaaaccuuuugacucuuuuuaauacuuaaacacauugcuuagcuggacaaauaguuucuuugggacuuuauaacuuuuucaccaggauauuuuuuuuuuauguuuuaaacuuuaggauuggagggucagauguggggaggaaugggaaggggaaauuauauaauuauauuuuaauuaaaauguuaugaauugagaaaaauaaagcuuucuaacacaaaaaagaagggacaaaaagagagagaaccacccaaaacuauaccccucagugagcagccauuaaaacaacaaaggcaggaguguucagugauaggcugcugaccuaucuuccaccccagguccaucauuagcccugaggagauccugggagaaggaccugugggcgggcuccuuggggaacugucacuuuugcaggacugugccacuugggcuuugcuuggucauuauuaguuuguuuguuugguuguuuuuuauaaucucagauuucccucuaagcagugugcucugcucugugaggaccuuugggugucagugucgguuuccagacuuuguggggagcugugacgugcccugggguccuucagcugcuucggcuccuccucucuugccucuuuucuagcucuuugcuccuggguaaucagugcuucucaguuccagcaucaucuuugaggagacgcccuuuagggcgcugugcugcugaugugucagggucaguggucagucauccguuugagugaagauuuagaucuuccucgucucuauccagugccgcauaauuaaguaguaauaauuguagcuuaugggguuuuuguuuuaauuuuuuuucuaucccuaugagcuuccccgcccccacugugauguacaguacuuuugucuugugaaugaagagucagauuuuuuuucucugucaaguaccauauaaauaaguagugauacuaauuguggguuauuuucucucacacgucaggugcacaggauacaucugauuuaaugucgccuagcaagcguagcucucagaaguacauaauagaaggacugacugagaaaucaucccacaucgucgaccccugggagagguuguuuaagauucugaauguuguuggaaugagaugcgaauggcagauggauaaagggagacgguaaugaagaguugauuucuagaauucaaaguuuuugguuguguagaaaacaaaaccaguuuguuaaaaaaucagugucaugcacagauacacuucuuuggggaaguuuugcaagagaagaggguaguuuuuuuuuuuuuuuuuugauccaaagauuccuaacugaaggguaaacaccuaaaaugcuauuggauggggaugagcgauugcucacuggauaaagugcucaucauacaagugugaggaacaagacuaaagcugggcgggcccaaccgcugccuguaaucccagcgcuaaggaggcaaacuggccagcuagacaagucucaacuggcuuucucuagccucagggagagcccuuucucaauaaggagugcagaaagugaccaagaaagaguuuggacgucaaccucaggucuucacaugcacaugcauuuacuguacucucauagcacccacacacugcgccacacacacgcacgcacacacacacugcgccacacacacgcauccacacacgcacacgcacgcacgcacacacacacgcacacacacacacacgcacgcacacacacgcacgcacacgcgcgcgcauacacacacacacgcacacacaugcacgcgcacacacgcacgcacacacacgcgcacacacacacacgcacacacgcgcacacacacacacacacacacacacacacacacacacacacacacgagcacacucaugcacacacagacagugcuggaaagcagacuucaaggccagggucuacagagugaguuucaggauagcuaaugcuuuacagagaaaccaugacuuaaaaucauaauaauaguaauaauaauaacagccagagagaaacucugucuaguaguaguacuaguaacaaaauaauuuuaaaaagagaugauguuaagagcuccaucuugugugaaguccugcagagaagaguuaguuaaccuggcaggcuucugucgugagauugucuuuguucguagcugcaggucagaaggggaguccaccccucaugcaaacaauaaggaauaauucaauaugaauaaacgucucagaagaacuugaagugacuaaugcaaugauguaaagaugagaaauaauaaauccuuaguauggagaaaaacuaacacugagcuguugacaggaauguaaauuaguacagcucuuaugcaaaauaguggggggcacauaaucugacaguagaccuaccuuaacuguuguuucuaaaggaaauuagcauaucaaagaaacaucugcauauuuguguuuguuacuguaccguuuguagugacuaucaaucuaaaugcccaugaguagauaaaauguaaaugugugauauagguauauuacaauaauauuuaguuauaagacuugauaguacaucauuuuuggcaaaauggaugggucuagaugacagaaagaaagaaagucagacacagcaaauucaccguguuccuucuuuucuuuuuuuuuugguuuuuguuuguuuguuuguuuguuuaguuugguugguuauuuuuuuuuuuuuuugagacaggguuucuuuguauagcccuggcuauccuagaacucacuuuguagaccaggcuggccucaaacucagaaauucgccugucucugccucccgacugcugggauuaaaggcgugcaccaccacucccggcaccauguuccuucuuacauggauguuaauaaaugacuggugauuguacuaccauucccagguucuugauagugccaagccaaguucuccacugcugcaccacagcucuguaauagcuuaguauauauuuaauuugcauaauuugaauagaggagcuugaaguuucccaaguaaugauaugaaggcacaaaccuuacuacccgagggccaagccuggugguccauuccuuuaauccuagcacucaggagucagagcagguagauuucugugagaucaaggccaaguaugucuacauagugaguucuagaccaaccaggacaacacaguaaauucugucucuaaaagaaauuuaauuacccuuguuugaucuguauauggugaaacauauagauauagauauagauuuaaggagcuagacauguucauuacccugauuugaucauauacuauaucagauuaucacaauauaccauaugaauuuguacaguuuuuuaaggggaugacucagcaguuaagagcacucauaugaccuggguucaauucccagcgccuacauagaagcucgggggauuugauacucucacacagacauucaugcaggcaaaaccacuaauguacauaaagcaaaaauaaaucauauaaaacucguuuuuuaaagcuucauuuuaaagcgucuugaaagcuuuuaaagucucauaccugcuugccucuggccagugcggugcuucucugggagccuuuauuccgugcuuuugcuaacaggcaguaaggugacucuuaucccuucccggcagaagcugcagugaccugcugcaccggaugaaggagcucugcagauacaugaacagcuuugacagcgaagcucacaacaacuauaaaaaccaagugcucuacuccacgaugcugguguucuucaagagugcguuccaguacgucagcagcauacagccaucucucuuccaaggucagugcacauguucuguguaaaacccaaaacacuggcugagugcagguaggaaggagacagaagugcucugccuccaccagugcugagggauuaaaaaacugcaggguagugccaguucucauugucauugaugauuuuauauaaauguuuuucacuaggaauuuccacuuuaagaccuauaguggucauauaaaacuaaauaggaauacugauuccucuuuuugaaaggaaaucaacucuuuggagcaugagaacacaggaugaggaguucagagacagccuacauccuuucucaaaaagccccacacaaaauucagagaaaccccugaaaacagauuuuuaugaauacagcacaauagacaaaaauuuaaauaaacuauacauuauauauagugcauguugacuuacggcguuucauauguucuguuuuugcuuggagcauguaguuaggaugugcauguaacauucaugaucauuuuguacuaccuggucauugcuuaaacacagauacauaagaacaaaugcaaagaaggaacccuuuaagaacaccuuauaaacaauucaguguagauuccuguagccuuuuuccuuguuugugugugcacuugcguuuacuucgucacacugggcauauuuuuaaaaagcuuuauuuacauuuggcauuugaccuccugcuuccucucauguucgcuacucuuuuucucacuuuauuuuuaauguucauguguguccuuugcacagguccuaacgccccaagccagguuccacuaauucuucuggaagauguggccaauguguauggugauguagaaauugaucgcaguaaacacauacacaagaagaggaagcuagcugagggaagagaaaaaaccaugguaacccuuuccacuuaauugcuaacagauuguguguaucauuugccagaaaugaaucuugguaaaaugugguuuuggagcuaaaauaauacaguuuauuaaacgaaaguagaauuaaguguaaguuauugccuucaguggaggcaacuuugcacccuuucugucucccugguucaucugacagugucuggagacauuuuugauugucacagcuguggcucugugaggagggauugguaauugccaucugguggguagaagcccgggagaggaccagacaucuuacagcguacagaacagccagcagccagaaagugucaaggucuaggaauccuguuugaguuguuuugacugacugguguugauuacauuuauaaaaccaugugggaccuguuggcugcuggcauaggaugcugugauggauguuggccucagaauggaaauggcagccuggucagccccacaagauccaggaaggcuuucaucaaggucagccucacugagcagcuuuugucaugggccugggagcugaccaaacagugguccugcuuuuaggcgcacacauauguguucccuucaguccaugaguauugcaccagugccuccucucagagcuucaguguccauugcauuucaagcuggacuucucaaagguaugcaugcuguucagagugcugcacugucuucccccaaaaccgagguucuuucauaagugucuggccucauuuggaagcagaacugucuuucaccuguugcaacacuauagaauucaccaucuaugauaguaaauagggucuuaguucaucacauuugcuauggaacagaacucugaugcaauaggauguccagagguuagauuucguuugugaaaagugugugugcaugugugugugugugugugugucauuccugaaguggaaggagcaacaggacacuaaagucugaagguagagagaaaggccuuuagacaggaggcaucugggacugaagaaauugcucagugguuaauagcacuugcugcucuucuagaggguuggaguuuaguucccaccacccaugucaggugacguacaccuauacauaauuaaaaauaaugagaauauguauguaugguuuguguauuacuuuuaaagaaaggaagcauggggagggggguaacuaugugagaccagcugagaaaugggcugcuucacugaaaccuugugcauacuguaugaucuugguguggucagaagcuagggaccacuuaucugaugauugaccugauaaagugauuggguaggauaucugauugaagaaauuuuugacagcaguuuccuuuccuuucuaugugacauugauuugguuccucggagcaaugugucacacagcagaauaacugacacaguauaacacaguauaacugaagcucauacugaagcucagcagccuguuuuaccuugacuguuugggcagcguggcuagccacgcccggucacauuuggccuuucucuccacucuggcuucuuugugacaugaaauggagagugguagaaaccuuuccuguaaucacugagcauuccugaguagguacaucaauuccagacucacaccucagcagagcggaagguggcgugggugugggccuggacaugugugcagaguaagagggccccuuguggggagaaagcucggacuucauucugcugugugacagauugcuccgaggaaccaaaucagugucacauaguaaggaaaggaaacugcagcaagugccacuuacacacucucaguguaagaaucugcuccgacuugaauuuaacuaaguugauguguuugggauuuauaaaauuuucucuucagaaaccaaccaacaauuuuaaaggcacuugacugcaugagaaugucaagaugaaaaucaaacauuggucauuagagaucaguguuaauuuagaaaggcugugcacauguaguguucuuugauauaaaagccauagaagacagugcucagaacagagacuaaaugauguuucaguccgauuucgcuuaaucaccuucaaugaagcauacucuugcugucccacaagcagaguucagaugaugaagaguguucagcgaaaggcagaaaccggcacauuguugucagcaaagcugaccucagcaacuccaucgaaguacuggagagcuucaaacuggccagggaaagcugggaguuacucuacucucuggaauuccuugacaaaggugagcuugugcucguugccgucaacaucucgugaucucuuccugucaccucucauagcucagugcugggucuggcacuccuuuccuuucauaggaugcaguuuuggucaggagacuauuccccuacuauucaggugaccacucaucccggagcagggcccuguuagacagacggagcauugccgucagaguugggguggaugggaaggauggugcuuggugucucccugugucuguauccugcccaucuacuucgugcuguuucccuucucccugagcugccuguguucagcagugcagaauacagacaaugugauuuugucugucaucagcccauugccuuggaaaacuggagaaagcuauuaucuuucuugagacggaaucucacuauguaacucuggcugguccggaauuugcuauauagacgggacuggcauugaacuggcaagagauccuccugagucuagcuuugcuagccaauaauguuuugcuuucaugugacaaugggguucauuaauuuccugcuaggcagugaccaugcaucccuugggcuccugucacaugaccaggcauccccaugucagauaagcuauguuguauuuucuaagagaggacagccuccguuucuuuuguuuuauuuauuauuguggauaugugugugauuauuugaaagaaauuuucuuuagucauaaauugugcuuuuuuuaaaaaagacaaaugggcuagugcaacuacauaagacauuggggugaugcacgggaaguguacuucuuagcacauaauacaugcuuacagaugcugccauauagaaauccuguggguuggugauauagcgucagugggcaaaggcacuugccaacuggccugaugaccugggacucguaaggagaaaggagaggaccaagucuuguccuugugcucuccucccuaccugcaccauggugcacacgcacaccuaagugaguacagugugaaaaaggagucccugcauaucagcaagaagcgucccuggcuuuacugccuaccagaaaaugcagaacaauuguaagaggaaccguccgucuuugauuaguguguguguuuucccuuugcugccucuguguuuaguguguguguuuucccuuugcugccucuguguuuaccaguuugggugaauuugcuuuugaauucucacgcagaauuuacaagaauuugcuuggcuuggaagacagacaccuggcuguggcuaagaaucuuccucacagauaugaucaucuaccagguagaguggcagccuuucccgcucccugucugcagggugggcugcugcaagcugcucuuagugcuaguccacugccucacgucuuggagcauuccgugguugugagauuacagcccacuuucaucuccggugucucacagugacacuucuuggugacauuugcuguguccagucauguuccugcugucccuguguauagaagcaacaacuccucacacacauauuaaucucuacccuugugcacauugaagauggcauaaguaauuuucaguguuuguaacuaauauuucuccauuuuaaccaccuuacagaaucuuugguuuccuuauggcauuuaaauagaauuugcuuauguugcucugccacuacccaccuuccccuuugugcccuugcaccucucugucaccauaaagcucuguuucccucccucuuucccuuccucagcucuuuuuaucccucacucaugguccccuuucuagucucaugaccucugccugcaguacccgcauaggagagagaacauguaguguuugucuaucugaguaaggguuacccaaaaaagcaauauuuuugcuucaugagaagaugaccuguucaagcccuucauccucugcucugccaccauccagccugcugcacuucuuguagcuaccagaauggggaaaguagacaguugcugcccaagugcugacauggacagauugcugcuucuguucuucauaagaaguaguuagcugauucuguagaaaggacauaucuaaagugugcuuugucacaaauccugugcuaauuuguguguguguucaugcauuccuguggagagcagaaaacagccuuggguguuacuccuccucaaggacuguccauuuugauuuuugagacaggaucuuuuacuggcccagggcucgagagacccaggaauccagcugucucuugaauacaugugccaugaucaacuuuuccacuccgguucuagggaugaaagucaggucuccaugcugugcuguaaacacuuuccuagcugagcuauucucuauccuacucuguuacuuuauuugcuuugaagaaagucuuuguacacuugccucucaguauuguagguuuaacaccugcagauuaaaccaaguguggauaauaauauuaaauuguuauuaaauaauauuaaauuguaggucuacuaaaaccugugaggccuuucuccuuuaugauuauuuuauaguauagcauuuauuuuaacuaucuuaguaaacuagugguaauugcaagcauauaugaggguguauauggguuauaugcaaacucuuagugucuuacauuaaggacuugagcauaucuuggugucuauggguuccuggagcuaaucuccuuaggaguccuacagauggcugcuucuaaacuuuaucuugcauugauuagauucucuuccuaaguccccucuccuccagagaugaucaugaaagugcauuacauugcuuauuacuucuuguauaauaaacucagaaguaagcguguuugugugugugugugucguguguguuuguuuuaauggcaaugccuuugugucuuuccaagggucaauauaagaaggccauagccagucugcaucacuuagcagcucugcaaggaucccuuucucagccacagaucacaggacaggggacuuuagaacaccagagggcgcucauccagcuggcaacgugucacuuugcucugggggaguacagagugaguaccgggaagcucauguggcggcguuaucaaaggcugcaaagcaccuugggacaucucuccccuauaguggguuuucaggucaauguuuccuugaguuugacuuuaccacucagaccuguuacuuaauuuguugcugaaaaucacaaugaucguauuuuacuugguguuucuauagcauaacuuaccugaaauugggcuucaauauuacuuguuuauuguucuauuuuugacacaagguaucauguaucccauaugaguugcuauguaguuuaaagauaggcaauguauaugcuuuauauaaaaagucaggguauuuuuuaacagugaagaauagauuaccgcuccuccauuucauagauuuaaucugacuauagcuuucuuugcacucacuguugaccacugagcaauggucaugggaggacaaaccuccaugcacauaugcugccugcugcuuugcuguaaauguuugcaguuguauuucuuguuuucaguuuagcacuucagguuaguaccugugucuugucuccugcagaugacgugcgagaaaguccuagaucugauguguuacauggugcuccccauacaagauggcgggaagccacaggaagagccguccaaaguaaagcccaaguguagaaaagguacggugaggucuuaacucuucguccauggaauuuccucagaguuucagggccugugacgugauaucacaccacaguggacuguggaaaacuaagggcuuuuuugguuguaaaucuuuuccaaaccugacuuccacuuccugaguuugauaucucugaaggacagcuuuccuguugccuggcacuagcaaagcuuaagagacuaucaauaugucccuuggguugucaccagauuccucuggggacauuuugagcuuuaccugauuccauauugcuugaaaaacuaauauguagcuaacuauaaauuuccaccuaagaaguuagaaguacauaugcaaguuaaauauaaagaaaguagaagagggaaauaauaauaacuagagcaaagccaauacaauaaagaaaugaguaaagucaguaguuggucuguaaaaauaugcauaacauuacuagcauucuaauaagauugcccuggaagguguugucuacaaauuaucaauaucaggaauaaagacaguaccacaacacauccugcuuacaucagaaggauaguaaaacaagcuaggaacaacuuuaugccaagaauuaaaaggcuuagaugcuguaggaaauuccuugaugagcacuacuuauaaaacaugacacaaaauggaauagaaagaaauuuguuauuaugacaaaaagaaauuaaauuugauauuuaaaacaacaacaacaacaaagucuuugcacaaagaaaaugucaaaugguuuuaaugguaacuuuuuauuaagaauuuaaugagagccaggcagugauggugcacgcuuuuaaucccagcacuugggaggcagaggcaggcggauuucugacuuugaggccagccuggucuacagagugaguuccaggacagccagggcuacaaagagaaacccugucucgaaaaaccaaaaaucaaaaacaaaaacaaaaaaaaagagaagaauuuaaggagaaauggcacuaaaagcucuuucacagaguagggcaugguucuggacucauucauuaagaccagccaaacaagagguucucugugagugaggacuacaggucagucugucuccaugagguagagaugcagauguuggguacgaacagacgcgggcagcuguugggcucuguagacuaugaacaggucaaaugagcagcagccagcagugacuccucaggaccaguggaccauaaagcagagcaauacagcagugugauucccugcuuaacagauugcaggagaaaaggcccaauugucuuuacagaugaaaaguuuagugcuaacuuguaauuuuaaacaauuuuagcaggcuggagagauugcucagccguuaaaagcacugacugcucuuccaaagguccugaguuuaaauccuagcaacuacauguggcucaaagccauccauaaggagaucuaacacccucucccagugugucugaagacaacuacagucuacuuacauauaauaauaaauaaaucuuugggccagagcgagcagggccagagcaagcagagguccugaguucaauucccagcaaccacauuauggcucaaacuaucuguacagcuacaguguacucauauacauaaaauaaauaaaucuuuucaaaaaaaaagauuaaaaaaaacaauuuuggcaaacuaggcagaggagggaauuucucugguaccaccuuuaacuauaaaauauuguauaaaauauugaaugcuuccuuccaauacaaaaguuuguuucucaccacuaaaguucaccaggcacuaaguacugguccauccaucagacaacaaaaaagaaugauggcauaugaauuuuaaaagauuacccagcuuuguguaauggugcaugccuuuaaugucaguacucaagagucagagguggguguaucucugugaguuggaggccagccuuagcuacaugggaagguccaggccagccaagguuaaaaugagaccguaacucaaaaauaaaccaaaagacuccccgcaaauacugcuuucuuaauucacagcacacacuugcuucuguuuauagaaaagccuaggcaucuucugaaagcuaccaaaauuaauaaguaaaaugucuaaaacauuucagugugaaaauaaauuuaugcaugcuaagcuuuuagaaaauggaaauguuggacuguggcuuaaagugacauuaaaaaaaucaaguauguagauggagagacaagcagguccuccacagugaaucugagacacuucugagagaagggaaccagccuuugaaaugaugccauguauugaucuucagcagccuugguccuguuagagugcuguuucucccccaagauucaguaugaccgcaaccaaaaccccagcaggcauuuuuuaaaaguaaaaacuuuggguguaaacuuugaaauuuuguauauauggaaguacaauucagaauagugaaaaaaacauuuugaaaaagaaaccauugucagcugaucacaagauuuauuauuuaacuauaauugguaaaacagcaggagcaaaauauagacaaaggaauagaggaucaagaaguagaccaaugggcuagagagaugacucagcgauuaaaagcacugaguucaauucccagcaacuaugugguggcucacaaccaucuguaaugggaucugaugcccucaucuggugugcaugaugacagaauacucauaauacaauaaauacacauauacauacauacauacauacauacauaauuuuuuaaaaaauagaaguagacaaacacagacaggucaaaagauucucaauaaagacaccaacguaacugagugcaaagagggaggccugaacacacagggcuggaguaagugacuuggaauacauuugaagcaaucucugacuaucacuaagcagguaucucuggaacagaaacacauguggcugguagacuuggcucagccugacaccaagaucauaauuguaaagcuauaguuuaguuaaaguagugguguagcauuggcagaggaguugaauaauggaacuaaacagaaagcugaaaaucagguuauauuacaguucagugggugaaaggcaaaauaugagacccaaccuucaggcuacacaaugauauuuucaguucuaaauuuuacaugugaaucaagacuuacaaucuuuuagaagaaguucugaaagaaaaucuucauaccuucuaguuagagaaggaccuagauuacaaagaaugcagaccguugggacacguuaguaaauguggucagauuaaacuuaaacugaauaugccaccaggucacaaugagaagguaacccacaagcugacacaagauuauacagcaccuaaagacaguaaaaauguggcaucuagaaguuucaguaagaucccucaggucaauaaaaaacagccagccaguguguccggggagaguaaguaaagaagcgugggcggcaggcagcagaaacaacugcuguagacacagaccguuuggaagcugcccggccugucaguggccugagcauuaggacuggcguggugaagcacccaccguucugcaggaaccagacugcagguaccaagaccguucagcacugcucccgagacaggguggcagagaacagccagcuuugccaggaugagugccuccuuacccugcuccgaaccucguguuuucaaaccgagucaugaguuccaaagagaaaugcuuuuuuuuuaauuuuuucaauuuucuuucuggaauggaauauucuugcccccgaguacaaaggauaaauacuaaaaaugaugaacguuucauuuuagauacaucauguguuauauaggaucccuagguauuaaaagacauuucuuucuugcuacuucuugacucugagcagaggaggauuuaaagaccacaggccaugaugaggaagauugagaucuugauuugaaagucauuacuuauuauuuucuuauaaguacacaugaagucaccuguaaauguguucgagcaaacauaauguuuauuagugaaaauuuagaaaucccaugaaccaggugugacaucugugaccgaaugagucccuuuuacguauauguguaaacaauagaauaccucguaauccuggaaauuccuuguugacaaaccugaaacacagaacauacaguacagaagccaguuugcagaagauacauacgcuaugauaccacuuggcauaguagacugaaaacaugccugacacuuuuguguguuguuuguaaauacaaacauugcucagaagcauccagauuacauaggaguugcaggaacaugcagacugcauagaagugauagucaccacacucaggacugugucuaccccuacaacaggaaaagacaagacgguaugaaaagccccuacgguuuugucauaauuuguuuuaaaaucauuaaagcuuaaagccagauguuagcauuuuauaaaacugagagaccagggccuggagagauggcucagcgcucucgcagaugaccuagguuauagucccagcacuuacaugccagcuucuaauuaucgguaaugccagcuccaggagauccaacacccugucucaccuccacagguacugaacacaugugguacacguacauauaugcagccuaaauauuuauacaugcacagaaggugagugacaagcacauuggguuuguuagagucccuuuauagaucauugugcauauuugaaauaaauuauaauuauuugauagaaaaaauaauuauaauuauuugauagaguaggaaagaaaauugagaaaccaacucuagaaaucagaaaccauugucaucguuacacaauuaauuguugucugcugugucucagauucugugacuuuuucuccuauugagggagcaugugagacauuuguuugucagaccucuugucucugguucacuaacagucuggccuugugguagguuuggaucugaagcuucugcccuguaccaguaaggcuaucaugccauacugccugcacuugaugcuggccugcuuuaaggugagucuaaaacgggguuaucaggaaacacauucccuuugaagcacuccugguaaacuggcaagagcuaacagcucuguucacacuguuuuauacuguacaaggcagaugagaaaagcuugugggcuggaaauugacaggugggcuggggaaguagaaaauaagcccugugcuugaggaauagaaguagggaaggcaagcagguccccuugcuuguuauggcaaaauuguugcuguuguguaugucagaauauauuagcuaaagaagaaggcaauauaaauauuggggucaccaguguauaaggaguuaauucuuuuagacaugagggucagcaccgucaaaggcucaguaccaucaaaggcucaguagcacuggaaaggcuccaagacucuugaagguaccacaacccuuggcuacaguggaauagagccuuggggucggaguauagccauuucaguaggcuugugugcaaaaggcaacaguacagguuacugcuuuaugcaguagucccacacuaacuaagcguuaauagcugccuggaaccagagaaguccucugaagugugauuuuaugggccuguucaugucaagucgcaccuuuggucuugucuuuagcuuccacuuuauuguuggaugucuuuccuucuuccaagcuccaucaucuccagcccuccugugauggcuucuugccuaucuuucuacucauaguuauccccuuaaaagauaccucuaagguugaggagaaggcuuaauucacagcgugcuugcccagcauccauggguucaauuccugccacugcguaagcuuggcauaguagugcauaccuauaaucccagcacuugggaaguggaggcaggaagauccaaagauuaggcauauccucagcuaucuaacaaauguagggccauccuauuauacccgagacccugucucaaauacacaggacaagaacaaaacaguaacaaaaaauuccuauucucuucaacguauaggaauaugcaaccuucucuaucccugauucucaaacucacaaacucccaguuuaccuauucauguccaacuuuggucuaaaaucuugugaccugccgugugcaguccucagagggguccugggcuucuuuagaauccacccuccuuagaagagugugguguccaauggcaacaguuuuauagucuuaaugguuuguagcauauacugacauauggagccccuuuuuaggaggugauauuugguauggccuauauuuccuggauuuauuucuucuauauaaaucuuugucuugcagcugagagcuuuuacagacagcagagacgacauggcacugggccaugugauuguacugcuccagcaggaguggccacggggagagaaccuuuuccugaaagccaucaguaagauuugccagcaaggaaauuuccaguaugagaacuucuucagcuauguuacaaguauccuucgucuggacaaauaagcucgguggcuuuugaauguuuagcacaggggcauuguccacuaggacccguugagcuuuuacuauuuguggggaaagaaggaguaagaguuagaaauggagcuguggcaguugcuuuguaaaagucaaaugaaguuuaaagcuacaauucaaggagucaggacagucagggccuguuuguuguuccucccaagaaggcagccaagaugcccacaguuaaaauagccucuggccagcccagagcaguugguuuagcauagaccucggcuuuuuuucuguggaaagaguaucccaguggucuccccugggacagaggcugccuuugggaucagguguuagcacugggccugcaccaccagagcugccaaagguuaagcgaaugaggcagaguucuaagucgggcagcacuugacuucgcaugcuuggaagggaagacagccuuugaauggaggcaacaccaaacacugguuugguugcuuucauuucuuugcuuugcauaguacaaccucucaaguuguaggauguguguacuacauauuucccagugccugaucagcgguuuuuaguauuuuuuuuuuuaaagauuuauuuauuuauuauauguaaguacacuguagcuauccucagauacuccagaagagggcaucagauuucguuacggaugguugugagccaccaugugguugcugggauuugaacucgggaccuucggaagagcagucggcgcucuuaaccacugagccaucucgccagccccaguauuuuuuuuuuuaaagacuaaugaaaguuacauaacuuucccccagaagaaugcaccaucuaacacugugcauggaguucucuggauucucagaagaccuugucugcugggucugaagaaauaaucuuuuuuugucuaacucauucugucaucaaauauccucccaauucguccuaucugcuagcuuuugucauuuuaacuaagaaauggcucggguggcccuguggaauccguuugcuugucucuccagggagaccaugugcuaaugcuuuccaguuugcuugucugaagcuugagcucaugcaguccacccaaggcaugagucucgcccgugucgcugagugacauuaccaccccagccuggcaccucuugugcaacgagcuucuuuccauagggcaguuugguuaacguaaaagucagcaucuggaucaggaaccgacugugguucuuaguuggagggugguaagcaggcucuuuaucugcugagagcuguuucuucgccugggagaacagggcaacauguuaccuguugguugaccugaaugugaccugcagacauugauaugcuggaggaauuugcuuauuuaagaacccaagaaggagggaagauucaucuggaauuacucccaaaucaaggaaugcugaucaaguaagcagaugaucuuuuguucuucgaagcucgccuuucaugugcugcaugaccuauuuguaaauuucuguaccuuucagaaauuuaauggaaaggauuccaaacuggucucaguuuucaagggucuacuuguucugggugucuuaaagauaugcauuucuuagugcauuucugcgggaaaaguguugcuuaaauugggauauuuuuguuacuuuggaaauuuuuuacuagauagaaauuucuauaugucuuuuccuuuccaaaauuuaguacucauuucugauuuaauugaaagcagcugugcuugacauuguacuggauugggaggaucuacagguucuauuuagaaacugucuuaagcuucucugagcuuccucauugcuugugcagucaaagcaaauuagcugguucuagugccucuaaaacacaccugcuccccaaaaauggcccuggacgugcauccccaguguggccccugaacccuuaagcuacuacagaaacccagguuaucuuagaugaaaagaucaaguuagugaccacucaugauguuuaacuagcucauaaauccugcuucucuccucgguccgcacugcaguuuggcuaauagauccuccccacuguaagcgccacaugcuuacuuccuucuuuacuuccugcauacucuguguuuguaagucagugucagaguuacaacaagagacggcccagaacaggaagagugcauugcugagacuggaaaccugcuuugucccuccguuuuggcagaagcaaguuuuuaauuauugaaagcaaaaguccuuccuuugcucugucuuuguagagucuuagggguguuggaggauagagguaagaaagaaaugcuuauguuggguuucuguaacuaaggaauuugucccauagugagcaaucccuuccuuauugcaucuuagcaagaguagggcccaguagaaucuguccuaaagagcagaaagaagaaugggagcuccccuccccauccuguaaaugauauugcaugccuuaaacaguuccuauaaggaacgaaggaaaugcuuaggaguauaugaggaccuuuguagaugagauuguguagucagguuguccuagacacuguccucuccccuuguccauuuacuacuuugauuaugaaccaaagugaugggggacauaacugcaugguuccaaguguuguugaccacauuuaagaacagguugcuucuauauauggaagcccagguaaccccuauucuguggggacuucuagguucugaaauugacuaugcuggcauaucuuuagcaagguuuuuuaguucaacaauaagccacgauucaaaaugccauacugugaaugguccuagagcccaacugucccuaccacgagucgaucugcagaggauugccucgugacuaagagaaugucugagguagagugagggaaugacucuacagaccucaacuccagccucacuguacugggccuuugcacuguccccauauucucuugguuugaacagugucaaccugcaaauagucccuaagacuuggaauuuaaaaugaggacauaucaacugcccagauaaugucacuggaaaaguuauuuguacaaggaggccucugucuugcuuuccaaggcucucccacuuugaucaaccaaaauuuccuugaacuuucuauaggagauaagccuccuaaaaacccaugguugacuuggcuuggacaaaggacuagggauuauuaacuagcgaucugaccuuguaggaauguucucugugaggucucaauaugaauuugaaaucuguauuuuagauaaucucuaccuaagugacaccaagagaaucaaacugcauaagacagagcuuugacugaaugaggugugauuagacucuugaauaaaacuaucuauauuccuuuucccuuuggguuccaaacaaauucucugaagccauugcagaccuuuuggguggucccuccagaugaguggcagagauguugugagcaguguaccucuccuccccuugggguaagguugugaguccguccuaguuguagcaucucggaugcaagcagguacaguacaaacaccaggcacuuggugccaggccacaaggaggcaucaguucuucauuuguuguauagauauguuguucuaauuuguguuaaaucagagaaauguuucuaugcugauauucacaguaccauaguugcauuagacuggaucaaaauggaaaaaaaaaaaagauauucucuggggugacuaccagcuaaugugcuaaauuuuuauuacagaauucugcaaaaccaugggucccagccuugcccccccccccccgaaaucugaagcucacccuuucuuuacugaaagcauugccagcccuucugagcccuuuuuaggagggccuuucaguucagggccucaguccugccagagguggcuagcuggcaucuccagguauaauucugggaugcgugggcaugagaagagugaaugaaggaggcuggauuuugaaucagaccuucucagaaguuacccucccccacuccccccuccucacugauuuaucacaagugggcagagcucugggaccagcagccaagacgccucuagacuggcaccagcagugggugcgguggggcccucagcuucucccagucccuugaagacaugccacggccaggggcuuguggagguuaaaguuucuguacaguccgcuuccagucucguguaucuucucuggaguguuguuuugcagugcagggugagcugguguggguguuugaaugcugcuguuugcuguuuuuuaaaggccuucuagcccucccaugggguugcugcagcaggaauucuuaccugugcuucagcccagcauacagacugcugacagguaccaaguggaaaaacaccugcucauagugugcuguuugucacauguuuucccgcccaugguuuucagcucuuugucccucggugcucuuuuucaugcuuuauuuauuuguuuuuaauuuguucugcaucccucggcaaaccaucugguuguaaauauuguaacauguuuaauuuuuuuuccaugaguugccaguguguuuguguugaauuuaaaaaucauucuggaucuggggagggaaaccuguuugguaaaacugucuuagacugagugaguguuagaggacgcgcuaggcugcgacucuguuguaauaaaaugcaaggguuugggucauggguauucaaggaccuugacacacaugugccacaaguaaauuuuuauuguagauuuccauauuaaugaucaggacuuuuuuuguucuacguagacauucacacagucuuucccugccuuagaguuucagaccuuuccuuucugaacuggcaguauuuaguacguaagcuaaaaugaugcuguuuauuuggcuagauucuccuguucuuaagccguaagaccuagcuaucucuaugugccacuugacaccagggacaugccugcugugcacugugcuguugcauggccaucguacugugcacuuacucagaccuacaugcuacauacccaggcuguagggaccagugcagucaaucauugccuguggagcaugacuguaguugacaucauccagacuugcauagaggcucugaugcauguauauugaguuguguugcuguuaauguguggaaacaaucccacaggaccaugacaagcagauauuuaauuguguguuuuguaguauuaggggagaauauguccucugucauacggccugcagauaauuauaacuuguacuuggcucaguuuuggguugcagcccagggacucaaguuagaaauaucucaaggcaccauaaaguacuaugcaucaguuugugcccagcaggagucagaucuuuaacccucaaagacaccgagcugaguuagccagcuagacuagaaauguccgugcaccacuauuuucucguggcccugcugucuucccagaagcucuuuaaaaugccuggguuguucagagugguuuguuuucacccgguguuacuucugcgcugccgcugccgaggugacuccugcucacuuucuauguaauaaugcgguuuagaagcacaagccuucagcgugauagccacagccucaguuuucucaguaguugaacuuugugacuuggaggagagucaggggauaggcaggaaacagagguagcuuuuguuugucugaaauugucacauucccaaacuagcagccaaaaugccucuguuugugguggaguccacugaauuuugcuagacuuuucuuuuccucuguucauuuuguuguccuuauuucugggguucuguuuguccuuucccguccuaacgcacggcucuuggcgcacaguuagacaccucuuggcuuuugcucccauuuaacccacccacagaugagcaagcacaugaauagcucuacucuucauagacccucacaggcagugguuguaccuuuccaaccugugacaugguucugucucaggacaaaagucuggauggacauggcacucaaaggaccugcccugccuuagcucccuggggauaggccugcaccccgggaccccagcggcuguguggaggccagaacuucucugcaccuagcagccauggaaggccugccagagagcuccuuggugacuggggcaugcuucccucuuccugcuguugucucucuggucuguggccuggucuccggcacagagaggcuccugaagguggaaccuaaagcugcccaaggcacugcauugugugagcuucaggaguucagaggcaaagcaggugacacuucacuuaccauuuggcugugugaaaugacccagucuaggacaggaaagauaucugccuaguauggagacugagacgaauggucaggaaugguuaucugguugcagcuucucuuuuuaaguuugguuuaaaugcgugacuauacuuagcuaugaggcaggcugauuccuacccagguaacacuagguuguggugcugcuguuaaccguggucucuucuguuucccuuucgcugaccucaggcaccacacagucacucgaggcaucaccaaaggugugaaggaggacuuccgccuggccauggagcgccaggucucccgcuguggugagaaccugauggcgguacuacaucgcuucugcauuaaugagaagaucuugcuccugcagacucugaccugauagaccuccuggccaccagcggcucagccaugacaagcgcugccagaccagggcugaugaagaagaaaaacaccaaguucuaacucccuuaguugcuuaaaagucaauccgaagaguauaggaaguuauuucuauuuuuaagacuucagguuuuuuuaguuuguacaaaauaagauucaauccauuuuguaaauaaaaacccgaaagauuugaaguuuuaaaaaaaaacuuauuuuuaguuucaaguaggguacauuugucuucuauuuuucuaaucauggcaaaggggcaaaaauccaacacaauuaaaugcaggaaugaauuuuuugauauauuuaccuaauggaauaugucuuccaugaccucagguguguuuuauugauaugcuuugguaaguauuacacaucaggauaacauuggaccuuucguuuuauuuaugcacaguugaacuugggccuguccugucccugcugagagcccauugcaggcaugguacucuauagucucugaaaagacaggaugagaaauaucggagacagcaaagugcaggggacccuccucucugcuggggccucuggaagucagucuggcucuguggacucuccuaggcccuuggggccgugcaucacugcuugacagccaucuggcacccugcccugcccugcucugcccugcccugcccugcccugcccugcccuguacuugucugugugaucaagaaugaacaugugcaaacacagacacacacacacacacacacacacacacacagagcaacuagaauuauguuuucuaggugcugccaaagacuagguuguuuuacagauauuuucuaaaaagaacaggcauucuuauuucuuccaaaggucacucuaguguauguucugggucuuaacuuauggaggcauaggucuuagguauaaaggauuuucuuguuaaaucaacugucauaauuugaauagugucacccaaaggucauuguguucaaacuggcccuaacuucacacuaguuuagugugucacacauacauuuaacgaugguuacuuauagacagucaguagggguuucuauuuuuuuuuuaauuucacuuauuuauuuccugcuuuaugggccccagcaagcuggagaauagacagaagaaaaauaaagugauuucaugauuugaguguuauuguccauauuccauuaauaaaacaaagguaaaaaggucacauaguaguuuauauuuaacgguuacauuccuaauggaugccaaguucagaugugagugacaugccaggucaccuugagcccaguggagggcuucccuuucguugagagcagcuuuguggcuuguuacccaugaaaagaaaugacuggugaaaaccaaggugcuaauguuuuagccagaacuccaagucagccagcugcccagagccuugcuugucaagggagacagcuccacaccuccgagaaccuugaguuaauguucugggcuacagucaacagucacaugcugugaccuauaguuuggccagugugcucuggaaugcugcuugggccagugugagcagaaauuuuuguuagaaauucaacauaguguugacaccuuaugguuuuguguaucuucuuaaguuuggaacuugagauaauacuaaagaaugccucagugguuuuaagcaaaaguaaaggaaguaagguuuaucugugugaccuuucccuucagccugacucugccucccuucaaaucaagaccugaguugacuuuuuaccuggaauacacuucugugacucaagacucugcugggauggcuuuucugagaacaggaaccuggugugcgggugcugggucugaggucaguucaccacaaaucgggugaaaauuaacuuugauacacuaaacuguagaaacagcuguuagcuucugaaugaccuguacucucacuggucaguuauugguuuacauaauaaaauaauucuaacauuuguuaacucuauuucaggccuaaugccauguauuucacacauauuuucuccugacaaccccgugaggcaggucuagugagcagaugaggaucugagacuuagguucuguguuggugcugaagugacagggcucgugaccuaugcucgagguuugugcuccugguguuggaaugaggcuggacauuuaguugauucccugagagcgccccaugcugguguugugcuguacuuuggaaguagcuaucuaaaaagacuagaaacuaagggugucguuucauaccuaaagaaacuuggcacgugggagacccccguuagaccagaagccugggucaucaauuaaacucacauuuagagaugaucaugaggggagagggagugggcagugcuggagagaccuucaagagacaggauguacuaacuaggccuggaaacaugaagucaauuuuauuagguugaugaacagcaaauccugguauaaggcauucaaauagaagucuaacagcaaacacaaggaccaggcuuauaguuuagugguagaaccuuguuuagcguguucaaaagccccaacuuugauuccuaguacugaggaaacagugugaucaauguaaauuauauauggguuauagaugguauaacaaagccuuuuagcugcuuaguaaaugugugcuaauaaacugcuuaugcacaugacagacuccauucccaugcucacugaguugauagcucauggucauugcaucucuguggauccugaguucuaacucagccccucccaaaccccuuguucuuucuuacuuaaacucccauaguagcccagagcucaucccccugucaaaggaaacaaccaguagcuaacacacaucaucaugaaagcugcuucacgucugccucuccuaagaugacugaccaucuguuccuaauggugaaauuucaagugccaugauggggaguuuucugaacagauggcaacaccaugugacuguagucgcaccacauagagcgaauccagcagagugggccucaucccacuuuaucucacauuuuuaucccauccguuugugugcuuccccccacacacaccuuauuuuuuauaacaccagcacaaauuacucaggcaauuucuuccucucucucucucucucuuucucucucucuuucucucuuuccuuuaaucacuuaugcacacauugcccaagcucuggguauuuggaucccagggugguauaacaaaggcuaacaagcugggugucaaagagagaggucuauuacagucauaaagguccagauccaaucucagggucaccacagccuuauucuguuccucagaacugaguccuuugccuuugacaaguuuccagucucucccugugucucuugccaucuucccucccagaaggacaccucucauacuccauuguagccucaccuaaaacuaacuguaucuaugagaucucagcaugcauuuugaggagaaacaauucaauaauacccuaggaaccauaugcuggucuuuguaaaaauuuuguuuauauaaucuucaggacuauuuuaguuguauuucucguugcuuuggcaaaauaccugauaaaagcaacuuaagggaggcaaaagucugaggggauauagucuguguggcagacagggaaagcaugcagcaggaaugugaaacaggaagcaggaaguggccuggcuauaaggcccccucuaugucagugaggcuccaacuccugaggcucugcaaccuuccucaacagcaccagcagccagcuggggaccugugcucaagcagcuugagccuguuggggagauuucacauucgaacccacauaguaagcuaagcuccccucugccucacaaagacauuuaaaaauuuuuagcacugucuacacgcuuuaauucuucacauaagacagacuacagaagcucugcaggagcaagagcuugcauuuagagaaucugugcauugaauauuucucuugaagagagaaauacuuuaggaggccuauccuucacuuuagaccaacauauauaaacucaccagagugggaggauauaaauuuaaacugacuuguugauuguuuucccccaggggcaccuccuaaaagugaagacgaagauaauggaguauuucuaguucgugauuaaaagucaaaccauuaucuccaucuagggagaggcuucuccguauuaauuaauuacuaccuuuguuucuuauagcauuuuuggaaacuaaaagcuauuucaaugaaguaaaaaaaaaaaaaaaaag

SEQ ID NO: 4463 - RNA, 734 nt, Mus musculus
uaaagcaggauagucuccagugugcuguuccugagaccagcacucucccugguauacucacauuugcccuggaagugggaaagaauaggaaagaaucagagugucccuugaggcuugaguucucagccugagccaaugggcuuccaugaaaguuuguauuuuucauuucacauagaugcuugccauauuuguaacgaauuauagucaaaagaaauccugcacuguccuuuucagguaacgggaauguaugagaguugggugcccaaacuuguggccgcccuguacaagagagaaccugacuccaaugucauuguaguagacugguuguaucgggcccagcaacauuauccagugucagcuggcuacaccaagcuggugggaaaugauguggccagauucaucaacuggauggagguaagauuggaagaaggggcuuucuguaugugggauaaaacucuugguuagagcuagacacauggcugauuuuuauuuuaucuuauugccuuuucucugagaucuaagauguuuucugaaacauuucagauuuucacaagagcauuuuuacauuguggcaaugucuuaguuuggcuuuuauugcugugauagaggcaccaugaccaaggcaacucuuauagcagacaacauuuaacuggggcuggcuuacagguucagagauucaauccauuauuauggcagaaagcaugacagacuggagucagacaugaugcuagagc

SEQ ID NO: 4464 - RNA, 21506 nt, Mus musculus
gggaggcgggcucuuccgggcgccaggcuccaggcuccguuccgaagcugggaaaaugcaagcgguucuuugcguguaacaggaucugugaggggugcacgcgagcuuggaagccacgcuauggugagcaagggaccgcagucuugggagaagugggcugcugagccucggcaucccuuuugguaggcuacccuuggacuggauggaagcuagugggccagauguggaguuguaugaagucccaugcggucucuguaguucccuguaccaaaguggugaccucugaagaacuucacccugugggcagcgucuguguagagcuuuggggacauggugugugcguagaaacaucuuuguagccaacaucaccgugcuucuugugcaucagaggacggcagguugccguuuuaguuuagcuagcaucucuagaauuucuguucuucggauuucacauuuggaguuaauuuuguggguauugugcauggaaucuuauguguugguagcacuccacuauuuugcugagaugauaaugcaaaggauuuaccaaugcuucggagagaauaagucacacagaguagaguuuagcuaaaggugggcugccucugaaacacccaaagauauaguguauuaaugaggucuguaagagaugaagugcuagauacgcauguuuguucaccaggauugucuagacauuuggcuccaaccauaaggaaggagacaacccugaucuuaaacagccgcuagaccgaugcccuuaagaaguggcaggagaccaagaagcugcucaaaggagcagguagggucauguaaccaacauuaaggccuggugugccauaaaaguccuguuuucuucuuaggcaguggcugcuuucuauggauccucuuauauagaugcagccaguuguccuuuuguuagcaagccagacagcaguauggucuucacuguagcagcaucaagaucucggccugccugcugugggccucugcguuuauuaguuauaaggagccgucacaucauuacuacauuaucugcuacacacagcgcugaccugagcuggagagcugaccugagcuagcugcuccucagcuuaacacccagcucaguccucuucuaacuucuuagugugcucucuaugauuucccaccccagcuuuuaucuuuucuccuuuauacuuuuauaaucuuucucagucuggcauauucaccuagggacccugacacugaagaauggucuacuguuccaggauacugguguacuuaagaaauaguccugggaauacuuuguuguguaagccucucuucugccuaaguaaccacuuagcaacuuaaaauuggacucuccugucucuaugugaauuguucagcguguaaccuggggccugacgcagcauauguaggauggaaaauguguccuaggcuggcuccucuuugagcaccagccagugcuguaugcaugcuauucuucaagaauuuuucuucauuaauaccuuacguucaucaaguuauuucucucugggcagacacauuaauucuagaacaccuguaccuccugcagaaaaauguuucugaggcucugucuguuacauuguuucagguagccuugacccuagauacagacaagucuauauguccacaggguauauaucuugcuguccacuugacuaaaauuaaaauucuaaaauucuuaaauuaagggguuauaccaucauagaguuuuaaaaugaccaauuugagucacuuagaccacaagaaucauuuaagcaguaguaaaaggauuuguguguggagcauggucucuacuuucagaccaaaauaggagcaacaguuuauuguauacagugcagggggaaauggggaaggcaauagcuagaucacagacugaaguuuaaggcagucagcuccaguagucccauuaugaagaagguccugauugaaguaggagggugguuuuguaauuuuucgacauguauugauucaugccaugugaacgaagacagaucagauugguggguguacaauuuggggagguuaccuugagccaguugauaucgaauuuccagcuaaggaacucuccuaugcagauaugugcaauccugguugaaauaguuaagccagcucagagguuugagauauaggcccucacugccuguagcugagugugucagguuacagaccccagcagcuaauauuguguacaggagcaaggucaauuauuaauucucccugccccucccucagauccauaacuuuauuugcuuuuaaaaagaaaauuaaagcaguucccgacacuugcuaguggucuuugugucuacacagccugugauuugugaaauagaauagaaaaaaaaaguuaaaauauauuagagcuuugagagggcccuagaucauuuaaugucucauucuguauaugagaaaauuggaacucagagaaguucugggacuuuacuaagacaauauccacuucuucaucacagaauugcuuaguguugaguuugcuaccccaccuuaacucugggaaccugugugcuaccagcccccacccagagaauauuggcucuucggaugaaaaacccaggcacacacacugcucaauuucaacuugccuugucaguugcugggcaucauuuaucuucugaggcaagcgugcccuccccaguacucuugucccaccacccuaaaucuguccucaacuuuaguugcucgguuacuuagcucaauggcugcuagcaucuuuauugaugggucaagaaccaauuaggcaauaggaccuuagcaucagaaccuucucuauagcuuaguguuuuuuaauuucucuaauuaaagaagcaguuauccauugaaacaaugaaaucuacagagagaaaugccucagacauuccagguucucugccccugcuucuuuuuuuuuuuuuuuuuucccgagacaggguuucucuguguagcccuggcuguccuggaacucacucuauagaccaggcuggccucgaacucagaaauucgccugccucuaccucccaagugcugggacuaaaggcgugcgccaccacgcccggcucugccccugcuucuuaauccauaaaggcccagggauauugcuuuguucaucuaucuaucuaucuaucuaucuaucuaucuaucuaucuaucuaucuaucuaucuauuauuuaauuuauguuuaauuuucauuaauuacuuuacuuccccaucagagcuuccacucccuucucuccuucuagucccucccucucaccuuuccuucuucuaugcaccucuuucuuacucuucagagaaggggacaccgcccauggauaucaacccaucuuggcauaucaaguuguaguaggauuggacaucuaaaggcaggcaacagagucagacacagccccugcuccugcuguuagcggucacacaugagcaccaagcuguauaucucuuauaaauguguagggggacuaugucuaucccaucauguuugcuggguggugguucagucucugugauccccuaugugcccagcuuaguugauccuguagguuuucaugugguguucuugaacucuccggcucuuuccuuccucccucucuuccacaagauuuccccaagcucuaccuaauguuuggcuuugggucucagcgucuguuuucaucaucugguaggugaagccacucagaugauuuuuauguuagccucccuucugcaaguauagcagaauaauauuaauagggucaagggugggcucucucaugguaugggacucaaguugggacagucauugguuguccauucccucacuuucugcucccucuuuuaucucugcacuuguuuuggcaagaaaaaagugugggucagugguuuuuggcaagguugguauccccaucccucuguuggaagucuugccugguuacaggaguggaccauuucauguuccauauucccucucgcuaggagucuuagcugugguuacccucauagauuccugggaguuuccauuguccuggauuucuagcuugucacagagauauuccccccaccuucuuccaguucuuuuucccaguccucucucccaguucucucuccagcuauucucucuacacugggacacuccuguucuucccuccacccacucucccacccacuucucuucuuccauccgccucagaggucuguuuuauuucccuuucucagcaacacucaagcguucucccuugagcucuguuuguuacuuugcuucuuugggucuauggguuguagcaugguuagucuuuacuuuauggauauuuauaggucacuacacaccauguuuguuuuucuagucuugguuaccucacucagguugaucuuuuuuaguuccauuccuuuaccugcaaauuuuaugaugucauuguuuuuaauagcugaguaguaguccauuguguaaauuguaccauauuuucuuuauccauuuuucaaugagggacauguggguuguuucuaauuucacaguauuauauauagaucuucuaggaaaauaggugagcagguguccuuguuguaugguggagcaccuuuuggcuauaugcccaggagugguauagcugggucuuaggguagaaauccccccccucugccccccuuuuuuuuugagaacccuguggagguuugaauaugcuuggccugugugaaauaggacuauuaguuggugagauuuuguuggaauauguguauccuuggagaaaguuucucucuguguaugggcuuugagggccccuagugcucaagcuaugcccagugcagaagagaccuuacuccuggcuggcuguggaagauagucuuuuccugucugccuuuguaucaaacuguagaacuuggagcucuuucuccaacaccaccaugucugcauucaugcuaccaugcuuccggaugugaugcuaauggacugaaccucagaaacuguaagccagccaaaugaaauguuuccuauauaaguguuccuuauauaggaaacuuagguauguuuccuauauaaauguugucucuuaacagcaauaaaacccuaacuaaagcugggcagugguggcgcaugccuuuaaucccagcacuugggagucagaggcagacggauuucugaguucaaggccagccuggucuacagagugaguuccaggacagccagggguacacagagaaacucugucucgaaaaaccaaaaaccaaaccaaaccaaaccaaaccaaaccaaaaacccugacuaaggcaacaccaaauugauuuccaaagugauuguacaaguuugcacucccacaagcaauggaaggguucccauugcuccacaucauugacaguauguucugugacuugagauuuucaucuuagcuauucugauggguacaagaugaaauccuagagugguuuugauuuucauuucccugaugacuaaggaugcugaagauuuuucuuauaaugccucucagccauuaaagauuuuucuguugagaauuuucuuuuuagcucugcaccccauuuuaaauuugguuguuugguuuguugguaucuaauuuuuuuuuuuaaagauuuauuuauuuauuauauguaaguacacuguagcugucuucacacacuccauaagagggcgucagaucuuguuacagaugguugugagccaccaugugguugcugggauuugaacucuggaccuucggaagaacagucgggugcucuuacccacugagccaucucaccagcccggugucuaauuucuugaguuguuuguauaguuuggauauuagcccucuguggaguguaggguugguaaagaucuuuucccauguuguagacuacuguuuuguucuuugacaguauccuuugccuuauagaagcuuuucaguuucaugaggccccacuuauuaauuguugaucuuugcgccugagcuguugauguuuuguucaggaaguugucuccuaugacaaugcauucaaagcuguucuccacuuucucuucuaucagauuuaguauauccuguuuuauguugaggcuuuugauccacuuggauuugugcaggguacuauauauggaucuauuugcagucuucuauauucagauaaucuaguuagaccagcaccauuuguugaagaugcuuucuuugguccaugguauaguuugggguucuuuguacaaaaucaauugucaauauguuugagacuuuacuucuggguuuucgauuuauucuauugauaaccuuguuuguuuguuuguuuguuuucgagacaggguuucucuguauagcccuggcuguccuggaacucacucuguacaccaggcugaccucgaacucagaaacccgccugccucugccucccgagugcugggauuaaaggugugcgccaccacgcccggcuccuuguuuguuuuuaugacaauaccauguggauuuuauuacacuuguucuguaauacagauugagaucagggauggugauaccucuagaaguucuuucaucauaaagauuuguuuuagcuauccugggugcuuuguuuuuucauuugaaauucagcauuguucuuucaagcucuguaaagaaugaucuugcaguuuugaugggaauugcauugauguauagauugcuuuuggcgugaugcccauuuuugcucuguuaaucauaccaguccaagaguauaggaauuuuuuccaucuucugaaauguucuucaguuucuuucuuuaaaggcuuaaguucuuguccugaagacuugcuuaguuagaguuacaucaaguuauuuuauaguuuuuguggcuauugugaaauguguuauuucccuaauuuuuucuuuagccuguugauuauuuguauaaagaagucuacuguuuuuuuuguuuguuuguuuguuuuuguuuuuuuuugaguuaauuuuguauccaaccacuuugcugaugguguuuaucaccuguaggaguuccuugguaaaauuuuggggccccuuauguauacuuucauauugucugcaaauagugauauuuugauuucuuccuuuucaauuuuuaucccuuugaucuuuuaguguucuuauugcucuagccaaacuucaaguacuauauugaauagauauggagagaguggacagcuucgucuugccccagauuuuaaggcaauugcuuuaaguuugucuccauuuaguuugauguuagcuauuugcuuucugccuacugccuuuauuuuuagaugcaugccuuguaucuaugaucucuccaagauuuuuuuuuuaucaugaaaggguuuggauuuuuucaaaaguuuuuuuuuuuuguuuuuuuuuuuuuguuuuuuuuuuagcaucuaaugagauaaucaugugugguauuuuuuuauucauuuaauuuauauguugcauugcauugguggauuuucauauguugucccauucuugcauuuguguaaugaagcuuacuggguuauggugggugauuuuuuuuuuuugauguguucuuguaauuagugugcaaauauuuuauuuacuguuuuugcaugaauguucguaaaugagauuggucugaaauucuccuucauugugacuuuuugugguuuagcuguuguaguaaacauuauuuggggguuucuaccccaccuuagaucauuuaguucccauguaaaagaugcaaaacuuuucuauuuauauuaagccuuaaggcacuacgacugagcagauaucaacucucuaucuuauuuugucuauuucccuuucaguauuccugagauaucacuugccauguuuuguugcuccuacuccaaguggcagccaucauggccuugugcucaauauucaccuaugccauggugccuuguuccuucuucuccucucucucccucaucgacucugucucaggccccaaguccaggaaccaaacccugucuaccucuuuucugcccugcuguaggcaucuuuuugaugaaucuuggauaacuuucagggcaagguuuauaccacaaaagcugguauucauauggaucucauugucuugaggcaauuagaccuugggauagggaauuuagcauuacaauacauaccaauacaccaaaccuuaccauugagauaucagagugucuguggccuccuagaaugaauuuggcaguguuccuucuguuucuuuuucuucuuuucuuuucaaauauuuuauuuauauauuuauuuauauuacuuuuuuauuuauaucccaaauguugcaacccuguccauuucccccucccagaguuccccucucuuugcuucugagagggugccccacgauaucucccuucucgaacauccuguccuauuggggccagacuaagcagucaguucucugcuaccuacgugccuggggccuuggaccagccaguguaugcucuuuguuugguggcuuaguuucugaacacucagggguccaguuuaguugauacuguugguauuuaugugggguggcuauccccuucagcuccuucaaucauuccucugucucuuccauagggauuccaaccuccauccaaugauuggcuguaagugucugcaucugucucagucagcugcugguagagccucucagaggacuccugucugcaaguucaacaugacaucaguaauaguguauggguuugaugcccacccauggcauggaucccaaguugggccaguaacuaacuggucagccauuccuucaguaucuacuccauuuuugucccuguaauucuuuagacaggaacaauucaaacuaagacaauauucaaacuacaaaaaucagaaaugaaaaggucuucaaaaaccuauacuguacaaaguuugaaaaucuaaauggaaugaaugauuuucuuccuagauuccacuuaccaaagcuaaaucaugaugcgguaaacaauuuaaauagauccauaaaacuaaggaacuagaagcagccauuaaaagucucccacccaaaacaaaaagcccaggaccaaaugguuuuagcacagaauucuacaagaccuuuaaagaagaaugaauaccaguacuuuucaaaucaucccacaaaauagaaacagaaggaucauugccaaaccugguguacuggcugguuuugugucaacuugacacaacuggaguuaucacagagaaaggagcuucaguugaggaaaugccuccaugagauccaacuguaaggcauuuccucaauuagugggaaaggccccuugagggugggaccuucucugagcugguagucuuggguucuauaagagagcaggcugagcaagccaggggaagcaagccaguaaggaacgacccuccauggacucugcaucagcuccugcuuccugaccugcuugaguuccaguccugacuuccuuggugaugaaccccaguguggaaguguaagcugaauaagcccuuuccuccccaauuugcuucuuggacaugauguuugugcaggaauagaaacauuaagacacauauccuaugacgccacagucuaucaguauuguauuaaugacagucucucuacaaaggaaggaucuacucuuuuucgagguccuuuucaguuauuuuuaccuuuuuuuuuuuuuuuuuuuuuugaggcaggguuucucuguguaacccuggcuguccuggaacucacucuguagaccaggcuggccucgaacucagaaaucugcuugccucugccucucaagugcugggauuaaaggcaugcgcuaccacugccuggcuauuuuuaccuuuaaaaaaaaaauuauguguaucaucuuuuaaauuucauuugcucuaaauaugucacuuuuguaaucuuugucuguuucuacucuccaauguuuccuggucauuaagaauuuuauucuguguuucucuuuuuuuuuuuuuuuuuuuuuuuugcggggggggggggggggaguguucgagacaggguuucucuguguagcccuggcuguccuggaacucacuuuguagaccaggcuggccucgaacucagaaauccgccugccucugccuccugagugcugggauuaaaggcaugcgccaccacgcccagcuuauucuguguuucucaagagcuauuuauuuauuuauuuauuauuuagaacaaugucuccuguagcucaggcuagucucagacuauguaguugcaaauugcuuuccacaccuaauucugccugugcugccuagugcuugaaaggcaguccugcaacuccuuccaggccggucaguaagacugaaaaagagaccagugagugguuguccucugcccucccugacuuuuauuggggaacggcaaaugaagagggaccuguguaagaauuuuguucacugacccucuuuggaacugguguagucacagcacagaagcgggaggguaggaaggaagguaggagcuuuccagcuuugguagcagauaacucagguaaucaauuuuagaugaucaauaaaaguccugaaggccauuucuuggguccacagaccaggcgcucaagaaucuaaaaaaugaacagaauuuuguucuagaaaccaaauucuuguaguuauauuaguucaaccaauauagaagauguggacaaacugacauggccgugucugacaggaguguugcuuuucuuggcugcaaauggagauccugagagagaaggugugagugauccuagguguggucuucuacagacugcuugucccuggugcauguggggacauaaagcugguuuccacuuuaaagaaauuuuuuuugauauucuaauuauaucauuuccuaauucuuuuuccuuucucuaauauauuccucuguguauugaauuucaucuccuuuuuuugguuuaauuguuguuacuguuuaaauuugaccuguguuuggcuguaggacuucucagcugugagacacagaaauggcuccacuggacauugaguguguaauggaccagacacaaaagggaucucaugucuuggaagaggaacaggcaguguuugugagacugaaagaguuucuucuaaaaugccaauuuuccagacuagggcccagucugcccgcugccugauuaacuugacuucuguucacccaggggaaucuacuacuguccugagacccagcuggguagcccuagcuaaugagcaacuauggggaggccuagcaaucagaagcaccaguggaagguaguuugugggcuccuuucaggauucuccuuuggugcugcuauaggcagcugugaagccaaccagccauaccauggagacuguggggaucacuguccccaguuaggggggagcaaaccagcugaucugucagaucagggacugggacugggauggacugugaaccagacuaugguucuauuuguccauaugacaaccugagcaguggucugaccuaugaaccuuccugagaguggauucccugggggaaagacaggcucugcagccacagcuaugggaugcugugguccuuguaacacauaagcauugauuuuggugucgugggaauacagauuugaacacugaaaguccaguuucuagaaguuuugaguauugcauuccacuuucauuacaaauaguuuggaaguugguaggagagacuugaugauccuuuagcaagacuugauuaggauccuagggcugcuggagccauggcuuauugguuaagagcaguugaugcauuuucagaaaaccagaguucauuucccaggaccuauaucaugcggcucacaacaggaucugguuuacucuuaccuccuuugguacacacacacacacacacacacacacacacaccauagauacauacacauauacacauaaauacaaacauuaaaaagcuuggggaugguggugcacaccuuuaaucccagcacuuaggagguagaggcaggcugaguucaaggccagccuggucuacagaaugaguuucaggacaguuccaggauuacauggagaccccuacccccacccuaaaaaaaaaaaaaaaaaaacccuagaaaacaaaugacugaguaaauaaaauaaaauaaaaaauaguucuuacuuucugugauuuagagaaauucaguuccaagggugaaaaacaguuucuaagcugcagagguuucucagguaugcacugguuugaguggguggaugagacagauucuacauuugugccauagcccauguggcaggaguagacauuacauuuucuucuaugucauuuugggugugggcuuuagugggucuguguuuacccgaaaccacaagggaaccuaagggguugcagagucauagcaggccuuucugauuauguccauuuccagacaguacucuagagcaugggaccuuucuguuuggaagcaauagcagucacuggagagucaagaccauaacaguuuaggggucacuuuaaguuaauuuugugggaguuguaaagucuuuguuuaaugucuucaucuucuuuuucuuuauucucucauacaauacacccugaccaaagccucuccuuccuucaguccuuuaagcacccugucccauuuuugcucuccacuguguccacuuuuucuccuuuuuccuucagaaaaaaaaagguuucccacugauaucaacuagauaagauauaacaagaugcaauaaaacuaggcauaaaccaaguuaaguugcacaaggccacccaguaggagaaaaaggguugcaugaguggacaaagauucagagagaccuccaccccuauacaaaccccaagugaacaaccacagcauguacgcagagggccuagcacagacccaagcaggcaccauaaucgucguuuugucuccuugagccccuaugggccauccuuacuuucuucucuucuggguucuuauggugucuucaacaccugugguuccaaccguucuuccuucucucuuccccuggguuccuggaacucugccuaauguuugaauguggguaucugcauuuguucccauuagcugcuggagcaagccucucuguugacuauugagcuaggcagcaucuaugaauauagcaggauaucauuaggaauaauuaaauugaaaacaauugaaucagucacauuuggcucaaccuuagaucucugagccauccaccuggccauccaggcagugucgugcauggacuuccuuucguggcuuggaucucaaguuaggucaagcauugguuggccaaacccacaagcucugagccaccagcacaucuugcaggcaaguugugggucgaaggguuuuuuggcugaguuggugucucagucccaccaggggaagccugcccugauuagaggugauccuuuauuuagguuucauauccuccguuucuaugagacauugagacaucaccuucauagguuccaggaaaguuccacugcccuggguuuccgcauuggcccaugcccauaaaaguccagcuauuccaguagucucuccucaaacucacucuguccagcccucccuuccccauccauucacccuguucccauccgcacacugcacuccucauccuaguccacucaagaaaaaucuguucuauuuccaguuuggaaggagauccuugcccauccccaccccacccuucuuauuacuuagucucucuuaguucauggauuacagugugauuagccuucacuuaauagcuaauaucuaauuuucagugaauauauacuauguuugucuuucugagucuggguuaccacacucaagaugauguuuucucauuucaugcauuugccugcaaauuuuaugacccuguuuuuuuucuaacaguugacuaauaauauacuauuguuuaaauauaccacauuuucuuuaaucauucuuccacugagggaugucuagaaucuuuuuacuuucuggcuacuauguauaaauagucuauaaauauaauugauaaaguguccuuguguuaagauagagcgucuuuuuugguauaugcccaagagugguauaccugugucuugaagucuugauucccaacuuucugagguaccaccauaucacuuuccauaguggcugucaaguuuguucucccaacaggaauggguuaguuuucuccuuguuuuacauccuugccagugugagcugucacuuauucuguugaucuuagccauucuaacaguuguaagguggaaucucauaauggaauugauuugaauuucccugaagauguugaagauuucuuuaaguguuuguuagccauuugugauuccacuauugaggauucucuguuuagacccguaccguauuuuguacuugaauuguuugguuuguugauguuuagcuuguugaguucuuuauauauuuugguuauaguccucagugagauguggaguugguaaaaucuuuucucauuguccaggucaguuuuguccuacugaaguuguccuuugugcuagagaugcuuuuuaguaucauuagguccaauucauuaauuguugaucuuagugcuagcacgguugguguucuguuuaggaaguugucuugugugugaaugucucaaaggauauuccuuauccucucuuccaucaggcucaguguugaucuucuuauguugggauuuaugguucauuugaaguuguuuugcacagggugauuaauauaaauguacucauacucccauaugcauagccaguuaggccaguuccauuuguugaagaugcguucuuuucucuauuguaucuuuccagcuuauuuaucaaaaauuaaauguccauagguauguggauuuaugugugagucuuugauuugcuugcauugauggaugucauuuuuaaugcuaauacuaugacauuuuuauuacuauaucucugcaguacaacuugauaucagggauggugauaccuccagaauuccuguuauuguucaggaugagguuuaggucucuugaguuuuuuauuauaccauauuaaauuaagcauuguccuuucaaggucugaaaauaauugugcuggaauguaaugggacuuauguugaaucuguacauugcuuuugguagaauguccauuuuuacuauguuaauucuaccaaugcuugaguguggggacaucuuucauuuuugauauuuucuucaaagacuuuuaaguucuugucaaacaagucuuuuacuggcuuguggucaguuaccccaacauauuuuauauuauuugugguuacugugaaguguucuuuucuguaauguucuucucugcccaugucauucauauauaggagagcugugauuuuauuuuauuuuaucuuauugagguaauuuuguauucggccauuuugcuggagguguuuaucaacugguagaauuuuugguacugcuuaucuguacuauaucaucuccaaauaaugguacuuaacuaauuucuuucuaauuuguauuccuuugaucuccauuaguugucuuauugcucuagcuagaauuucaaguacuauuuugaauagauauggauagaguagacaaccuuggguguuuuuuuuuuuuucuuuuaaugauauuuguaaagugucuuugaauuucucuccauuuaauuuguuguuggcuauaggcuuuuuguaaauugccuuuauuaugugcagguauauacacauaauaucaccuguauuacuagucucugaacacuuuuauuuugaagaggcauugaauuuugacaaaggccuuuucagugucuaaugagauggucaggugauuuuuuucuuucauguguaauaauucuuuucuuuuaugugguggaauauauugauugauuuucuuucuuccuuucuuccuuucuuucuuucuuucuuucuuucuuucuuucuuucuuucuuucuuucuuucuuucuuucuuucuuucuuucucucuuucucucucucuuucucucuuucucucuuucucucuuucucucuuucucucuuucucucuuucucucuuucucucuuucucucuuucucucuuucuuucuuuuaauguugaacaauccuugcaugucuuggagaaagcugacuuugucauuuguacguuuuuuauuuuuuuagugauucugagucucuugccuguaagcauggaugcccaucacauguuuuguguauggugcuaacaguagucacaggauggccucagaaccucugaacuugggauuauugauuguugugagcccucauguacacacugacacuugaacccaucucaucuguaagaccaugugcuguuaguuccucuuuccuugcucuugcccugugugcuuuuuaaggucuauauauacauugcuuauauuuucaccuguccaucuuuaucuguuuuaacaggcauucucuucuaguaacuuuuucuuaaucauacagcuuaaauagugacacucaauuuacuagaagauaaauacauaacuggaguguaugcauaaguuuuuguaagaaguucauugagaccuucagaguuuuugcauguauuuuguuuaugugguuguuuuuugggguggugguggugguggcagguucuuuuuuuuggggggggggaacccaaaucuuuauuguauagaaauacacacacacacacacacacacacacacacacacacacacacacaauccaagaugcuauucucucauuuccccaucuuccucuucuucuucaacgccucugauguagaggacauuauuacaccuuauucgaacuuugcccagauguccagacaaugccccauguauguauucuucaguauuugcgagcugcauguucauguagccauccagggagaccagguagcccuguacuccaugccccacuuaaguuucaccuucacuggcuuuccugucagugcauugagaaaagacuugggauugagggguaaacucauugcggccaccggugagcguugcaccccgcuagcuaccgacccugccgcugcccaccccucgaucggagcggcugccucuacacccagguggcagguucuuaauauuuaccucaagcaguccugaaaaucauuacauaggcuuaggcuggucuccaguucaaugagauuaauguaccucuaccuccugggugguacaauuaaaggugugagccaauacacccagcuugccuaucuuuuuuugcaguuagucaucauucagaccauuucuccgauauguguaguauugaucugucuaucucugacuauauggcuguuaauaggccuuucuccugcaaguuuauauccuguuuaaagggcccagaaaugacagggguggaccuccuuuucaauuuccuucuaaaaugacuuggugauuacauuagaacuucugugucauggaguaaguguggaaaucaccagaguuauaugaaucuauuguuaaagaaauauauauuuuacacguugucagcacuaugcuuucuguugaacccaugcauuauggauauuuuaggacgcacugacauaugaugauguccacauuaauuucacuccggaagagugggccuugcuggaucauacccagaggaaucucuacacagaugucaugcuggagaccuacaagaaccucguugcuauagguaagacugugaaguuuaauuugcuuuuuaaaagaugaggaaagguguuucuugguuauugagcucuucuuuauuuucauugugaaagaggaacagugugguaaauaaaucaggcaugguucuaagguucauugaggagaguaacuuaacuuuucgucaguuuucaaccauauaucauacauuuucugguaauauauuuuagguuacaaaccagaagacaaaauuauugaacaucuucaaaauuuuagaauaccuggaagguaagugucauguucaagcugauauaaauaugccuuugaagaaauuugaauguccccuagaaguuuuaagagaacucaguguagacaagcacagcuuuaaguguauugaugguuaguaaauucucacaacaccacgaaccucaauguuagguagucggaaaaagcacaaggaaacaaugacuuaacagcuauuacauuuuaguuauauccccaugagaacugcucuauagaacugccaauugauuuagguugaugccacucaguuauugcaaaggacauauacauagauuagaugacaaguauaugucuaaaaucuccuaauaggcaaauauuccacaauaaaucccauauuacucauauacguuuaaugauuuaccaaaguuuagugagagggguaauuuaugagauucaugaagguuaugguagagaaaacuuuauccucauauuaugucacugugauaaacaaacaguuaaacugaaugaaugcaguguggaaaucuuuuauuuuuuauucuugccauaauugauaugugucacauuagauaaaagccaugugagcauccugaauauggaagguaccucuuucucccacaacaauuagaagauuugcaguuguccccacuuugaguagauugugaaagugauaugaguuuacaauuaauuguauauccaauuucauugguaauauguaaauacauucacacugcagaaaagccuuugaguaaaagaaaauggaaauucuucuauuuauccugguucacuuugcaaauguaaugugacucacuuuauagcaaaacgaugaguucuaucacugaggcaaagcucugaguucuuccaguucucuuaaaaauauggagaaacucacaugagaaaaggauguuauaaagacgaaccaugugcuaaaagcuuuaaccaccacagguaucuucaaauacacaaaagaaaccauaauaaaauacaaacuuaugaauucaaacaagugauaaaaccuuaagauuugauuccuuuuuagaguaaacuagacaaaauuguuaaauuaaaucauacaaauaaaaagauucaucucuguaaucaaugugguaaaguguuuacacauguuaauugucuucacaggcauaaaggaagucuuaccagagagaaacccuaugaauauacucaaugugguaaagccucuacacgucacauuggucuucaaaggcaugaaagaauucauacuggagagaaaccuuauaaauguaaucaaugugguaaagccuuuguagauuacuguacucuucaaaaacaugaacgaacacauacuggagagaaagccuaugaauguaaugaaugugguaaaggcuuuacacaacaagcuuaccuccaaaaccauaaaagaacacacacuggagagaaacccuacgaauguuaugaaugugguaaaggauuugcacauuacucuacucuucggaaacaugguucuacacauacuggagagaaacccuaugaauguaaugaaugugguaaagccuuugcacaacagagucaucuccaaaaccauaaaagaacacauacuggagagaaacccuaugaauguaaugagugugguaaagccuuuucacaacacaguagucuccaaaaccauaaaagaacacauacuggagagaaacccuaugaauguaaugaaugugguaaagcuuuuucacaauacaguaaucuccgaaagcauaaaagaacacauacuggggagaaacccuaugaauguaaugagugugguaaagccuuuucacaacauaguagucuccaacaacauaaaagaacacauacuggagagauaccuuaugaauguaaugaaugugguaaagccuuuucacaacauaguagucuccaaaugcauaaaagaacacauacuggagagaaacccuacgaaugcaagcaaugugguaaagccuuuucacaacacaguagucuucgaaagcauaagagaacacauacuggacagaagcccuaugaauguagucaaugugguaaagccuuuucacgacacaguagucuccaacaacauaaaagaacacauacuggagagaaaccuuaugaauguaaugagugugguaaagccuuuacacaacagggucaucuccagaaacauaaaagaacacauacuggagagaagcccuaugaauguaaucagugugguaaagccuuuucggaacccagcagucuccaaaugcauaaaagaacacauaauggagagaaacucgauguaugcaauuaauguguuaaagccuuugcaauuuucuguacuuuucagaauaaugaaauaaaucauacuggagagaaacccuauaaauguagccaaugugguaaagccuuugcuguucacaauuauuuccaaauacauagaggaacacauucuggagagaaaucuuaugaguguagucagugugguaaaaagcauuugcacauuacuguacacguugaaaacaugaagguguacuuacuguagagaaacccuaugaaugcaagcaaugagguaaagccuuuucacgacagagucaucuccagaaacaugaaauaaaacauagucuagagaaacuguaucaauguagucagugagauagauaaagccuuugcacaacagaguuaucuucaaauacacagaaaaacauauauugaagagaaacccuauguaagaaguguaguaaagccuuuucacaugguaguuaucuaauaccuaaaaggacacucaccagauagaaacccugcaaacauagucagugugaggaagccuuuucacaauaguagccucuaaauuaaagguaacaacagcaacaacaaaaaaacauacuggagauuuauucugaauguaagcaauguggaaaagccuuugcauauuacaauuauuucugaaaacacaauacauacuggagaguaaacuuaugaauguaauugcuguguuaauaccuuuguguaucauucucugaggacaugaacccauacugaagggaaucugggacuauaaaguauuugguaagauuguuagccagcccaguugcauuuaauacacaagaucauuuuauucugggggaaaaagucugacaaguguccacaaucucuuuaagccuuuugccuaucuguauuuuguuugcaccuacaaacucauagauaaaagcccucugaauuuacacuauuagguagcaacauuuagauuucauucaccucuucaauuacaucaaauaaguuauuuaaguguaaaacuuuaugggucugucuuaguaacuuuucugaugcugugauauaacaucuuugguaacuuaucaaacacuuuauuugggcucauggcaccagagauguaugggauuaccaucaacauggcauggcaacaagugggaaacauggcaguaaagcaggaaguuuaaagcucgcauucaagugcugugacauguuuccuccagguggggugucauuuacugaaucuuucccauugagaaggguugguuuucugaauuccagcucaaauccuuuccuuuugggaaguuaaccuuuucaugaagaagaaaaacccuggaaaugagccuuuaggugccucaucaucugggcuauaccaaugaaggcuuagaggagaaaaacagucaugagugcaaauuguauuuguuuagugauuuguuuaaaauuuaauuaugcauuguuagugugucuuucugugaguacaugugugugucugcugguuuccaagaaaguuagacucuuguauauuuuuguaccaaagauuucaggaaguugucaagaacuugaccuuggaacauggaauaaacauguuuuaacuacuuagccaug

SEQ ID NO: 4465 - RNA, 430 nt, Mus musculus
cuuaaaacccaugacccuucaguugaucuuccucagccaguccaaucucuaucaggagcuggcauaugcucuugcgcuggucacccuguggcugaauuacuucuccauuuucuucuggaugcucaauuacaguaccauugcaagcaaauuucuucuuaaacgccuucacuaguuucuuuuuaucguacucaucagugaucaguuguaagggucuuccugucguuucucuuuugaauucuuauauggauauaauccucagagccagcaggaagcaggucaucacccuuacuugcaucagcaaaggggucgaaagaguggagguucuggauagcggacauacgaaaagauuccuuuuccucggcggaaauggccugcggaaggcggcugcgggagaaggcgggcgugggggacguagcuucgggaagcaaga

SEQ ID NO: 4466 - RNA, 25663 nt, Mus musculus
ggcgggcucuuccgggcgccgugcucucggcucuuuucugaagugguguaggagcuggcgguucugugccucugcugagagccgagaaaaguacucgcgcaagcuuggaggccaagcuauggugagccaggggcgacugucuggggacgagugggcugcugagcgucgggaagccguguggugggcccucccucggucugagucggagcuaguggccagacguagcgcggugagguccuuugugguauuuguaauuuggaacugccaggcucccuguggaggccccugaauaauuucacucugugggcugcaucugugcacagccuugggaacagggguuguguguaggggcuguguuguacauagauagcuucacuaugcuuuuggagcaucagcggcuggcugguugccaaauucaggaaaauucuaguuucucuagcacuucuagaauuugugcacuuccuauugaacuuuuaggaguacgacccauuuggaguuaauuuugugaguguuguaaauggaaucucauguauggaguagcacuugacuaagcugugauguugaagaguagaauuugagacguaaaggauuuaccaaugcuuaagaagucacacaaaguagaauuuagcuaagggagggcuaccucucuaacacccccccccccgccccaaauacacaguaugcuaaccagguuuguuagacauggugcuaugauacauguuuguucaucaggauugucuagacauuuggcuccaaucauaauagaggagacaacucugauucacaacccaccacuagucuaaugccuauauuaaagggcaugugucucacaagcugcucaaagggacauuacagugucacaaccaacauuaaggccuaguguuacauaaagguccaauuggcauaguucuugccagaaaggcaagaagaccuugcgugacagcuauuugaaaaaaacaaaaaaaaacaaaaaacaaacaaacaccuuuguauugagggcuggccugaucaagcaaggcguucccugagguucucauauggagaaggaacguagcauagcuccuucucaagccaggaacgugcuuggcagauccaguaacagccuugggagcuuucccuauggcucugagguauagagaauaaaugaagcaccuucuccaaaaacaggcauaugcuugagaguuggucauggucuggggccagggccuuggagcaggguuucuucuguucuugagaacccaagucuucccaccaaugaacugugguuaucagucagucccauggccacugugggcuuugugaguaaaggucuugagauucccuugugcagcggcacugucugauuaaccuccuucuguguuuguaccauuguaugacuguuucuguugucuucauagaagcagcccccauuuccuuccauuuuccuccuggaaguaguauacaagauguucuucuuaagggguugccugacuuagcuugggcaagacuuccccaccccagcuuuuaccuugucuuccuuuuacuuucacaguauuucucaucuacaacuggaccuggucacuccagaaugaucugcuguuccaggauacugguguacuuaagaaauaguccuggggguaucuuugcuguauaaaucuuccaucugccucagugguuagacuugcagucuccugucccuauuuaaauuguucaaaguauaaccuggggccugacccagcauguauagaaugcaaacucuguucuaggcugguuccucuuugagcauucuccagagcuaggugcaugcuauucuuaagaauuuuuccuucauuaaugccuuaaguucauguaguuauuucuccuagggaaggcauauucauucuagaacaggugcaaccuaaccaaaaaaaaaaaauguuucugaggcucuauuauauugccucagauggucuugauccucaucuguagcuccacagagcaauugccuugcucuccaccugauuaaaauaaaaauuccuaaauucuuaaauuaaagagcugucucaaugcagaggguuuguugguugguugguggauuuggguuuuuuuuuuucuuuuuuauucaugaaaauagucauuucacucaacaaggacucauacacagcauuuauguacaguguauagcuuuagcaaaacagucaauggcaaacaaaagcaauaacauuaauuaaaaccuugaaacaaagcaaaugaaaaucccaaagaaaacaauauccaagcuagaaaauugauuuaaaaauugauuaaaagauuguuugauuguggcaagaccuaugugcucugucuggccuucaguacagacuguaauagccuaucaagucuagggcuggcaugucucuaggggcuuugaaaauaaagcccucccaaggucaaggaugagacagucucaggcuuuugucuuucuaauucucuuuacucaucucuacuaaaguaucucugaugguaauccuugaugugcuuuuacauaguuuguuaguuguuggagcacauaaugccauaaaguugguuuucauuuaaacuauaauuuuugaaauuauaauuacaucauuucuaaauucuguuuccucccucccauauauuccucuuuguauucgauuucauggacucuuuuugucuuuugggaaaaauuuuuuuaaauuuaauuuucauuuguuuuuauuaauuuauuuuuucauucacuuugcaucccaguaucagaccucuuugccaguucugcaucacaaagauccccccauccccuucuucucuaagaaggggggucucccuugggucuuauguccuaucccuccccucauccccccuugucaagucacugcaggacuaggcauauccucuccuacugaggccagacaagucagcccagcuaggggaacaggaucuauaggcauuaggaacagcuccccuuuacuuguugggagaccuguaugaagaccacacuacacugcugcagggugucuaggucuagccuaugaucccucuuugguuggugguucagucucuggaagccccaaagauuccagauuaguugacucugauggccuucuuuggagucccuguccucuuuggguccuucaauccuucccacaacucuuccacaaaaacccuccagcuccaucuaauguuuggcuguggguaucugcauacgcuuuggucagcuguuccgugaagccucucugaggacaguugugcuaggauccugucugcaagcauaagagaauaucauuaauagugucagggacuggaccaugggguggaucucaguuauggccagucauugguuggccaauccaucuuucucugcucuaugucccugcauuucuuguaggcaggacacauucuuuuccucuuuucuuuuuauuggauauuuuaucuauuuucauuucaaauauuaucccguuucccgguuuccccucauuugagacaaagauuuuuauggauuguuuggugucccuaucccuccucugggaguacuaccuugcuacaggaaguggccucuucagguucauaucccccacugcaaggugucuuagcuagagucgccccaaaacauucaguuccuaccaccaggucuuuagcauguccuaaaaaugcuucccuaugcuucucccauggauuucuguucucuuuccucugcucuccuacucaugaugccccuucugcaccuucccuuuucuaccuacuuccuccccuccaccuucgauaucuauuuuauuucccguuuugagaaggauugaaccauucuccuuugacccuccuugguauuuugcuucuuugguucuguggauuuuaguguaauuauccuuuacuuuaggacuacuauccacuuauaacuggggacauaccaugcuugucuguuuggguuugaauuacuucacucaggaugauauuuccuagugucaugcauuugccugcaaauucaaugauauccuuguauuuaauaugguguaaauguaccacauuuucuuuauccauuguucaguugaggggcaaaaauguugauuccaguuuauagcuacugugaauaaagcugcuaugaacauaguugagcaaguguuuuugugguauagugcagcaucuuuugggcauaugcccaggaaugguauggccaaguauagaaguagaacuauucccaacuaucuaaucgccaaauugauuuccagagugguuuuaaaaguuuacacuaccaccagaaauggaggcauugcucccuuugcugcacauccucaugaguaugagcugucuguugaguuuuugaucugagccauucugguuugcauuuuuguuuuguuuuguuuuguuuuguuugaugauuaaggacuuugaacguuucuuucaguguuucucagcuauuugagauucaucuguugagaauucucuguuagcucuuuagcccuuuuuuuuuuuccgguuuuucgagacaggguuucucuguuuggcccuggcuguccuggaacucacucuauagaccaggcuggccucuaucucagaaauccgccugccucugccucugccucugccucugccucccaagugcuggaauuaaaggcgugcgccaccaccgcccagcuaccccauuuuuuaaaauugauuuauuuggguuguuggugucuaacuuccugaguuccuuauaugucuuggauauuagcccucugucaaauuauggguuggugaagaucuuuucccacuuuuuaggcagucauuuugucucauugaggguguccuuugauuuacaggagcuuuucaguuccuugaggucccauuucuuaauuguugaucuuagugccugaaccauugguauucuguucaggaaguugucuccuagaccaaugaguucaagguuauucccuacuuucuguucuauuucauguaucugguuuuauguugaggucuuucauccacuuagacuugaguuuugugaaggggauaaguauggauccauuugaauucuucuacaugcagacuuccaguuagcacaaguuguucaaauugcuuucccuuuuccauuuugugguuuuggcuuuauuguuguuguuguuauuauuauuauuauucagaaaucaagugucaguagguauguggguuucuaucugggucuuugauucgauucuauugaucaaccugaguguuucuauaccaguaccaugcacuguuuauuccuauugcuguguaguacagcuugaagucaaagauuauuauaccuccagaaguucuuucauuguucaggauuguuucggcuuuucuuguuuuuuguuugcuugcuuguuuguuguuuuuccauaugaaguugagaauuguucuuuuaaaaucuguaaagaauuguguugaaauuuugaugggacuuguaaugaaucuguagauugcuuuugauaagauggucaguuuuacuauaugaauccuaaggauccuuggccucuuuuucauugaaucauuguuauuguuugaauuugaucuaaaugugucugcagaacuucccagcugucuggccaaggauggcucuauugcacauugaguaugaaauggaaagugcacacaagaguccccaugucuugggagaguaacaggaagugcucugggagacuagaugauuuuuauacuaaaauacaaauuuuccagacugggccuuugucauccuuuagggugaaaggauagaacuaggaaggucuguguugucugaaucauuugaucucuacucacccaguaggggagaugcugccuagcuaggugucucuaguuaaugagagauucugagaaggccugccagaaagaaacaccaguggaagguagcuuguggguuccuuccaguauucuccuuugguacugcuguggggagcuguguuggggaauaucauccguacaauggugagucuggggaccacucuccccaguucaggggaaaucaagcugagaugucagugcuugugagccugggauggacagugauccaaacugugguucuguugguccaugugccaaccugagcaguggcccuuggcaucugugccucccugaguguugauugccuauggagaaggaggcucuaugacccuggcuaugggaugaugccgugcuuguaaaaccacuauccugugugcacacaugcguauugcucuuuugguguguggugggaagacagauuagaaaacugaaggucugguuucuagaaguucagaauguugcauuccacuuucagguuugucuuacaaauuuuacaaauaguuuagaaacugguagaaaagccaucaugaggccaucauucagcaacuugauuagaauccuaggccuggagagauggcuuagugguuaagagcacuugaugaucuuccaaaggaccagauuucaguucccaggacccauaucauguggcucacaacuguuugcaacuccaccuccagaggacugauaaucuguucuuaccucacuggguacacucucacacacucucacacacacucacacauacacacacacacacacacacacacacacacacacacacacacacacaacauagucacagagaaauacacacacacaguuuuuaaaaauccuaaaaucuugguggugacucaugcuuuuagucccagaacucaggaggcugaggcaggcauauuucugaguucaaggccaaucuuuuauucuuagcuaaugucuaucuuugauguugaaggguauuucuuguguacagcagaaggauggauccugguuucacauucauucugcuagucugagucuuuuauugggaaauugaggccauauauguugagagauaucaaugacacgugguugucaauuccuguuuuuauuguuggaagugguagcugugggguguguguggguaugggugugugugugcuuuccuuauuuagguuuugcugaugugagauuauuuauucucuguguuuucauggaugggguuaacuucguugguuuggaguuuucauaacaccuucuauaggacuggauuuguagauagauguuguuuaaauuagacauuauuguggaauaucuuuuugucucuguuaaaacgcuugauuaaaaguuuugcuugguguaguaaucuuggcuggcaucuguggucuccuuagagucuguaguauaucuguccaagccuauuugugcuauagagucucaguuacgaagucauacuuggucucuuccccuugaagcuuuuuuuuuuaaugauuaaauauuuucuuuauuuacauuucaauuuuaucaacuuuccucauuuccccuccgaaccccacccuaagcuaucccaccuucuccugauuacuaacccacccacucccacuucccuguccuggcauuccccuacacuagagaauugagccuucacaagaccaaggaccucucuucucauugaugucucacaaggccauccuucugcuacauauguggcugaagccuugagucccuccauauguauucuuugguuggugguuuucagucccugggagcucugggggcuacugguuggucaauauuauaguuccuccuauggggcuacaaacgccuucagcuccuugggaccuuucucuaacuccuccauuggggacccuguacucaguccaauggcugugagcauccaccucuguucuguauuuguuaggcacuggcagagccucucaguggacaacuauaucagguuccugucaggaagcacuuacuggcauccacaauagugacuggguuugguaacuguauaugggaugaguccucaggugggacagucacuggauggccuuuccuucauuuucugcuccaaacuuugucucuguaucuccucccauggguauuuugaacccccuucuaagaaggacggaaguauccacucuguggucuuccuuuuucuugagcuucauuugaccugugaauuguaucuuggguauucugaacuucugggcuaauauccacuuaucagugagugcauaucaugugugguuuuuugugauugggugaccucacucaggaugguauuuucuaauuccauccauuugccuaagaacuucaugaguucaucguuuuuaaaaggugaguaguacuccauuguguaaauguaccacauuuucuguauccauuccucuguuaaggguucuuucuagcuucuggcuauuacaaauaaggcugcuaugaacauagugaagcauguguccuuauuacauguuggagcaucuuuuggguauaugcccaguagugguauagcuggguguugagguuucccacuauuauugugugaggugcaauaucugcuuugaacuuuagcaaagguucuuucuuuucuuuucuuuucuuuuuuuguuuuguuuuguuuguuguugguuuguuuuguuugguuggguuuuuggguuuuugggggguuuuuugguuuuuuuguuugauuuuuuuuuuuuuuuuuuuuuuuuuuuuuugguuuuucgauacagaauuucucuguguagcucuggcuguccuggaacucacucuguagaccaggcuggccuugaacucagagauuugccugccucugccucccaguuaauggcaugugucaccauugcccagcagcaaaguuucuuuuaugaauguucauccccuugcauuuggagcauagauguucagaauugagaguuccucuugguagauuuuaccuuugauggguaugaaguguuccccccccccuuaucuuuuuagauaacuuuagguugaaauucaauuuuauuugauauuagaauggcuacuccagcuuguuccucgggaccauuugcuuagaaaaauuguuuuccagccuuuuauucugagguagugucugucuuugucacugagcugggcuuccuguaugcagcaaaauguugggucuuguuuacuuauccagucuguuagucuauguguuuuuuugaggaauugaguccauugauauuaagagauauuaaggaaaggugauuguugcuucacguuauuuuuguuguuauagguggaguuauguuuauguggcuaucuucuuuuugguuuauuaaaagaagauuauuuucuugcuauuucuaggaaguaguuuauccuuuuguguuggaguuuuccauuuauuacccuuugaggggcuggauuuguggaaagauauuguguauauuuguuuuugucauggaauaccuugguuucuccaucuaugcuaauugagaguuuugcuggauauaguaaccuggaauggcauuuguguucucuuagggucugugugacaucugcucaggaucuucuggcuuucguagucucugaugagaagucugguauaauucggauagauuugccuuuauauguuacuugaacuuuuucccuuaaugcuuuuaauauucuuucuuuguuuaguguauuugguguuuugauuauuaagugacaggaagaauuucuuuucugguccaaucuauuuggaguucuguaggcuucuucuauguuuaugugcaucucuuucuuuagguuagggaaguuuucuucuauaauuuuguugaagauauuuacuggcugaagauauuacugaagaugggaaucuucacucucuucuauaucuauuaucuuuagguuuggucuucucauuguguccuggauuuccuggauguuuuggcuuaggagccuuuugcauuuugcauuuucuuugacuguuguuucaguguucucuaugggaucuucugcacaugagauucucucuucugucucuuguauuuuguuggugauucucacauuuauaacuccuauaacuuccuagauuuucuaacuccaggguugucucccuuugugauuucuuuauuguuucuuuuuccauuucuagauucuggaugguuuugcucaauucuuucaccuuuugguuguguuuaccuguaauucuuuaagggauuuuuguguuuugucauuaagggcuuuuagcuguuuaccaguauucuccuguauuucauuaagggagguauuuauccuuuuuaaauuccucaaucagcaucaugagaugugauuuuaaauccaaaucuugcuuuuuguguguguuggguuauccaggacuuacuguugugggaaaacuauguucugaugaugccauguagcuuugguuuuuguugguaaaguucuugcacuuuccuuucuucaucuggcuaucucuggugcuaguuugucuuacugucucuggcuugagcuugccccuccugugggcuuguaagucagugucagcacuucugggagaacagcucacccuggcagggcccaucacagagcgcuguggaacagccucagcuccuggguucagauggagacaggaaggauccugucccagcugcuccaccucuccuguccucuugaagcuuucaauauucuuucuuuguucucuguguuaguguuuugauuauuauguggugaggaaauaucuuuucugguucaaucuguuugguguucuguaugcuucuuauauauacauuuauaggcuucucuuucuuugguuaugaaaauuuuguuuaaaauauuuuucugugccuuuggguugguauucuuccucuguuccuauuauccuuagguuuagacuuuucauggugucccagauuuucuggauuuuuuuuuggggggggggucaggaauuauuuuagauuuaauauauuucuugaccaguguaucuaaucuuuaacauaugaaaucucucuuugguuuuuugugugcuuuugaugaugcuugcaaaaaucuguucucucaaaaaucuguauucucuuuugucuuuaaaagcaauuaaaccaaacuuuaaaauucuauccuaugauuacuugcuuguaggaagcaggcagcuuuuacugucuggcucucugccuuagaacagccauccugucucuuuucacaacaggggaucccagcaucuuugaccucaggcuuccccuauguuccuuuaaguuucuugcaugcugagccaccaugugacucacucucucugcucacugagaaaccaauuuuaucucuuccuacacuuauaucacuguguuugcuccauccaagaauuccuaaauuaauaguggauucucaccuuccauguugugugccaucuguugcaugccucccacuccaaagccuucucuuuuccugcaucccuucucuuccuccuucucuuccuccucagaccuggaagucccaccuuuacuucacccagcucucgagcgcgcccccaacucgccagcaagaacgacgccacagcaggauccuucugcacacguuuauucaguccuguuucuucuuguuuauaucuccccuguuuauaucucucccuuguuuauaucuccccccgaacccugggccucucacuccuuuuauacucucucucauccacgcaccgcaggccacacccccucgccagucacgaggcuucagcuaaucagggcagcagggacaaaucuccaccaaauuggauucaccuguauccugguacaccugcgcagcacucaagauguuugugucuuauaugaggaagucaggugcaagucauaugacuuagcugcagucccuggcgccuuugggacugccgccacacccgcuccccacaauucccccuuuuuucuuuuuuggcagagagaaugucuguagauagccccccgcagccaugccccuuacccguccuugggugacaaacagcauugguuugaucccugucuuagguuggugacaugcccagggagucuuaucacugacuaccucucuaucaugccaagccacaccuggggagauuguguuuugcuugcggcaggugcaucaaaaggccaggauguuaauuaaccuauggccagaucuuaauugcugcaagcaagccucaugggugaagguagaggucugauccccagugugcaagcauaggggcccuacacaaaaccaucccuuaggcucaucacccagagaggucuuggccagcucccgugucguuuuuccugggggaagggaacuaggacacugaaccuucaugcaaucagacauaccuuccacaggaugccaacagcaagcuauccucugugcagugcuuagccucgcaacccacggcauaacacagcauaauuucuuuuagagcggcaaaccgaaucugaggagauugucccgccuccacugcagcaaaagccuacgcuaccauggcgaaagugcgggccgcacacucugcaccuaacacaugugccaaacacaaaacacacacacacuauaacaagcauacaucccagggcucucucaucccugcucaucuucccugaagcaagggauagauggccagcggggcuaucucuuuaaggggaauuuagggaucaaaaagcguggaaaaauuugaaugucaugucgagcugguaucagcuucuggaauaccgaaaggaucucucaucuuggcuccauccuuuguauuugugggaccauccaccacauccacaguggcaacuggaucaggagccucauucuugcagcgucucaccaaucucuccagcacccaaagagguuccaucugguccuguggaaacacacaaacagacccucucgcccacgucaauaccagaucuggucgauccucuccaaaucuccggacagaagguccaccuacagguggcugcugaggaggcauagggaggcggcacaaaagcuaauucgccuuccuccuccaccucggcucuuuuauuuuguccuuucuguccaccugauaacacugugucuccuuucuuuuuccuuuuucuuuuuaagcccuucucuuccgacauacuuucuuguugcucuguaaggauuuucugaccugucuugacugccucuacacacaguuucaaacaguaacagaguccauauaucagaacaaacaagaccaaaacuaucagaccuacccacaaagggucaaugggagaaaaaagcauaacuacacagcgaggaucuauugaucacuacacugagguuaucauaguuccuuaacuuguccccaaaccgggaaccuuaacuugucccaaagccaggaaccuuaacuugucccaaagccaugaaccuuaucuugucccaaagccaggaaccuaucguuaccuugugccugcuuccuggcaacuuuauacuugccucuauuuuauccaagguccuucccaaacuccuggguuacuucgugccuacuuccuggcaacuuuaugcucaccucuauuuuauccgagguccuucccaaacuccuggggucgcaaguuucacucaccgugaacuuacccugccggcaaccacugacugcugaaaguucugaacucggugggggagucgguuccccguacgggccaccaauugucgcguccgcucucaaccagcaagaaugaugcgaccaccaguccuucuaacagcaguuuauucagucuucaucuuucuucuuucucuucaucaauaccguuccccagcugaagaguucugaauccacgccggauccuucucaacagucuguuuuacaggaaccuuuauuaaccacuccuuccccgugaugcaguucugaauccucccuguagcagggggucuucgcucgugccugaagauguuucuugucccggguuucggcaccacuucucgagcgcgcccccaacucgccagcaagaacgacgccacagcaggauccuucugcacacguuuauucaguccuguuucuucuuguuuauaucuccccuguuuauaucucucccuuguuuauaucuccccccgaacccugggccucucacuccuuuuauacucucucucauccacgcaccgcaggccacacccccucgccagucaagaggcuucagcuaaucagggcagcagggacaaaucuccaccaaauuggauucaccuguauccugguacaccugcgcagcacucaagauguuugugucuuauaugaggaagucaggugcaagucauaugacuuagcugcagucccuggcgccuuugggacugccgccacacccgcuccccacacccagcaauuggcuucugccuucuuuagugaccaaaccaagaaccaauuagggaaccagauuuuaguaucaguuccuuccccuagcaauuguguuaucugguaaguuuuaaaauaauaaagcagucuagaguggguuuuuuuuuucuuuuuuuuccuuugaauuuuuugagacaggguuucucuguguauccuuggcuguccuggaacucacucuauagaccaggcuggccuccaacucagaaauucaccugccucugccucccaagugcugggauuaaaggcaugcccaccaugcccugcugaguuuuucuuaaggugggcaggagaagacuggguggcuuggcaaagcuagcugggaggaagagauagccagugccaggcuggaggaagcauggucucugagcuaagcugggaccacagcucugggaaaaggaggaagcaugcauuuuaaaaauuaugugcaacaauggcuggugacauauuucucuggcuguuaauuguauuguuacacugauauuuaggcaucuggguuuuugggugauuauugauuuagguguucauuuaaggauuuuuuucaguguuggauagguauuuuaucuguuucucuuguucucugaccuauguggucuauauuugagcaugagguuuugacccaaguugaggacaggaguucuguguggccucuaguccaaaaggguaucucccaccuguguuagagucuggacauuucaggacucagguucagcaaguacugucuguccaaguuaagggcccugaggugguggaacagggggcagagguaugggguuaggguggguaggcugucugguuuucuagcagcugaagacugugguuaggaagagaguuggugaagucuucaaggggauggcuaaccuuuauuuaacgaagaaucaucagaaguugaguaauauugaucaaagucauuuuuccugcaugaguuuccuuaguucuuuuaauuaaaacuugacuguauuuuucugcuuuuguucauggcuuuuucucuccauccuuuuauucuuucacaaauauuguauaauucuugauuguuguaucucugucauaaguauagaaaucacauugauacaauguguauacuauuucuuuauaagcauauugagcauuauguuuucuacuuugcauguagcuuugacaucagcuuucuuacuacaaguuguuuggaauuucuuuguauuguauucaauuuaugugguaaauaugcuacaucuuaaucaugaugucauuaauaaaauauaaccaaggauuguuuauuuacuucuuucuuuauuuagguuuguuauuguuauucacuuaugaaagacauuuaguuuauuggauauaauauacuguaggguuuggguaaguuucucagcacuuauucuuguugggagugaccugaguucagauuucaacaucugaauugggaagcuaauaacuaccuacuccuccagauccaagggaucuuacacucuuuuucucugaugugucaccugugaacacacagcugacacacacaaacauacacaugaaaauguugauaaauuugucuauagucuuuaugacuuauaaagcaauuauaacaaaacaguuugcuuuagguguacaaugccaaugauauacucuuucuuuaaguaaaaaugccagcagccaauaacuggggagaacagacauagcggguuucggauucucaguuuuaggaccuggaggaggaggaaggagaacagagaagcuccaugcugggagaguguggaggagaggagagaugguggccaugcucaagaacaguacaggacugagaggcauggccaccaugugaaggagccgggaaagugcaacccaguuggccagcccucuagguccagagcagccaugauagaacaucgaauuuaguaaguaguaagucagaguuaucaccuggagguaaugaagauuaggcaguacuguccagcucuugugcugccuaaggcauauuaaugugacuuucauucaggaacacaaaccauugaggcagggaacgaaccugcugaugaaauuuauuuauuaaauauuuauuucagcaaaugguuaacacauuggucuuagauuuuuuaaguguuuuuaaaaacuguguguguguguguguguguguguguguauauauauauauauagagagagagagagagagagagaguauauauacucuuucuuuaaguaaaaaugccagcagccaauaacuggggagaacagacauagcagguuuaggauucucaguuuuaggaccuggaggaggaggaaggagaacagagaagcuccaugcugggagaguguggaagagaggagagauacacacacacacacacacacacacacacacacacacacacacacacauauauauauauauauauauacacauuauuuuuucuguguccugauuagcuucaacugucaauaagauauaacguagaguuaucuuaggaaauaucaguugagggcauguccagaugagaauggcugguugcuaugucuuugagacauuuuguugauugaugauugguaugggaaggaucuuccacuuaaggugucugaccaagcuagcucagucaguuaacaggguuacaagggagggagggagaauugaaaaggaagaaaaacaauuaggcaaaauuauaacaugaccccgccagaaccgagacugaaacagcuuuauuuuucuccagucugcuuuuauaucauucuagguauauccaagaaacauggucaguucuuagaucaaagacaaagccaucaagugaaguaguaguaaacaaggagaucacacaagagaguaaucaagcagaguaguaagccaagagaugacacaaggugacaaguaaaguaguaaggcaagagaccacacagggaauaauucagcaaagcaguaagcaaagccccacgaucacuguuucuaauauucuuacugagccuacauccuugucugaguccagugacaaaugccaaauuccuagaagcagcaccaaaagcucucagcaggugucaguaucccuaagcaacuauggcuggucugaauaagagugagcaugagacagugagcaaggacuagagaugaccaggaaacaacgucucuucuggguuuugccuucaguuucuaccuugaauuuauauccuaaguuuccacaacgguggauugugaucuggcaguaucagccccgccccccccccccaaaaaaaaaaccuauucauuaccugaguugcuuugggguagaggauuuaaucauaggaacagagaagcaacauagaacaaaaaccccuaccucauaagugauuuuguugcugugaaguacagugauuuggaggaauguggaagauauuacuacuuuagaaggcaaaagcuaucagaaucugugugcagagguuaauccguuaugcugguauaccuaggaaaagggaguuucuagaguaguacagagaguggagguugaugucauaggauuucaguggcaaauaggguccaugaaaaauuaaacuacagguuuuugugugauguuugccuucaaacucuuucuuauugugcccaugcacuguagaaaugaguuugauggaaaaaaagagacugauuucuuagauaaaauauuuauuuuaguguauaguuguuacugaugacucaugcauguuugcaacaaaaaguaacacaagugguguguaaagauagaacaagucugugauuuguacagaaaaacaccgcaaaguaguuucagauggcauucaaaugcuaaaacaaaggcaggaauauucaaggaaaauagcaccauuaaauuuccauugaauuggaagcuuaguaauaguauccuaaugguaagacucucuucagcuaaacauuuaugaaaggaacaggcaaagugauuccuagucccaagaaucaacuucauucagaaccugcuccaacugugguccaaguguggcaggguccaucccaaucucgaagcccaacuugacaggaucaccucuguuguccugguucuggaaacaagaaaguugcaaaguuuaaaggucaugaauuuuuccucugugguuucaguucagcccuguuguacucaacuauguuuggcagaaucagagccucagugagaagaguguaagcucaaugcaugaagcggugaauaugaugccugguuugcaucuugagaccacaagaucuugagauaccugagcuauaagauauaugacauagugaguggaaggagcaagguggagggggacaaagggagagguggagagacagaggcggggagagagggagagagagagaggcaugcaaacagauucagaggugacagagaugacaaguuucagggauagagacauguaaaccuuuuaaaacuuuagcccaugugucugaggcagagcucuaggauuugggguuugccuugcuggguuucggucuugccuuugucaaaucuuucuucuauuuucaaaugggaauguguaguauguuguuguauuuucaaaauauauaacugguuuccuaauuuuagaagaugucauagucaaaaaauucugucugucugucuaucagaagagacugaacauuugguugggguucuuauuaggauccuugaaguuuaacacguguauguuuugaugaucaaaagcacauaguaaccuggaucaguaguaguauauucaaugaaaaaccucccagauagaauaauguauuugaacacuugucucucauugguuguugucuuuggagugcauauggagucuugaguaggcagagccuugcggguggaaguucccuguugggguugagauuagaaugucuauagccuuuccccauuaucaauucauugugccuacauucuuauaguugaaucugauuagccagcuuuuaccacauagugcuauaccuuuaacaugcacuguauugcuaaauaacauaagauagagaagaaguauuggcuuuucauugauaagccauuugcuagccagauauauauaauuuuauuauuuucgguuuaguuuuugaggacaaguuuucuccguguugcuuuggcuguccugacauuagcucuugagauucaguucaucuugaucugucugauuccuccucucauguucugggauuaaagguaagguccauccaauauaacugacuuucuguuuuuguauuauuggcugauagcccuggaguggagguuuuuguaggugucaagcauaugcuauuguguugagcuucaucuacaucuuaaaauuugaacuuggacagaggguauauucucucucacagagugauauauuugugguauuaauaucaucugagccuccuaagucauuggauugaaggugcaugacauuuuucuuaccuuuuauguguuuugauuguauuaaugaguaugaguguuuggcuuguaugcauagacacaacauguugugugucuggcauuuacaguacucagaagacggccucauaaccucugaccuuggaguauugauaucugugagcccaauauaaauacugacaauugaacugauuuccuuuauaagaccagcaaguaaucuuaacuccugagccaucuaucuugcucaguuuuuuuuuauguaugaucuaaguauacagugcuuaaaauuucaucauccauccauaucugugcauucuccuuuacuaagaucuuaauaaucucauaguuugaguugugacacuucacauuucugugaaaugaauagugagaccuucagaguuuuuguaucucuuguuuguuuauuuuguugggcuuuuuugccagggaaagagucugaccaagagaucuuggaucucauucuauagaucaggccuuccacucagugagauccaucugucucugcuuucugaguacuauaguuaaaugcaugagacaggccugcuugcccauuuucuuuuguacuuauuaaucauucaugcaauuucucuaaaauguacucaguauuacuaaucucuuuguuuaaugacaggggugaagcuucucuucaguuuccuucuaaaaugacuuggugauuacaguagaauguccaugucauagauugagugugaaaaacaccauaauuagaucaauauguuguuaaagcaguauauaauuauguuaauuaguauacaauuaauguuuucaguauuaugcuuucuguuguacaugugugggauauuuuaggaugcagugaccuaugaugaugugcacauaaacuucacucaggaagaaugggucuuguuggaucuuucucaaaagaggcucuacaaagauguuauccuggagaccuacaggaaccucacugcuauagguaagacuaaauuuucugucacuuauuaaaauaugaggaaaaguuuuccuuaucuucuguaguuuuugauugugaaaguggagaauaugguaaauauuucuggugugucuuaagguucacugaugacaguaacuuaacuuuuguauaauuucaaauauaugauauauuuucugauaauauguuuuaggauacaaaugggaagaauacaauauugaagaauauugucaaaauucuagaauacauggaaggugaguuucgcguguuaacugaaacuuaaacauuuguauguaccucugaagaaauuuuaaugugcccuggaaauuuuaagguaaagaacagcauaaagcacagguuuuuguauauuuaugaauaaaagauucucauaguaucauaugccuuagugucagguagcuaauccauguuuuuaaggcauuucuuugagaaacaagacaaggaagcaugccuaaaaagcuaucaccuuuugaauaauagccccacaagaauuacuuuguagaacugccaaauucauuuuguuugauaccacucagguuucacaaagggcauacacauagacuagaugauccaaaaccaucuaauaagcaaauaguuuauagugaagcucacauuacuuauauacuuauaguuauuuaccaaaguuuagugagaagggcaguuuaugaaaaucaagaagguucuugugaagaaaacucuauccuuacauuacuucauuaugauaagcaauaaauuuaaacuuguaugaauccaaugugaaagccuuuuguuauuuuugcuuuaauauacauaucauauguugcauuagauauaagccauggcagcauaauggacauggaaagaugcaaugugccccuuuuacucccagaacuauuaggagauacuuaguaguaaccacuucgaguagacuuugacuaugauguaaguuuaccauugcguuuccaacuucauugggaauucuuucccaaauucacagugcauaaauguucugugaggaggaauauagacauucauuuauuuuuccugguucacuuugcaaauguaguuuggcucucaguauaggaaauuguuaugaaugccaugacaguaguaaaucugaguucuuccaguugucuucaaagauaggaaagcacucaaauggaaaaaagaugcuugcuauaagugugaaccauguacuaaagacucuaaccaucccagauauccucaaaaacauaaauguauacauaaugaagagggacccuaugacuguaaacaaugugauaaaaccuuaagaucuaauucuuuucuguaauuaaacuaaauuguaaaauuaaaucauagagauaaaaagauucagcaguauaaucaaugucauaaaauguuugcacaugccauuuaucuuugcaggcaagaaagaagucauccugaagauaaacucuaugaauauagacaaugugguaaaguuuuugcaugucacagucaucuucaaagucaugaaagaauucgugcuggagaggaauccugugaauguaaucaauguaauaaucacaguacucuucaaaauccugaaaaaaaucauacugaagagagacuauaugaauguaaugaaugugguaaagcuuuuucacaacagagucaucuccaaauacauacaaggacacaucauggacagaaacucuaugaauguaagcaauguuguaaagccuuugccuguugcagcagucuucaaaaacaugaaaaagaucauacuagagauacaaccuaugagucuaagcaaagugguauagacuuuucacaucagaguuaucucuauaagcauaaaagaacauauauuguacagaaacacuacaaaugcacucaaugugauaaaguguuuucaaaacguaguaauuuccaaagacauaaaagacuacauacaggagagaaacccuaugaauguaaccaaugugguaaaggcuuugcacugcccagauaucucagaaaacauagaagaacacauauuggagagaaacccuaugaauguaaucagugugguaaagccuuuacacagagcaguggucuucaaaaucaugaaagaauucauacuggagagaaacccuaugaauguaaucaaugugguaaagccuuugcacaucauaguucucuccagaaacaugaaaaaacucauacuggagagaaacccuaugaauguaaucaaugugguaaagccuuugaacaacaaauuuaccuucaaauucaugaaagaauccauacuggagagaaaccguauguauguaaucaaugugguaaagccuuugcauaucacagucaucuuaaaguucauggaagagcucauacuggagagaaacccuaugaauguaaucaguguggcagagccuuugcuuauagcaguagucuucagauacaugaaauaauccauacugcagagaaacccuaugaauguaagcaaugugguagagccuuugcacaucagaguuaucuccagaaacaugaaagaacacauacuggagagaaacccuauaaauguaaacaaugugguaaagccuuuguacaacagauucaucuucaaguucauggaagaauccauacuggagagaaacccuaugaauguaaucagugugguagagccuuugcauauagcaguagucuuaaaaaacaugaaauaguccauacuggagagaaacccuaugaauguaaucaaugugguaaagccuuugcauaucccagauaucuucagaaacaugaaagaacacauacuggagagaaacccuaugaauguaaucaaugugguaaagccuuugcacaucacaguuaucuccagaaacaugaaagaauucauacuggagagaaacccuaugaauguaaucaaugugguaaagccuuugcacaucacaguaacuuccaaaaccaugaaagaacacacacuggagagaaacccuaugaauguaaucaaugugguaaagcuuuuucaaagcagacucuucuccaacuacauaaaagaacacauacuggagagaaaccguauguguguaaucaaugugguaaagccuuugcauaucacagucaucuuaaaguucauggaagagcucauacuggagagaaacccuaugaauguaaucagugcggcagagccuuugcauauaacaguagucuucaaauacaugagauaguccauacugcagagaaacccuaugaauguaagcaaugugguagagccuuugcacaucagaguuaucuccagaaacaugaaagaacacauacuggagagaaacccuauaaauguaaucagugugguaaagccuuugcacaacagauucaucuucaaguucauggaagaauccauacuggagagaaacccuaugaauguaaucagugugguagagccuuugcauauagcaguagucuuaaaaagcaugaaauaguccauacuggagagaaacccuaugaauguaaucagugugguaaagccuuugcacaucucagauaucuucgaaaacaugaaagaacacauacugaagagaaacccuaugaaucuaaucagugugguaaaaccuuugcacauaacaauaaucuucagcaucaugaaagaauucauacugaagagaaacccuaugaacauagucaauguagaaaacccuuuucauaucacaguagucuucagauucauacuucagagaaacacuaauguaguuaacgugguaaagccuuugcaugucauaguagucuuuacauucuugaaagaauucauauuggagagaaacacuaugauauaaucaaugugguaaagcauugcauaucacaauuaucugcaaauauacaaaagaacacacugaaggaaaaugauacaaauguaaucaauguaguauaaagccuuucaacaucacaguuaucuucaaauacaaaggaacacauacuggagaguaacguuaugaauguacucagccuguuaaagccuuugcauaucacaguugucuuugaggacaugaaaguacucaggaaaugaaccuaugaauauaaaguguuuuuuuucccauagguuuacuguuuauucaggguuaaauguuacagaguucauacacugucggaaccaugccugagaacccaaagaaagaaauggugcaauggacagccucauccacccaguguauuaaaacuugauucauaugcauuuugauaauuucacaaucuugaaaacuauaacaagacuugggauuuacaucugcugcaggucuucagcauucaguacaguaugcuauuaaaauaaccucaucaugucuccguucacuuccuaaaauuuguguguguaugugugucuagcuggaguagacuauaaaguauuugguaagaucuuuaggcuacacacuuaaauucaaauuacacaagaguuauugcagauuuuaaaaaaaaucugaugcucucuugcucuguucccuugcuccugcucccccucucuucccuauucccuccccccucuccacaugcucaugggcagcucucucucucucucucucugccuuucucugucucuauuccuuuaacuccccaagcccugaaaaaacucuauucuauacuguuaaaaaaaaaauccuacaauugucaacaaucucuucaagccuuuggcuucuucaugcuacaugccaaagaaagaaacugaauauagagucaacaagaaauacuagcauuucugaagggaagaauuguugacagggagaaaugucaugucuuggcagcaucccuuuuccacuucaaagaauaugauuagcauugaaaaaccuucauauggcauuugcuccuguguggcaagcugcuccugggguaaaaacucuccuugcuucaacugcugacaguauacuguccaaacuggacaaauaggauacagagaagucaagugcuaaacuuuaccaaaacaaguaggcagugcuuuaguauugcugccucauggaaaagucuaucagauauuuggggcagaaggcugaagauaaugucucaaaguugcagaggaaccuuggaugacuguccgggucaaccucucucuagcauuucuauaauuuuggaagcugcuugcucugcacuuccuguauccucagggaauguucauuccuucucaggucucuuaugggguugaagacuagauaguuauagucucauaacucagcuuaaguuguuuaagguuuaaaaaauauuuuaaggucuaaagguaaaaguuggcaaaugcaaguuuugauugaaagcgaaauaggcacagaagauuggauucaccgagauaauugauaguagauagaaaguagaguacuuucuccaagguugccaaauacauauugacuguaucuugugaauacaauucucacuugaugguuuucauaauuguucuuauuguauauagcuuauugaugguagagaaagacccuuuauugga

SEQ ID NO: 4467 - RNA, 102384 nt, Mus musculus
ucuaucagauaaaacauuuuauuuauauauaaaauuuuuauauuuacauauauauaauauacuuccuccucacacacuuugugugcauauaucaguguguguuggaguguucagcuccagcggcaucuagaagaaaagcaagaauuaucaauaguaucaucagccacaucauugguggcacugucaggagcagcagcaucagcagcaucagugucauuaucaucaggaucaauguaaugagaaacugagaagguagaggcuuguuuuguuaauuuuauucucagaugucgcuuccuuuggaauguuuguuuccaggcugauacuauccucacaagucagaguucagaagagcagagauaaauagacaccaauguuuaacagaaacuaauguuuucaaugggagugaaaaaaaauuaccucauuccaggaugggagacaaccaaguaccauggucaguuguguuggucuaaacugguuuuguuacacuaugugaaguauuuucaauaaguugggaaaaggaaacaauguuuucugauucuagguaaugcuuaaauagcaugaaauguauuaaucaugacuauuaguaucaaagauaucuacuuuucuaucuaaaauaaaaguucaucuauuuuaagcaacuacugugguccaccuuaccggguuuaucuuuucucuuggagggagguccuuggccauuuucuucauagcacacuugggaauuccauuucuaauccacaucaucauugauaacaggaauguaaaaaaccacaucaagggcauuacuggcagcaguagcauaucugguucccaaagaaaaccagguaccuggacaguggacccgcuauggccagugagaucagcugacucuaaagcgucauaaaaauccucagcuauaucuucaucuaggucagcaacaggacuggguuccucaccugaagaaagaauagcauacuugucuuaugcuccaagcagugucagaacauucaggucaguucuuucaauggaaucuagggaacagcaagugcagguaccaggaguaggcucugggucacaaugggguguggcccuugcaugcuccauguaaaaaucugaaucaguuaugaaguccaacccaaugucacuaccuguuucuaagucauauuuuucaucagauucagaacugucagaaggacauggggaaguaauuugcucaauaucagaaggagcaggacugucaggagcacauugugaaggacuugguucuaugucagcaggaauccuggugucagcagcacagguggaaugaguuggcucaacaucagcaggagcaccccugucaggagcaaguugugaaggaguugguucuaugucagcaggagcccugcugucagcagcacagguggaaugaguuggcucaaugacugcaggauccucacagucaggagcacacugggaaguaguuggcucaacaucagcaggagcaccacugugaggagcaaguugugaaggaguuggcucaacauuaacaggagccccauugacagcagcacagguggaagaauuuggcucagcaucagcaggagcccugcagucagcagcacagguggauugaguuggcucaaugucaccaggagccucaagcacaugaauucuaugcuuccgaggaaagggacggaaaauaggugguuuauuuccucgcaccuauaaggaaaauuggcaauguuacuuuugauuuaaaguuucacugauuuuauucauuuuaucaccugucugcuaaugucagaaucuugauuuacaguccccaaaauguuucuguauucagaccaccuucaucacuaaggacacuaucugauauucagcaaccucugcuuccuuucugcaugaugaguaaaaggcccagaguaucuagaaaucuuugauggggaccugcuuaguguuaugcuuuuaucuucugcucuuugcuaccucacaucaucauucucuacaaaauggaaagacauaaaaagaaaagacaaaauguguccucuccugucuuuaugaccugaauuuugaauuccagccagaugaggugaauagggcagugaggugcuuugagaacaaaaagaaccucucucuucugcacuacacuaacccuuccccaaugaaugaucuucuacaguuguccauuagauaccugggauaucagaacaguggagcugaauugugaagugcaugaauaaaguaugucacuaccuacagcagaggggaauugcugaguuccauguauggauucuauauaugccuuccaaaaucucaccuauuagcucuaugucaaaguaacuuuuaugcacuucguguaauuguaaucuuugaugcuuacuaccuccaucugaaugauaaccuaggccuaguccuggaagcuucucaccuaugugaaacuuagcauaggccuagaauauuuucuagaggcuacuuacugcugaauaagcacaccguuauuucugguucuuuuucaucucuggcugacugguucaacucagguguucuagcucaaagcugcuccccaugcuaacugauucagucuggauucucucuuggccucugauguuuuuuuguucugcuugaccucaaacuaacuagcaauuuuuuccuaaucuuccgacugcuucauauucucugguucauucugccuucacccgugucuugcugguucucucuucaaugaaucucucuaaaacucucuggguaaaaaugccuccucucucuguuucucucugcacuaccucucaaguagcuucccuuuccuuucuucuugagagaguuggacacauccuauuuaaucaaaacuuucucugauucaucaacuucucugccaugcaauuagacaucauuuucagacaaggugcuucauucuacaaacuaacuuuaccuugauuguuuaggauuaaggguguuuacuaaggaggugucuguauucuggcuagagggauuaaaguuuggugcaaaggcugagucacacaauaacuagacaagaguuuauugaguaaacaacacaaucaaacacaagcacagcaugaucaacuauccugcaucaccaugacuguuguuacacagagaggaugaauauaaugaccugauccagcaccucugugguggcuugaaugucagaggcccauaggcucauaugaugcuugcucuccagauggcugaccuauucuggaaaggauuagaaguuguggccuuuuuguuggauguguguaacugggaugggcuuuaagauuacacuagacaggugccauucccguaaaguucucucuucccuguguaggucaagaugugaucauucugcugcugcuucaguaccaugccugcugccugagccacgauggugaugugugcauccaacuggaaccaugagcccaacuucaaacacacccuuucuucuggaaguugucuuucucauggucuuuucuuacagccauagaaaguaacuaacauaaccaucaucuagguacaguaggagugacuucaaacgucugaaggauucauuucaagcuaugaagggguuuugcccaguggauuuggucacaaaacaagugaucacauuccauaaugcuagcuuagauaggcuacccagagcacucacugauucaaccagauacacuuaggaaaugugaguguugaaaguggauuugaugcagcauggcaaauaaggucuccauauauuugcugcuccuuacaucucugagaaauucauaacuuagcagccaacuuuugcccuucaguaccagguuucaugauacuuacaugaaaaagucacacuccaaaacauacucugcaucaucaaacaauauaacacagagaagguucaacaaaaugaguuaagcagcacuguugaucaaagggaaaggaugaggaaacaugcaaucucugugucuucaaacuguucaaauguuagaauuuaguucacuggauccacugagaaacggacuugaauacagcaaagcauguggaauuuucagacauaggcacguuuucauacaccacguguuaccggacucauucuccccuuccucauuguguaaacaugcuugagacagguauuaaagaagaauaaaggaccauaugaugcaaaauuaaauuuccaggacaucugccacuuccaugaagauaacacugaagauaaaggagaggacccugaagugauuucccugaauuguuagucacacaacagguguauauuaacagcauuuauuugccaguauacuuaaauucaugauucaaaauaaucuuuaucuuagggguuugugcacaugugguuacauuacucugcuuauguuaugcuuguguguguauuucuccccucccucucucugucucugucucucucucucuauuguguuucuguauguguguuuguguuuguguguguguguguguguagacuggagagauauuucaggagcuggaucucuucuuccacagaguuagaaagaggcucugaccauuucugcugcucucuauggucuaaucugucuagcuugucuuucagggcuguucuacucucuuagccuccaaucuggauuuaggggugcagagauuacaggcuuuuuccuuuuuucaggaugaaauucagcuuauuaggguuccaaggcaagugcacuauuccacugagccaccugauagguauauuuuauguauauauacaugcaugaguccauguauguguguauuuauuuauacauauauauguguauaugaauauguguauauauaugcauauauauuaugcauuuauauucuaguuuuaaaauaaaggggagagagagagggagagagagaaagagugcuugguuguuacccauauuggguauucucuuagcaugcaauagagaacuguuauuaucuagcucagguccauuuuuuucaaauuuuauagguauuacacugcaauugccacauaggcuucugggaaguuuguguuaguuugauuuuaugcaaguuuaauaucagaaaauagcaucuauuuuauuucaaucacauaauucauuucuuugaagaauggaaacuaccuuuggcuaaguugugccuggcauauaucacugcuuuaaugauauuguggauuguauucuaauaauugguauauaaaagaaguugcuucauuucaugccaacuguaacuauucugugguuaccauauccuucaccauuauuauguacauucuguaucaucauaaauauucuauuuaggggaaauguguuuguauuaggaauguuaguuuugaaaacucuaacggcuuuucacugaacuagaagaugauugccaagaaaauuucuguguucgaaaauuaccugaguucuaccuucuugcauaguucucucuagaacaaaauuuacucgguucaucacauauuguagcuaauauuaacuuggaaacuaaauugagcuaggcuaaaaagaaggaacaguugaguuugguuucugacacuaugaaguuuacaguuucuaaagguuucacuggguguaauaauuacaucuaaucugccccuuucuuaauggugaauuuagagggcuuacauuaagauaauuagcuagcuguuaacaguaggcaguggaggaaguggugugaguaagaucugcaaauagacccuuguguuugauuuguaacuucucaguggggauuaaaacagaaaagagggcuauuauucuuuuacuugcuucugcaguugcucugacaaaaugucugaugggaaagucagucaguuacuuccagcaaggcaacagggugucccaguuuguggcacuauucuauugcuucucacaugcugguagaccaggaaaccaauaacacagaacugguaccacauguagucauaaccaugaaaaccuaccacugacaaccgugugcuaccuaggucauaucccgaauguuaaacccucucccuaaguguggcccaguauuaaaacccaggagaagacaucucucucugucugacccucccaugcacuggguaagagguguguaauguuauaaagacacacacacacacacacacacacacacacacacacacacacacacacuuuuuauauacucucucucucucucucucucucucuguguguguguguguguguguguguguucaugcuaaagcauuuucagacaauguguaaaucagggucagcgagauggcuaaguaguuaaagauacuugucaccaugacaaacagcuugaauuugauaccugagacugaaauaguggaaggagaagacugacuccuauuuguuaucauuugauacccacaauucaccuugccuuccucuacuucccauaucaauuaugaacaggguguccuugaacugacaaagacaauccugccugauuuguggguucaugaauuaaaggugugcccagcauaccgagccuccuauugugcacacccugccuauuaguccuuuggacuucaauagguaaaaugugaaggcugaggccuggguccaggaaguuaacaauuauccuaagacugacuacuuacuuccccuuaugauacuuuuaaucguuuucauaucaaacauauucacuguaggagcuauaaaaggggguugaggaguuuuuaacauguuuuguucuugcauagcaccuggguuugauuuguaauacauaaaccuuugcucacaaaauucuggaacaccaaguccaugagaagaaauaaccucuucugaugucugugcgacgcacacacacaugggacacagaaagaacacacaugcaaagcauucacacacuuaaagucagucgaucuaagaggagaaacacaaguauugguugcuuccauguugacuguaccuacuuccaggagccuguauuauuuacuuuuugucauuuuaugaauucuucucacuguguuacaaacaugcccauuuuuuuuuuuuuuugguuucuuucuuguuguuuccauagucuaauuuccuaacacuuacauuuuaacacagugguucucaaccuaucugucaugaccaauuggaggaggugcacagaacaggcucacacaaguugcccaagaaacucugaaaacacugauaggacauuacaacugauaacauuaucaagccuacacuuauggagcagcaacauaaacaauuucaugguugggagucaccacaacaugaggaacucuauuaaagaaagggucacugcauuagggagguagggaagcacuaccucauacagggccuggcaaggagugaggauaugaaggagaugaggggacuguucaugccuagguuucucuucccugacacuacuugcaguacucaaccacaggcacacacauccaacauuuuccuucauaacaagugaauauguuacuuaucaaauaggggagaauuaacauuagggaugcuuuuucuucauaaguguuaguuauuggcucuccccaagaacacacauaaacuccagaacuccaaaaaccuacaaaauccuuuugcauccuccucuguggucuauguaaacuuuugcuagauucuuccagcaaugcaaagguauagaguuaacuuuuuguuuuguugugcaauuaacucuuuucuuuuggggugcaugcuuucaaaucaacuuuacuucuuaguaaucaugggguauugacacaugaaaaauaaaaacuguaauuaaacaugaaauauuuucuaauacgcuuaucuauuuucaaauugcuaggauaucaucaagauguaaaaauauuuaggcuagacuagaugaagagaaaaucaugaaaugagaaacaggauauuguucuuccggguugagacuaagcuuaauucauuaugugccaaauuuucuccaucuuauauaagaugaucauuaauauugcuaaaaccucuuuuggcauucuuucuccuccauugcuggggggaacaaaaugcacaguuuaccauuuuaaauaaaugccaguuaaauugccacugcuauccuuaucauaguaccuguggaacuacuuuauagaaacacauuggaucacuuagucacauucaaaaaucauuaaaaugucacuuaucagucacacauccccucacucuauggcuagagguuauacagaaacaaguuuccuaaacuccaguaucucauagugauuaaguagccucauacugaauauggauguaucuaaauaaaacacuacaauauuuuaaguguuugaauauggcacaaagaauauacauguauauuucaaaaauaagaaaaagaagaacuuauauggacuuauauagcaauugacucucugcuucuagaaaugcuggcuaacuggggaaggacaguuauuuuuuaacuagaugaagaacuuucaacauacccuuauaagaaucaaauagaaaauacucuaaucucuucauaaggcaaauuugaugaacauaauugcuaaauauccacaauuucuucucagucuaaaaacagaugaaagagagaaaccaaagagagccucucauauaugauccugaaauaggagugcccaaggguagauaaaacuuaugggcauucugcuggggguaaaggcacuuuggagauugcuggaucauugaaauaucuggacuuacuaaaugguauucuggucuauuaucacggucacauuuuuaaaucagucuaauguguauucauuucugcaaacauuacuuugucaaacaucaaacaccuucuauuaugugagaccugcacucagucuucacucccuaugucucuugaguccauucucauauugggccacuacuacccauaaggacuuacugcucacuugcaauugauagaaaguuccacaucuacaauaugguuuucucugaaucaccuuuuccauauaaaacugggauauuagacuacugcugaauuaagacaauucauaagaaacuugauuucacagagaagcauuuuaccuugauacaggaaguauaccugacaucuucuccuuuugaacaccuagaaacaacaaugggagguuugucagggagccauuagaaugcaaauaugcaaccuucuuucaacauuagauguguggcuggaucucuuguucauggagaaaaaccccaggcuaacuauccaguaaacuuuagggauucucugucaccaccuccagucucaccauaagggccccagcauacagcagcacaugagacugucagaccucauguggauucuuggcauccaaacucucauucucacacaugcauagcaagcacuuuauccauuggaucuuccaccuagcuauggauccuuuacagcauuucaugcugcaugauagauaucaucaguuauuucaacaugguuugcucuauaaauaauuauucaccuugugauuauagaaaaguaaagagcugaaauugucuuacacagaggcaaagacagugucaggcucugaauuucauauuuucuacagauuaauguauuauaaaaugcacacuacauucuuaccacagugauguucuucuuguaauuuucucauuaacuacaaaagagggaggcaaaauuugucauuaaacaaugguagccagugccgaagcaaauauuuuugugaccugauaugcuuuggcaccauuuauaaaagcuuuuaagaugaauauugauuuguaagcaauaaauauacuagaacucuuccuguccucauucuuguauuuuuaaaauaaaaaaagaaaauuuuaucuaaaguuacuauuuauaauuaauugugcaaaauaccuacaauccugagcccuaucagacacaaaaagugucaucuuagccugaaguguuauuccacagugaauauuguugccauugcugcuuucugucucugcccuagggaugcuggcacaacucuaagugagcgaacucaucuuggacagaagugaagggacuucuccaaguauugacuugaacuuccuucacugaggggaaauauccauuccuacaacagggaagcucagucuauggcuaugcaacauagccaaauacaggagacccaaagcccuuugcaaaggauuuccagcugcaagugugacaaagcucuagagagaucaguguguuacucuacucuagaucuucugaggaagaugcuaaaggcccucaguucuagcacuggugccuagcucaugugcaaugcaaagaagcucagcaucaacuuccauugcuucccauggcaugagcugcuggaaagacccccuuaguagcuaugcaaacugaaguauuacuccagagagaagcauggaagacacaaugaagcaguaauuccaagggacuaaugccucacacgaagcguuuuuuuuauuuauuucugcauauaaaccauugagugacucagguuucacuguauggaaaaagccugcucagcaaacaagcuaacaaauaaacaauucuuguuuacuuccuuugcaauauguaaaacuccacuguacccugcuggacauugcccauggccagagcacagccuuugucccaaacaagaaaugggcugagaaaguggaccucuggaggaccuuaugcuacucauguauggggccucugucaauccuuaucaccagaagaaagcucuaaugcugaaauaacuuaaaagaaacucacccacauuacacuaauaguauuucaucccaugcuuaugugaagacagccauuuagauuccucuacacuauucucuggcugguguuuuccaaagucaaaguaggugcgagagaugcuguggugacaguugcugaaagcauaaacugugugguauuucucccacugugagaaucauauucagacugaaccaaugggcccuuccaugccaugacuacaggaugauaggauuuucucaaccuuccuucuacuguggcaguuuuuucugcaaauuaugucuuguagcauguaaaccaaguaucacuauaaauuugguaacuaauagaacuacagggaaaaggugcugucagaguagcccauauggaggcuguugcaaagaauacugagaauggcaguuuucauuccacagcacuaccuacaaaacucacacaccagucaguuuuuuaaaaguuccuaauugagccaguuauuuauuguaucaggauauucacauuaaauggaagacaaauaaaaauaaccagaagacaauguaugaauuaucaaaugaguggaaauucagaaauucuaugauggaaaaaaaaaauccagagugcccuaaugacauuaaguccucaaaauacagugaaaguaauugaauacucuauuuuuguuugcuuaacaugaccacauuuuauggacaccgauacacauacaacaacaugcagucaguaauauauaucaauuauaaaacuuaaguaaaaauccauuucauaccaaagucaacuugcuguuauguaacuagagaggaucuacauuguagaauaggugaaaaaucuuuuuacuucuaaaaagucacuacaugcaucaguaguucauuuuaaauaaacaaacauauuucaggugauaaaauuugaauuugaaauuucuuugaaacaauuacuaaauaaaucugaauccuaaaaauguuuggcagcaaauuaagaaaggcuauaacuacuauuggcauauuugauuuccuuaguuucuauucuagcaggaacaaaauucuuuuugugauugggauagaaucaauagaguacuuacucuuaaacuuaccuguauuauacuggacaguguuuuucaagauagauuuaagcuguccugguggucuugcuucacuguggcauauuuuaagaguguuauuuuaauauucauauaaaaauuaaucaaagacuuugaauucuuuguuguuugauuucccaauuuaugcuacauuacaaaccaauaaaaucuauuaacuuguucuucaaccaguugauuacauuuggggacacuuuccuuacaacuucuccucauaugggagaaguuagcccacaaaauauagcccuacaaaaccacucacagauacagacaagcacgcgugcacacaugcauacacacuaguaccucuucagccuuuguuuuaacagcuuacagauuuuuuguuuuuaauguauugacucaauuucagucuuugcuccuggaagggcaaaguacuucucucaugauacuuugugcauauuucauugauuaugauguuaccacacaagaggaugcuuugugcaccaucaaguagauuucuagaacucuaaacaacccaccacagcuuucauaauguucaagcugcuccuucuguucucauguaugacugaguccugauaucguagucugcuuguuucuauuccaaacaagcauuucuaggaacauaauaagauaguaacaagagcaaagaacaauaaacuuuaguugacacuugcaguuuuacuguggaaccguuuaggauuccaaauagaagucaacauguguauuuuucaaggaguuucugaagaguuuuaaguacugaagauuuuugaaucuucacuuucaacauuaccuuugaugauuuugggaauuuucaaacauggauucaguaagcuauuuaauaauguuuugaaaauguuuguugauacauagcacaaauaaagaggacaauauaauuguucucucuuguggaaguaaugaauccuaaugagcacagaauuaccuuaaaauacaucuuuuaauuuucuaucaaaccagugucuaaccuagcauccuggacaggaguggaugggccuucaacucuauggucaugucuaacugauguggaagacaaaagcccucuuuguagagagauaauuauuauuacacugucauucagauaaucaauugagagucaaaggaaucauuccgguggaaaacagaucaugugaacagaucauugauggauggaacuuucuggaagacaugggugucuucuaacagcuaugaaagaugcuacaccugaacaaaaagguccuuugcauguaaaguaaagcucugucagaagaggaaagaaauuuguuggcauccuguagugaugacugacaacugagaaucauccuaaauuauguaaacucucagacaagagaaaugccugaaaugauagcuacuagugugggucuuaguucacaaacugaauccaguaaggcuuugaaaagccaaugaaucuuagauggacauccauaugcauagcuaaucccagcaggcucuuuuuccaaacuucagaguugguucuuggaaauggugggugacuaucguguucauguucuuaugaacuacacugagcgaguuuccaagcuaaaacauauauucauaauauugugggacuuguaagacacaggucucaaaguacucacaacaagaauuugcuucuuauuuuugaauuuaccuacuacuaaugaauuguuaaaccuuaccaggacaaaggccuuuccucuuuaaaguauaagacuucugaaaagaaaaacaaaauauauuuuauuacaacuauagaaaaacauuacauauaaaaacgaucagacccauuguuaguaucaauuucuaugagaucaaucuagagacuauucaagaguaaauauccacuuuuagcaaauuacuuugcauagaaauauucauucccuguauauuucaaauugaagacgacaauaauuuaucaaacauuaaugccuaacaauauacacacauacacauuuguaaugauccuaaaugaacucucacagucugauagugaggacaauccugaccagaauaaacaacuguuucaaaaauaacuucuugugauucuuuuuaacucuaggcuaaugguucugaaaagaauuauagauugaguaugguggcacacaauuugaaucucaacacuuaggaggcaaaagcagauggagaagcugugacucccuggacaaacagagcuauauuuagugagaccgugucucaaccccuccccuaaaaagaguaaaguccagagcugugcugugcuucaagauguucuccccugagugccagucuuuggcuacaauuaaacccacauuaagcaggccugcugcaccaggaacauccaaugcucugcgcaguuuccuggagauauacacugucaccugauuuccaauguccaggcaaaggcagcccaccucaggacgccugugacagaaacuccccgggauaaccaguuggcuaaaggccaauauaagaacacaaucaaagagaacuaaaucaauaugacauauccacagcacagguauucuacuauagcaagcucuggauauccuaacacaaucaaagcaaaguaaaaugucuuuaaauccaaucuuaugaagacgauagaggccuuuaaauggggaaauuaauaaaucccuuaaauauacaggaaaacagaaucaaacagguaaagaaaaugaauaaaacuauucaauaucugcaaaugguaaaagaagcaguaaagaaaauacaaacucagggaaccuuggagauggaaaaccuaagaaggacaacagagacagaagcacagccaacagagcaaaaauaauggaagagaugaucucaggcauagaugauauaacaaaagaaaauguuaaaccuaaaacaauuucugacucaaaguauucagguaaucugugacacucuaaaaaaaaaucuuuuuaugaauaaugggaauaaacaacaagccaagagaguaccagcucaaaggacaaggaaauauuuucaacaaaaucauagaagaaaauucacccaaacuaaagaaauaaugccuaccaacguagaaaaagcuuacaaaacaccaacuucauugguguucucaacacauaaucaucuucccuccacauacaucaaaauaacaggaauuaacaaucauugguuauugauagcucucaacaccaguaaacucauuuuccacaauaaaaagauauaagcugacagacuggauaugaagucagcaucuaucauucugcuucaugcaagaaacauaccuuggccaacauacagagacaucaccuaagaaugaaggacuguaaaaaguuuucccaagaaaagguacucaggaugaaagcuaaggagcaauuguaauaucuaaauaaaagagacuuucaaccaaaaugaaucaaaagagauagggaaggauauuucacauucaucaaagaaaaacacaccaagaagacuucucaauucugaauccccacauuugcaacuuaaauccuacuuuuaaaggugcuaauggggguuggggggcacaaagcuagcagugcacaagcaguagaacagaugagacaguguacuuucugccuccaucugcacccaggagcuggggcuguuccacagcccucugugcaugggcccugccagggugagcuggucucccagaagugcugacacagacuuacaggcccccaggagggacaaggucaacccagagacagcaagaccaacuaacaccucagauaaccagaaguaaaaaggcaagcccaagaaccuaaccaacagaaacaaggcuacauggcaucaucaggauccaguucucacacaagagcaaguccuggauaccccaacauaccggaaaagcaagauuuggauugaaaaucacaucucaugaugcuguuagaggacuuucaggaggaaauaaauaagucccuuaaagaaauacaagagaacaucggaaaacagguaaaagaacuuaaagagaaaacacaaaauucccuuaaaucauuacauggaaacaaacaaacaaacaggcaaaggaauugaacaaaaccacccaggauccaaaaauagaaguagaaacaaaagaagauaccacaaagggagacagcucuggagauagaaaaccuaggaaagaggucaggaguuauagaugcaagcaucaccaacaaagagauagaagagagaaucucaggugcagaagauagaagagagaauacaagagauagaagagagaaucucaggugcagaagauaccauagaaaacauuaacacaacagucaaagacaaugcaaaaugcaaaaaacaacaacaacaacaacaaaacuccuaagccaaaacauccaggaaauccaggaaaaaaugaggagaccacaccuaaggauaauagguauagaagacagugaagacccccaauuuaaagggccaguaaauaacuucaacaaaacuacagaagaaaacuuacguaaucaaaagaaagaggugaccauggacauacaagaagccuacagaacuccaacuagauuggaccagaaaaaaaauuccuccugucauauaauaaucaaaacaccaaaugcauaaaacaaagaaagaauauuaaaagcaguaagggaaaauggucaaguaauauauaaaugcauaacuaucagaauuacaccagacuucucgccaaagaauaugaaagccacaagauccugggcuuaugucauauagacccuagagaacauaaaugccagcccaggguacaauacccaauaaaaaucucaauucccauagauugagaaaccaagguauuccaugacaaaaccacauuuacagaauaugauuccauaaauccaguccuccaaaggaugauaaaucccagaagauggagagaucuaccaugcucauuggcaggauuaauauagucaaaauggcuauccugccuaaagcaauccacagauucaaugcaauccccaucaaaauuccaacugaaaucuucacugaguuagaaaaagcaauuugcaaauucaccuagaauaacaaaaaaccuaggauagcaaaaagucuucucagugauaaaagaaucucugguggaaucaccaugccugaccuaaagcuguacuacagaacaauugugauaaaaacugccugguacugggauagcgacagacagguagaccaauggaauagaacugaagacccagaaaugaacacaaacaccuauggccacuugaucuuugacauuggagccaaaaccauccaguggaaaaaaauacagcauuuucaacaaauggugcuggcacaacuggcuguuaucauguagaaaaaugcgaauugauccauucuaaucuccuuaucuccucaagucuaaguggaucaaggaacuccacauaaaaccagagacacugaaacucauagaggagaaaguggggaaaaguauugaagauaugggcacagggggaaaaaauuccucaauaggacagcaauggcuugugcuguaaguuugagaauugacaaaugggaccucauaaaauugccaagcuucuguaaggcaaaagacacugucaauaggacaaaacagcaaucaacagauugggaaaagaucuuuacuaauucuacagcugauagagggcuaguauccaauguauacuaagaacucaagauguuagacuccugauaaccguucagaauggcuaagaucagaagcucaggggagagcaguuguuggugaggaugugaagaaagaggaacauucuaccauugcuggugggauuguaaggugguacacccacucuggaaaucaguuuggugauuccucagaaaauuggacauaguacuaaucagaggacucagcaauaucacuccuguguauauacccagaagaugcuccaacacauaauagggacacauucuccauuaugcucauagcagccuuauuuacaguagucagaagauggaaagaacccagauguccuucaaaagagaaauugauacacaaagugugguacauuuacacaauggacuacuacucagccauuaaaaaggaugaauucaugaaguucuuaggcaaaugaauggaacuaguaaauauuauccugagugagguaacccaaucacaaaagaacacacaugguauguacucacugauaaauggauauuagcccagaaguucagaauacccaagauacaauucacagaauacaugaagcucaaguagaaugaagaccacagugugacuacuucaguucuucuuagaagggggaucaaaauacccaugggaggagauacagagacaauguuuggagcagaaacugaaggaaacgccauccaguuacugucccaccagagaauccaguccauauacaauuaccaaacccagacacuauuguggaugccaacaagugcuugcugacaggagccugauagagcugccuccuuggaggcucugcaguguuugacaaauacagagguaaaugcacacagccaaccauuggacugagcacagggucuccaauggaggagcuaagaaaggacacaaggagcugaaggaguuggcagcuccauaggaggaacaacaauaugaaccaaccaguaacuccagagcucucagggacuaaaccaccaaccaaagaguacacauggugggacucauggcuccagccacauauguaacagagaauggacuugugggacaucaaggagaggagaggcccuugugcuugugaugggccccaguguaggggaaugccaggacagggaagcaguagucgguggguuaguuggaagggggaggagggauggcauuggggugguggugguggaggggaaaugaggaaaggggacaaaguuugaaaugcagauaaagaaaauaaauaaguaaauucaaaaaauaauuugaaugacugaaaacaauuagauuaauuaaaaaaaaaaaagaauuguaguccggagacacagcucaacaguuaagcacacccagugcucuuugagaggacugcuguucaguucucaguacugucucuaaaacuccaacucuaggagaaugccuuccucuggcuucaagggucacaugugcacauagaauuuuaaaaauaaaaauuauucuuuaaaaauggcaaaagagaaugugguauguguauacaaugaaauucuauucaacuauuaauaguaaagacauaaugaauuuugcaggcaaaaggauaguacuugagacuaucauccugaaugaaguaacccagaaccaaaacaucgaugguuuguauucacuuauaaauggauauuaguaauaaauuacaggauaaccuuaccauacugcacagaccaacaggagauaaacaagggguaaggaccaaacaaaguuguuugaaccugacuuagaacagagaauaaaauagucauaggagcaaaauggaaggagagaacuaggugggaguggggauggucagggaaaugggguguuucaguaucagauguagggagacacaggggagaugaccugauguccaugagaaugaauggauauacacagguggcaggcguugggguuugggacaauauucacauguuugucacauugcaugguuuaaagaaaccuuugauaaaaucaaacaccccuucauguugaaagggagauuucagugauaaaauuugcacaucuaaccaaaauaaagguaauauaugacaagucaauagccaacaacuuaaauggagagaaacuuaagagacuaaacaaggcugcccacauacauaagagaccucaaacaaucuaccaaagaaugccuauaccaaaggugauaaacaccuacagcaaaauggcugaauaaaaaaaaauggacccaaagaaaucaguaacccuccuuuauacaaaagauaaaagggacaagaaauaaaaaccuucacaauagccaccgaugaucuaaaauaucucgguauaacucuaaccaaccuacugaaagacaugucuaccaaaaacuucaauucccugaaaaagaaguugaagaaaacaucugaagauggaaagaucuccugugcucuuggauggacaggauuaacauggugaaaauggccacuuuaccaaaaccaucuucagauucaauacauuucccaccaaaauuccaacacaauuacuuacagaaugagaaacagcaauucuuaguuuccuaucaaaaacaaaaaaugcaagaugaauauauauaauaaaauaauuccuggauguaucaucaucccuggucucaagacguaccacagagcaaucagaauaaaaacugcauuguauaccuauggaaaugaacaaguuggucaguggaaucaaaucgaagacccaaaaaugagucacacacccaccaacacuugauuuugacauaaaagucauacaauggaaaaaaagaaagaaaauaucuucaacaaauguugcaggucuaacuggacgucuaugagaggaugaaugcauauagacccauauuuaucccccagcacaaaacuugaguucacaggcaccaaagaccucuagaccacuaaaccagauacacuaaauuuacuaggagacaaggugggaaauauccuugauacauugguucaguagacaauuuucugaacagaacaccaaugucucaggcucuaagaucaauacuugaaacauagggacucaugaaacugaaaaacuucugcaagacaaaggacauugucaauaggaaaaaauggaaaccuacauauugggaaaagauacccaccaacccuacacuugagagagaacuaaaguccaaaauauauaaagaacacaagaaguuagggaacucauaaaucaauuuuaaaaugggguaaauagcuaaacagagaauucucaacagaggaaucucagaaguuugagaaacaccugaauguucaaagucuucaguccucagugaaaugaaaaucaaaaggacucgaagaauccaucuuacaccagucagaauggcuaaaaucaaaaccuggagugacagcacaagcuggcaagaauauugggcaaggggaacacucuucuauugcuggugggagggcacauguuuacaaccccuuuugaaaaguaauuugggggacacccccaaggaaccacacaggauuccccacgggauccuaagaccucuagugaguggaacacagugucugcuccaauccaaucaagcaggaccugagacugcauuaauuaagguaggagauaacccggccugaucaggggcacaagucccuucugguucacuccagcagcgaaguuccuugugcacggaguuucuggacacccccaagguccucacaggacccuccgugggaucuuaagaccucugaugaguggaacacaacuccugccaggaggcagguucgaacaccagauaucugggcaccugccccaaaagaggagagcuugccugcagagaguacucugaccacugaaacuaaggauagaucuagucucccaggucugcugauagaggcuaaaauaaucaccugaggaacaagcucuaaccagagacaacuauaacaacuagcuccagagaauacuagauagcgaaaggcaaauguaagaauccuacuaacagaaaucaagaccacucaccaucaucagaacgcaagggcgaaaucaaccaaguguaaacaagaagaacuauucaaagaauuaaucaaaugaggaguuggaucuuugaggaaaucaacaagauagauaaacccuuagcuagacucacuagagggcacagggacagcauccuaauuaacgaaaucagaaaugaaaaugaaaagggagacauaacaccagauccugaagaaauccaaaacaccaucagcuccuucuacaaaaggcuauacucaacaaaacuggaaaaccuggaugaaauggacaaauuucuagacagauaccagguaccaaaguuaaaucaggaucaaguuaacgaucuaaacagacucauauccccuaaagaaauagaagcagucauuaauagucucccaggcaaaaaaaucccaggaccagauggguuuagugcagaguucuaucagaccuuuaaagaagaucuaauuccaguucugcacaaacuauuccacaaaauagaaguagaagguacucuacccaacucauucuaugaagccacaauuacucugauaccuaaaccacagaaagauccaacaaagauagagaacuucagaccaauuucccuuaugaauaucaauguaaaaauacucaauaaaauucucgcugacugaauccaagaacacauuaaagcaaucauccauccugaccaaguagguuuuauuccagggaugcagggaugguuuaauauacggaaauccaucaacguaauccauaauauaaacaaacucaaagacaaaaaccacaugaucaucucgauagaugcugagaaagcauuugacaagauccaacacccauucaugauaaaagucuuggaaagaucaugaauucaaaguccauaccuaaacaugauaaaagcaaucuacagcaaaccaguagccaacaucaaaguaaauggugagaagcuagaaggaaucccacuaaaaucagggacuagacaaggcugcccacuuucucccuaccucuucaacauaguacuugaaguccuagccagagcgauucaacaacaaaaggagaucaaggggauacaaauuggaaaagaugaagucaaaauaucacucuuugcagaugauaugauaguacauauaagugacccuaaaaauuccaccagagaacuccuaaaccugauaaucagcuucggugaaguagcuggauauaaaauuaacucaaacaagucaauagccuuucucuacacaaaggauaaacaggcugagaaagauauuagggaaacaacacccuucucaauagucacaaauaauauaaaauaccuuggugugacucuaacuaaggaagugcaagaucuguaugauaagaacuucaagucucugaagaaagaaauuaaagaagaucucagaagauggauagaucucccaugcucauggauaggcaggaucaauauaguaaaaauggcuaucuugccaaaagcaaucuacagauucaaugcaaucuccaucaaauuuccaacucaauuuuucaaagaaucagaaagagcaaucugcaaauucuucuggaauaacaaagaaaccuaggauagcaaaaacucuucucaaggaugaaagaaccucugguggaaucaccaugccugaccuaaagcuuuacugcagagcaauugugauaaaaaaaugcaugguacugguauagugacagacaaguagacuaauggaauagaauugaagacccagaaaugaacccacacaccuauggucacuugaucuucaacaagggagcuaaaaccaucaaguggaagaaagacagcguuuucaacaaauggugcuggcacaacugguuguuaacauguagaagaaugcaaaucgacccauuccuaucuccuuguacuaaggucaaaucuaagugguucaaggaacuccacauaaaaccagagacacugaaacuuauagaggagaaaguggggaaaagcccugaagauauggccacaggggaaaaauuucugaauagaaaaggcuugugcuguaagaucgagauuggacaaaugggaccucaugaaacugcaaagcuucuguaaggcaaaagacacgaucaauaagacaaaaaggcuaccaacagauugggaaaggaucuuuaccucuccuaaaucagauaggggacuaauauccaauauauauaaagaacucaagaagguggacuccagaaaauuaaauaaccccauuaaaaaauggagcucagagaugaacaaagaauucucaccugaggaauaccgaauggcugagaagcaccugaaaaaaugcuuagcaaccuuaaucaucagagaaaugcaaaucaaaacaacccugagauuccaccagucagaauggcuaagaucaaaaauucaggugacagcggaugcuggcgaggauguggagaaagaggaacacuccuccauuguuggugggauugcaagcuuguacaaccacucuggaaaucagucuggcgguuccucagaaaauuggacauaguacuaccagaggauagugcaauaccucuccugggcauauauccagaagauguuccaaccaguaagaaggacacaugcuccauuauguucauagcagccuucuuuauaauagccagaagcuggaaagaacccagaugccccucaacagagaaauggauacaaaaaaugugguacauuuacacaauggaguacuacucagcuauuaauaagaaugaauuucugaaauuccuaggcaaauggauggaccuggagggcaucauccugagugagguaacauaaucacaaaagaacucaaaugauauguacucacuaauaagaggauauuagcccagaaacuuaguauucccgagauauaagauacaauuugcaaaacacaugaaacugaagaagaaugaagaccaaaguguggacacuuugcuccuucuuagaauuggaaacaaucacccauggaaggagucacagagacaauguuuggagcugagacaaaaggauguaccaucuagagacugccauauccagggauccaucccauaauuagccuccaaacgaugacaccauugcauacacgagcaagcguuggcugaaaggaccuugauauagcugucucuugugagacuaggccggggccuagcaaacacauaaguggaugcucacagucagcuauuggauggagcacagggcccccaauggacgaguuagagaaaguauccgaggagcuaaagagaucugcaacccuguaggugcaacaacauuaugaacuaacaaguaccccggagcucuggacucuagcugcauauggaucaaaagauggccuggucggccaucacuggaaagagaggcccauuggacacacaaacguuauaugccccaguacaggggaaugccagggccaaaaaaugggaaugcguggauagggaagugguggggaggguaugggggaauuuugggauugcauucuaaauguaauugaggaaaauacguaauaauaaauaaauaaaauaauaaaauaaaauuagauucccaaguauaaaaaaaagaaaaaaaaagcaaaguaauuuggcagguuuuguuguuguuguuguuguuguuguuuucugaaaauuaggaauaguucuaccucaagacacagcuauaucacucaugggcauauacccaaaagauguuccaccauaccaucucaauaacuguugcucaacucuguuaaugaaaccuuuauuugucauagccagaaacagaaaacaaccaagauggacuuuaacugaaaaauagaugaagaaaaugugguauaccuacacagugaaauaucauuccacuguuuaaaacaaggaauccaugaaauuugcaggcaaauggguacgcuuugaaaauaucaucuggagugauguaauccaaacccagacacacaggcaugguauguacucacuuagaaugaguacuuuuucagacguauagugcaggauaaucaugcuaagauccacagaauuaaagaagcuaaaacacgagaacaaaaggaaaaugcuugauucucacucagaagggaaaauaaaauagacauuaggauuugauuuagggagggaaauuugugggagauggagagggaacuaagguggggagcaagaguagggugguaucagggagaagagauaccugaggagaggcaccucugugaugaaacaaagaccagggacugugggggcucuuaggaaucuauaggggugagucaacuagcagcaggugauauggagcccuaagcaaucuucuccuguagccagaagggacuuccaguggaaggaggggaauaccaaugcccucacaaaaacaucaacccaaaauuuauccuaccuacaagauauucagggauuacaauggaacagagauuaagggaaucgccacccaauaacuggcccaacuugagacccacacugugggagagagccaggcuuugacaccauuaaugauguucugcuaugcuuguagacaggagccuaggauaacacuuccaagaggcuucauccagcagaggauggaaacaaauguacagaaccacagacaaacgucaaggggaguuuggagagucuuguggaagaguuggggaaggacauugaacucaaaggagaacauugugacugaggggucagggacaccacaagaaaaccuacacaaucaaguagccugggcccaugagggcucacagagauugaaccaccaaucaaagagcaugcaugggcugcacauagacccccuccccauauguagcagaugugcagcuuggucuucauguggguucucuauaaacugaagggaggaccgcuucacacuguugucugcauuuggauuccucucugcuaguugagcugccuugucuggacucagugggaaaggagcuuaaucucuacucuuauuuaggguaaaaggauuggcuacuauauaccauauuuauauucacuauaaaaaucuuaccuucauugaaccugacaugcuucacuucaguucucugagcugacgauccaguacugugacauagaguuuaaaguuagcauuauugugcuauucauaagaaaaauauuuagcaaguguuuuaaguacuuuauauuugugucccuucuguaucuuacuuuagauguuuacaaacaauauuuuuugaaucaggaucucacuauguauccaugcuggucugaaaacugcucuauggagcauguuggccuuaacucacagaaaucuguucauguccuccuucccaaguucugggaugcaaugcaugggccaacaagacuagacaaaacguugaauucacuuuucagcaauugacuaugauugcugacugcucagcucccaccuuuucucaagaggaaauaugaggaauacuuagcucuuaauuaaaacacaaacaaaagugcacacacacgcaaacacacacacacaaacacaaacacacacacacacacuaaaaagaauuaaagacaagaucgggcaugcucagggugguuuggcuguagacacuuauggaagucuaaaaggaaggauuccaggccugaaggagauaggaacuccagaggaugaccaacuaccagaaucaaauaacaugaacccucagggcacucagagauggaacaaugaaacaaagaacaaacauggguuggacggauaucuccgagcaccuauguagcagaggggcagcuaggucuucacaugggucccaaucaacuggaauggggguaucaaaaaaagcuguucauccuaccucaguuuuauucuucuagcugagcuacuuuuucuguccucagagagagacgaagugccaggguuuggacauacauggagucccaaacugcucagaggugaaguggaggaggggcagggagagacugugggacugggugaccaggagggggucacugagcuagauguaaacaugaacaagaaaaaaauaaaauuaaguuuuuacauauaucauuaaaguuuugaaauguaucuuaaaucacagaaagaacuguuauuuggaaauaauggcucaacauaaacaacagauauacauguccacuaaacagaaaauuucagcauaaagagauguauuccauauggaaaaagcauguggcauuguaagagcaaacucuuucagagcuaaauauucacagaauucaguacaagauuuauaacgcuaauuaaaguaguagacucugcggaaagaaaugaacuacuuauauauccacuuugaaagcuccaucugaaguggggaagaaaaaugucuugaacugcggaaucaccaaaguugcuggguaccugugcuaggacaguuuaagaacaucucccagugaaagguaguuuucugcugacuuggacauuucaggacucaaacaucauuuggaaacacugcuugguaccugugauuauguaugguauaauucuaaagaaauggcuuaugcugucaucuuuggggucacagguuauaaguuuucaggcuuagggacuguggguguuuaucaugguagaacacuugccauagacaccuauggcucuuaauucagugacaaacacuuucaaaaguaaaaauacaguggcaguggagcagcaaccgaucuugguuauccuuuggcuugguggauggcucaugaggugaacuccugaacuaggcagugaucccuggugcaugcuguucuuuguuguggugaaacugucucuuuuccagcucccacuucaugugugcuaagcuuccuaacuaugccucugaguuucuuacaaucucucuaucauuuuaauacuccugacuuaagcaauugucacccucaagagcagcacuaagauugaagaaaagaagaaacuguaccuuuuugcacacuuugcugcuaaaaauucuaccauuucagguuucuguucaaauguugcaaguugcaauggugucaagccauacuauaaaggaaaaaaauauugcauuuuacaaaacuacuuguuucucaacaaucugcucaucaccgauuuuaugaagauaaauagacaagaaaagagucacaagggaucauucacccuacaacaccugcugcacuuucccacacacagcugucuuuucccuuugacacgccuuuucccuguccaacacugccuauaacacggcucccuuccagaacucuccccaaacacucaaggauugcaaucuucuuagcuccguggaguggggccuccauugccacagcccagaauacagaguacacugugcuaugccccuguugaaggagugugcucaggaggggucuggagcagaguuucucaaccuguauuucaaauauauuucuuuucuaaacuaagaauuuaucucagaagcuugacagccucucccauguacaucaaaacuuuuuaaaccuuaaauaacuuuuuuggcauauuuucuccagugaccaaauuucuucauuugccuguuaccucucucguuuuccagucuacccuuauccuaagccaaacacauaucaguaccuucuuugcaccaacacauuucuauuuauucuacaaucacuuaacuugaaaugaauuuauuuuuauugucugugcguaugugauguuugugugguccuaaauacuuuauuuuugaauuuuaaaaucaaggccaauucugagacaaaauacacuauuuuuuuuaaugaacuagcaaaaaauaugaaaaaauauauuuggugaaaauaaaaggguuccacugaauagauucagugagaaugcaugagcuucuguguguagaaaauagaugugcaugucacugcuagaggugcccugggaaugaaguugagugaucuuuaccucuguuuuggcuucaaugucuacguugugcucaaggagcauuuuuacaauccuuaaguuaccccuggauauagcaugguguaaggcuguguucccacugaaaucuaucagauuuggauccgcauugugggugagcaauacggaagcacaauccacauugucucguuggguggccuguaaaauuguacaaagaaauacaucuuaaauucaaggaagucaagagagauguuuucuaccauugcacugaauacuuucccuuaaauaaaacauagaguuucacuucugcauauuaucacucucuuuagacacaaggucuuuuaagaacccccaggcuugcuugccuaacuuuauaaucuccccaccacaucucuuucccagugguagaauuuaaggguucuguuaacacaccuagauauucuaagaauucaggcucugugcugguuuguuguugcauuucagagauuaguucuuugguuagguuuuuuguuuguugguugguuuuguuuguuuguuuguuuguuuuucuuuuugccagugcaacacaggcuuaacacaccuagaaagauucucacuugaggaaaugccucuaucagacuggccucugggcaacuauguggacuuuuuuuuuuuuuaauuuuaaauugagauagaaguuggaaagucucgguuuuaggaguugggguaugccugggacaaaguccucaauuuuguuaaaaaacaaaaacaacaacaacaaguaaacaccugagcaaggcuugguaaaagccauggaaaagcugcauucuccugugaacuccaguucaguucuucccuccaguuccugauuugagcuccugcccugguuccccuugagaaugaucugugauauguaaauguaagccaaauaaccauuuccucuccugaguuguuucuggucaguguuuuaucacagcaagagaaaccaaacaaggacaaccucuauccauuuucaugucaaaacagauggccaauagcuaccuuaaucaagggugugcagccuucaucaucccggauguuaaugcuggaauuauuuucuaauaauagugucaccacgucuggaugguugugggcacaugcauaaugcagcgaaguccugcaaauggaaagggcauuuagggacauucccaaaugcuaaauaagagucccaucuccuuuaagcaccacauacuaugaagcuaauuuucuucugauguaagaaaauaacuggaauugccuuauuuauuuaugacuacucaaauguucauuuacugugcuagggauauagugcauggcuguccccacauaaggcagguguucucucacgaccuucaucccuguacaaagaaccauagaaaaguucccaguaaguucaucucagcaugaauucaaauccuacucuaauaucugguacucacuagugacuacuugggauuucuaugagcuccaugacuccauuuccagauccaaagaauggagauuaagcauagcuguuaucuuacccggggcugcugggaggcuucagguuggaugggcaagaacucugcuagaacauuacaagcauuuacagcuccugaaaguucagcauuugcucaucaugauaaugauuucucuuccuuguuauaacaaacacaacauuucagugaagguaaaacaggauucuaucaacaguacacauauaaaacuuuucuagucaaagaaguuuacaugucuuuaaaaauaacucuuuuucaccaacuaagucuugaacaugauaauccuccuaacucauccuaaauaguggccagugacacugggcucacugucccuuuucauucacauuuuagccucucuaacauuggaaugucauuuaucauuucuauuauuuagcaacuauaauugccaauauuuuuaacuuuguuucucuacaaaauaaaggguuaucaugaaacccauugugccuuacauugaacaaaauauggcacaauccacagguaaauggcaaugauacagaucacuuguaucuauguaaauucuuacaaacaaacaaaacuauaagacaucagccaucaauucuuugucuguuuguuuuucauuucuacaguucauuuuuuuaugcccaugaguaguguuuccauaccugguagcagggggagcacaaccuaguccuuaggaaauagauacaguauccaugguaauccaugcacuagaugguagcaaaggaggaccucaugcuuugccauaaaauggucaaugugcuccuggacucacaccaaaauugggucaauauccauacaaggugauaaccuaugccauccuagcuccuaugcuugauauucaaaaggcuacaagcucaaugaagcaaggguuccaaugagcaugcuucaguucauuuaacauuuaaauuuauagaauguaaggaagcuugacugggcagagaaacauaaugguauaagacuggaaagaucuggagagauagcagaauguauauucuacacaguagauaucuaacuuauguguggggaacgaaugggcugacagaaugaaaaacuacaguuggacaacucaguguuuuuaaagaaaacauucauuaagcaaaagaauauccuaaacuauaauuuauaauuuauucaucuauuauuuauaugaagcuccaacuucaagccucuuugaacuacaaaauguucaaaaagcuuguggacuacagaaaaucuacaguugugucauugauucaccuucauaaccuaguacaaccuaaaaauaggaaauaagaaugaggggcuuggaugauugguaaaacucaauugguaaaacacuugcccuggaaaccugaaugcagauguggggauaugggaauccccaaaccuuacucgccuacaagucugagaauuagugugcuccaagagaguaaaucaaacauaccaugggauuugggugagugaacaugucucuaaaacugagggaccauuggguggaaccuaccaagggcccugauggccagaguucaguccccagaacccacaauguggcagaagagaacugucaaguggcgauuucucugauuaccccacacuuaguuccacaugugugcgacacaaaaaagugagaggaagacaaugucagucccuuaacauguguaucaaugcacaaauaacauguacauaugaugagaaaugggauugguggugguggggaaauguauauuuguuccaguucaaaaugucuuugauccauuaacaaaaaugggucauauugaucuaagauuucauagugauuuuuuccauuucaguugacaauuuaucuuaugauuaauuuuucaguguuguauauuaguguuaauggucuauauauugagacaaaucuagacagguggcuuggcaguuaacagcucuagguauguuuucuagagcacucagcuuugauugcuagcacccacauggcagcucacaacuguguauagcuccaauucgaggggaccaagaaccugauugugucacacauggugcaucgaaaaugcacagagacaaaaccuuugugcgugcuuguguguguggguguguuuguguugcugugcaugagugucuucaaaguuuuaguguaacauaaaaauaaaaugauguaguuuaaucaaggccuagggccugguguuccaggguaugcaggucucauauuacuaagagcauuaaacacaaugcaggagaccccaguagaaaugacccuaagcaugacaucucuccuuuacuaguauguggcccugaaaguugauuuuucuguuuaucucugaguauaccugacagaucccacccaccucuguguacccccccucaccaauuucaagccccauuaccuuuuccuucuaucagauucauccacaugauguugacuggaguggauuaacuucucuguuguaucaaggucacccacgcuggccgcucguuguaauggaccuauaggaucauagccaaucaaguagaggggauauuucuucuuuuucugaggaugcaugcaucuaagauccagacaugaaugccacaggcggguguaccagcgucuccuucuggggauguucauugucugggcaccauaauugauuucuuccuccauuauuggagccuagggucgcccacgaaucuucuucccucucuucccuucccuuuaacugauaucugacucccaaauucuauaauuaaagaaaaaaaggcaacucuuguaucuaaaaagcaggagagcacagccaguucacugugaagugagcuguacuucagcacguagcagcagcacagcucugcuagcaccaccccagugacaugcucugagcacacaauggugcuaucuaugaugcguguauucuaugcguuucuuccucagagugcaguggcaggagcccacccuccugggugccugggcaaagcacugucaguuuugacucugcacuagaucuuugugcauggccuucaaagggaauacugagggcagauaggugaugguucagauccuuugcaacccugcagcccugccaauauguggaccuaacuggccugaugggacaaaagugaucauccuguguugccaaacccagacccaacaccacaaauauguuauguggccucuuuuaaggauguuagugguuaaggaucugagaugagaacuaugaucuaaauaaccgcacaggauuaguaucuuguaagaaaccagugggagaaugcuaucucccaaggaagaacaaguaguguagaguguuauaaagagauaaagaaaagcuagaacaggaggguuuaauaagaggcgauugggagagacagguagaggcaugggguacacccuuccacugcccucaccucuuucaggcuccguuaccugccccuccuauucaucaacaugauauugacuggaguugagucucuccauuguauccaggucacccuuguuggcugcccagggauuccuaccugaaaauguagagggucaguuuccuuugguuaugcaagcacccacagcccuggcaugcaggccuagcuaaaguaagaaauaaggggagggaccacaaacacuaaaggcccuuugaaaagcuauauggaaaucagcuacucuagcagcuuccuauacauuuaugcaagggauccuuauggagccaaaaacugacagaggagacaaggcuccaacuacacauccugugccaccaaguuacaccuccaguaacaggaauggguugcaaccuguugagucauuaaccaaaggguccuacauuaagccucaacuaucagcacaggcuagugccaagaguauuggguggucuacacaaugugaugguuaggacugauuucugaaggucaccuuucugucaucacagugcaauagguugagcugggucuaacuagacucuucacccuacuaaccagaguucauaagauuggaaggaaaccuguuacuacuggaggacaaaggaaauccucaauaucugucagcuacaaacccugaaacuuacaauaacaccuacaaggcagcucacaaccaucuucaaagccaauuauaggcuauccaaaucccucuugcaucuucacaggcccagacaugugcacagugcacacacauacauguaggcaagacauacauacacaugaaauaaacauaauuuauauuucaauaauaauggguuuauagguauguaauacacuuauguacuaaguuaauucuuagaaaguauacaaucuaguagugcuuucuuaguaugucauuaaaauuaugcacccaucacucuguuuuaaaaacauuuuuaucuuuaagaagaaacccuagcaauguauugaaucauuccugcaucccuggaugaagucuacuugaucaugaugggugauguuuuuaauguguuguuggauuucuuuugcaagucuuuucuugaguauuuuuucaucaaugcuuauaaaaggaauuggucugaaguucucugucauuguucagugcuucuugguuuagguaucagggugacuguugcuuauaccaugaguuuggcaguguuccuucuguuucuauuuuguggacuaguuugaggaguauuagcucuucuuugaaguucugguagaauucugcacuaaaaccaucuggcaucuggcccugggcuuuucaguugugagacuuuuuuuuuuuuaguauagaauggagcuuauguaggucauggggaggggaguuaagaggguagcagagucagagaaaggcagacagaaggagaaaguagagacauaggggcuggccauggucacauggagagagaggggaagggagugaaagagagggggcacaagggggaagagagaggcaagagagcaagaggguaagagcugguugugaggcuuuuacugcuucuacuucuucagggauuauaggacuguguaaauaguuuaccuggucuugauuuaacuuugauaagugguaucugucuagaaaaagaaaguccauuucauugagacuuuccaaccuugugaauacaggucuuucaauaaaaccuauuaauucguuauauuuucugauugucuauuguuauguauccuuuaucacuucugauuuuuguuuauuuggauacugucucuaugccuuuuaguuuggcuaaggguuugucuaucuuguugauuuucucaaagaaccagcucuugauuuuguugauccuuuuuguuguuuucuuugugucuaauugauugaguucaguccugauuuggauuguuuccugcugucuacuccuuuuguguguguuugccucuuuuacuagagcauucagauguaguuuuaaauuucuagaaugagggcuuucuaauuucuuuagggaggccauuagagguaugaacuuuccucuuagcagcacuuuuauugugccccuuaaauuucagguauguugugcuuucauuuacauugaauucuagaaugucuuuaauuucuuuauuucuuccuugacccagagaucauugaguagagaguuguucaguucccaugaguguguaggcuuucugguuuuucuguuguuauugaagucuaccuuuaaccuacuguauucugauaggaugcaaggggucauuucaaauuuuuuguaucugaagaggcuuucuuugugaccaacgauauggucaauuuuggagaaaguuccagaaggugaugagaaaaguuacaugcucuugauuuggggugaacuauucuauacauaaugcuuagguccauuugauugauaacaucuguuaguuuuauuauuucuccauuuaguuuuugucuggaugaccuguagauuggugaaagagaaguguugaagucucccauuaauaaucugugggguuugguguaugcuuuaagcuuuaauaguguugucuuacaaaugugguuguccuuguguuugaaacauagauguucagaauugagauaucaucucaguagauuuuucuuuugaugaguaugaagcauacucauacagggaagccuguaugaaguauaugaaguauacucauacaguaugaaggauacucauagagggaagccugucucuuuugauuaucuuugguugaaagucuauaguauuagauauuagaagguuuucgucuuaguuugacucagcuugauacuuaggucugcuugcuugaaaaauuuugguucagcccugcacucugagguaaugacuaucuuuauugcugauguguguuucuuguaugcacuacaauaguguaucuuguuuucacauccauucuauuugcuuguguguguguguguuuuuaauuagaaaauugagucgauuuauauugagagauauuaaugaccugugauugauagugcuuauuuuuuuuuugaagcuuaaaaauuaaaguuuuuuuucugagugcucaggaagguggccauuucaugaucugaacuguaucccugaauaaaggcuguacagcauuuuuauagaauggagacaaaaagcaagggugggcuguugcauugaccaauuuugacauaagggcuuaagcaaggaaauuaacaaggaaguuaacauuggugacauucuuggccuuaucugggucacauguuucaggguccuugauuuagcuuuugcuggcagguccccuucuggacucuggcccagaauuuuagaauguuaagggaacaaaggagugggcaagucacacacauuaauuaagucaagacaggcagcacacuuaugacuugugugccuuaguuuacauaaagggauaacagcugucuucccuuuuuacauccuccacuggccaucagacaaaccuggaacacuugaaggagcagaacaggaaggaguuagguuguggagccuaggaacauaaacucaguuuugagccugucagcaauguauuccaaggaguuucugagaugacuggacucaggaaacugucuccuaacagggugggcacaggugcauguaggauaaaaggagacguguaagagcccuaaguaacacaacacaaugcugcugaaagcucagaacauucucaaaggucucacuaagcucaaaagguaagaaaucuuccagaaguuucuugucucacauaccugcuucccauccccauuccucauugccucuagggcuugcagucuauaggcccagccugggcugccuuaggagcaugugguucaggccucauccucuccuccugggaaggcaggucacccauguggcaagcuaguggcucugaccuugaaugccugugugguguuugccucaugagcucaaucuaacaaacaugcuccacaaauuguuucagaguaaaaaugaaccagaguguuccuguuuaaaaacaacagccuucgguccuuucucuaacuccucacuuaggaccuggguugaguccaaugguuggcugagagcauccgguuugggguuggggggugagcagggagggaaccaggaagguggauaacaugugaaauguaaauaaagaaaauaaccaauaaaaaauuaauucaagucaauaaaucaaagaaggaguuucaugaaaaaacaauaacagcaagcccaccauguaggccccucccugacugcagggccugagagccaggucuggccauugauaauucaguuacauaguccucuccccucugacuuuaucaauauuugauggcaggcuucagcaugcuuuugguggcaaguccuucuggagccccuucucaugugacagugaugcaacauaggucucagcaggagcucacaucacaagucaccuccuuccugaggucaagguggcccaugauuggcugggcagcuguggcuggagccaaggcauuauguugaugaauccuaaugaugugggaaggcccuggcaagccaccauccaauuagaagccuguucaugucuggguggguuccagacagaggcagggcuaggaucaggcaggagcaggcacaucuaggggaucugcuuugcagguggauggggguuuuacaugggucaucaucuccaagagaaacccacggagggccauuuaauuaaguccagcagcugcucagaaaccauagucacgccagagcagugcaugaugucucuguacagguuacaaggaggagggcacuccccacuacaauagcacagguggcugcccgcacccucagaacaccagccucugugaaguucaucacuaucugcauccauuaaacugugucuuuggcagugaggcagcucugucuggugacagggccuguugguaaauaaggguguagugacauguucugauuggccagaaaugaauauacaaugucaguuucugaccucaucucagauaaauaggagggggcgacaaggcaggagggucaauuugcggcugcuaggugucucuggucuggauuccuaguccagaaauaacucagugccuucaggaggccagacaugcuggccgcaccaggagccuacguaaaggcucacagcugacuguggagcaggcauuguugaacuccacaguucuuucucugauauagaaauguccccugucuuggagagucucccgaacauggauuuauuauucuauaggaaagaagccugacauucuguuggcucagaccaagguacuuguuuuagggccagagaccugagcuuucuucucuugauguuggcacucagaccuggcucacucacauagaugggagugccccaagaccuucucaggacacagggagacccuacaagggacuccauuucaugcucauuaaccuggacuggccagaccauucacagguggcuugauccauucucucuaccucuaccuaugguaaguucagcauagugaagagaacugggauuuuucucauccacuggcagcugcgugcuccuccggaugggcagguaggguagaagagggagcuggcaaaaaucuuggagucaggugcccuucucugguuccccaugaugguccugcgacacugugggucacuucauguucuugugcuauuugcuccuauuuauauuuguuuuuuuuucuuuuuuccuuuauuucuucuuuuuuccaguggcauuauuuuuuuuucugguccaauaucuauugacaaauucagacagugcuuaauaaaacuuuaguuaggucacuguacaccuuccugauaaaauuugcauauucaccuuccguuuauuuuuuuguagaacaugauuuuauauuuacaacugucaauauucgacauuaaaaaucauuuuaaagacauauuuuguuauuaugucuccauugucauuucugauuuuauuaauuuggauacugucucugugccuucuuguuagucugccuaaguguuaaucuaucuuguugauuuucucaaagaaccagcuccugguuugguugauacuuuguauagcucuuuuucuuuucuuuuuuuuuuuaagauuuauuuacuuauuauauguaaguacacuguagcuguccucagacacuccagaagagggcaucagauuuuguuucggaugguugugagccaccaugugguugcugggauuugaacucaggaccuuuggaagagcagucggcgcucuuaaccacugagccaucucgccagucccguuccuuuucuuucuauugguugauuucugcccugaguuugauucauuccugccuucaucuccuguuggguguauuuuuuucuuuuuguucuagagccuucaguuguacugucaagcuguaagcucucuucaguuucuucauggaggcacuuaaagcuuugaguuuuccucuuaaaauugcauuguguccaauaaguuuuggugugauaugucuucauuuucacuaacuucuaaaaagccuuuaauuucuuauuucuuccuugaccaaguuaucacugaguagagucuuguucagcuuccauguguaugugugcuuucuguuucuuguuguugcuauuguuguuguuguuguuguuauuuaagaccaaccuuaguacauggugaucugauagggugcaugagauuauuucauucuuuuugugucuguugaggccuguuuugugaccguuuauauggucaguuuuggagaagguaccaugagguacugagaagaagguauguuuuuuugcuuuaggaugaaauguucuauacauaucuguuagaaccauuucuacuguuaguuucacugugccucuguuuacuuucuguuuccaucaucaguucauugcuaagaguaucccacuauuauugugugggguaugaugugugcauugaacuuuagcaaaguuucuuuugugaaugugguugcuuuugcaucuuggagcauagauguucagaauugagaguucaucuugguggauuuuuccuuugacugguaugaagugucuuuccuugucuuuuuugauaacuuuugguuaaaaauugauuuuauucaguauuaggauggcuaguccaucuucuuucuugggaccaauugcuuggaaaauuguuuuccaauauuuuacucugagguagugucucucuuugucacugagguguguuuccuguaggaagcaaaaugcuggauccuguuucuauaucuagccugcucaccuaugucuucuggggggaauugaguccauuuauaguaagaguuauugauuaaaaguaauuguuacauccuguuauuuuuguuguuggagguggaauuauguuucuguggauaucuucuuuuggguuuguugaaagauugcuuucuugcuuuuucuaggguguaguuucccuccuaguuuuggagauuuccaucuauuauucuuuguacagcugguuuuauggaaagauaugguguaaauuugguuugucauggaauaucuugguuucuccaucaaugguauuugagaguucugcugguaaaguagccuaggcuggcauuuguauucucuuagggacuguaugauaucugccuaagauuuuucuaccuuucagucucuggugagaagucugguguaauucugauaagucugccuuuauauguuacuugaccuuuuucccuuacugcuuuuaauauucugucuuuauuuaguccauuuauuguucuaauuauuauaugacaggaggaauuucuuuucugguccaaucuauuuggaguucugucggcuucugguauguucaugggcaucucuuucuuuagguuagggaaguuuucuccuauaauuuuguugaagauauuuacuggcccuuuaaguugggaaucuucacauucuucuauaucuauuauccuuaaguuuggucuuuucauuguguccuagauuuccuggauguuuuggauuaggaacuuuuugcauuuugcauuuucuuugacuguugugucaauguuuccuauugucuuuucugcaccugagauucucuucucuaguucuuguauuuuguuggugaugcuugcaucuauaacuccugaccucuuuccuaggugcucuaucuccaagguugucucucuuugugauuucuuuauuguuucuacuuccauuuuuagauccuggaugaugguuuuguucaauuucuucaccuguuuguuguauuuuccuguaauucuuuaagggauuuuuauguuuccucuuuaaggacuucuguuuaacugugucuuccuguauuuuuaagggaguuauuuacauccuucuuaaaguccucuaucaucaucaugagaugugauuuuaaaucagagacuugcuuuugugguguguugggguauccagggcucgcuguagugggagaacuggguucugaugaugccaaguaggcuugguuucuguugcuuaugcuuuugcccuugccucuugacaucugguuaucucuggcgcuagcuggucucacugucucugacugggacuugucucuccugcaagccugugugucaguacuccugggagaccaggucucucugagaggaauuuggguaugaaaagcuguggcacagugucagcuccugggugcagacagaaaccagaaggaccuguccauggcuguucuuuggauccuguguccugaggguucugggcaggucccuccagucuuaccugugcucacagguaugucugcacuccagugcuacccacucuaucccugcgguauuuggcuaucagcuaugugcauuucucauggaugauucucaagcuguggggaauuccuauggaugauugauaggauauagguuuucccucaagaugauugccagguuggggguguaccaugugcauaacuaacaggcuguagcuauuuccuguggaugguugauagguuaugggcuuuuccuaugaagacugacagguugaggguauuugcuauggauaauugacaagcuguaauuguuacauaugccugacaggcugugggaauguucuaaggauaauugacacgauguggguauacccuaugaaugauugaaagucugugggcauuuccugugaaugacuaacaagcugugggcauacauugugggugaaugacaagauuuggguacuuucuauacaugacagauaggccguggacauuuccuauggaugauuugcaggcagcggccauuuacuauagaugagugacaggcuguggacauauccuguggaugacugaaaggcugugcauguuuccuguguguauugaaaaguuguagauguguacuauguaugguuggcaggcuuuggguauuuccugugaaugauugacaggguguaggcauuuccuauggaagauuaaccgauugugggcuuguccuuuggacgagugacaggguugguauguguuuacuguggaugauugacagucuguggccaggacaugugguugauugacaggcuguuggcauugccuaugaaugauugacaggcuguggguguuuccauuggaugacucacaggcuauaggaguuuccaaugcacaauugacaggcuuugaacacuuuguaugcaaaacugaucaguugugcgcauguccuguagaugauuaacagaccauggccauuuuuuaugcaugauugacaggcuguaggaauuuucuguggaugacuggcaggcugugauuauuucuucugguugacucucaggauuugugaguugcuuauagauaacugacaggcuggggacguuuccagugaaugguugacaggacuugggcacuucuuaugggugacugccagccugucggcuuuuccuaugaauaauuaacaggcugugggggguuguugcacagauuuugauaagcuguguguguccugugggugauugacaggcuuugggucuugcauaggaaugaccuauagaugcaauucuacagaucucuugaaucuauauaaauuuuugauaacaaaugaaaaucuaaacccuaagucaucauuacuuugauuuuuuuuucauuucuuuuguuuuaugcccaugaguaguguuuccauaccucacuaccagcaggagcacaacacacuccuaagguacuagauaaaguguccaugguaauccaggugcuaaauguuagcaaagcaggaccucaugcuuugccauaaaauccucagugugccccuggacugacaccaaaauuggguaaauaucccuacaaugugauaaccuauacuauccaacccccaugcuugauauucaaaagacuuuaagcaaaaugaaacuaggguuccaaagaguauggcucguuccauuucauaauauaaauuuauagaguguguuaaacuugacagggaagaggaacauaaagauauaagaauaggaagaucuggagagauaguagaaucuauauucuacacaguagcuauguaaguuaugugugggaaauaaauggacuaacaaaaugaaaaacuacaguuggacaguucaguguuuuuaaagaaaacauucaaugagcaaaagaauaucuggaaacuaaaauuuauaauuuauucuuauauuaucuauaucaagcuccaaauuaaagaauaauuagccccuuagaacuacaaaaugaucaagaagcaaggggacuacagaaaaucuacaguugugugauugguuccccuucauaaccuagugcagaauaagaauaggaauaagaauaaggggcuaggguggucaguaaaacucaacugguaaaacacuugcccugaaauccugagugaagauguggggauaaggggauccccaaagcuuacuugccugcaagucugagagucagugugcuccaagagaguaaaucaaacacaccagguauuugggugagugaacaugucuuuaaaacugagggacccagaacacauaauguggcagaagagaaaugucaaguggcaaauccucugaccaccacacacuuagcuccucaugugugggacacaggaaaaugagaggaagacagugucagucucuguccuucacauguguaucaaugcacacaccacaugugcacaaggugaauaugggggagcagggucaugguuacaguucaaaaugucuuuauuuggcccauuagccaacacaagacauauugaccgaauguuucuuggugauauuuuugcauuaaaguugacaauagaccuuaugauaaaacuuucuguauuauauauaacauaguauaaguaauauauuaugaagagauggcuuggagguuaagcaaucuaguuuuguuuguagugcauugaguuuugagugcuauuacccacauggcagcucacaacuguccauaacuacaauuccagggcauuccccacucaauucuaccacauagugcauagaaaacacauagcagcaaaauacuccucuauauaaaucuacaaaaguuaaacauguacaaugaaguaaaauguauguaguuucuuuaacuaagucacguuaaaguauccaauacaguacuucaaaagagacaaugggaaaguauuuauaaacuaacuaaaguuuuugguuugcuuucuuuauagaaggccuaggagcugaugucuuaaaguaugcaugucuaggugcccaggacccuaaagcagguaaaugaucuagugaggcucaguauaaaaaagccuaagggaagcagaaaacuggccugaccaggggaaaaguuccuucuaguuggcaccagcaccaguucaccuagggagcagaguugguggacacucccacggucucuagaggacucuccacgcgaucuuaggaucacuggugaguggaacacaacaucuguuccaguccaaucgcacgggaccugagacagcagaagacaagcagaaaaccggccuaaucacgggcacgauucccuucuggucagcaccagcaugcggucaccuagggcauggagucuguggacagccccacaguccccagaggacucuccacgugaucuuaggaucacugacugcauggcaacaccacuuccaggcacuguaacagguccgggaucuuaggacaacaggaucucaggauaaccuaaggugggucacaccaguauuucagggucucagaggaaacuugacugccaaaaacucugacacacccagaaucucagguuaacaggagcccacaaucaaaggaucacagaaaaagcuggacucugaggaguccugaaucaacugggauuauaggaaggauagacuccaaucagguauagugagggcagggagcacaugagauaaucugauggcaagaggcaagcuuaagaacagaagcaacagaaaccaaaguuacuuggcaucaucaaaaccaaacucucccaccguagcaaguccuggauacaccaucacaccagaaaaacaagacauggaucuaaaguuacuucucaugaugaugacgaaggacuuuaagaaagaaauacaggaaaacacagguaaacagcuagaagccuuuaaagaggaaacacgaaaaucccuuagagaguuacaggaaaacacuaccaaacaguugauggaauugaacaaaaccauccaggaucuaaaaauggaaguagaaauaauaaagaaaacccaaagggagacaacucuggagauagaaacacuaggaaagaaaucaggaaccauagaugagagcaucagcaacagaauauaagagauggaagagagaaucucaggugcagaagauuccauagaaaauauugacacaauaaucaaagaaaaugcaaaaugcaaaaugcaaaaagauucuaauucaaaaaaucaaggaaaucaaggacacaaugaaaauaccaaaucuacagauaauaggaguagaugagaaugaagauuuucaacuuaaaagaccagcaaauaccuucaagcaauauuauaaaagaaaacuuccccaaccuaaagaaagagaugcccaugaacauacaagaagccuacagaacuccaaauaguuuggaccagaaaagaaauuccucccgucacauaauaauuggaacaacaaauggacuaaauaaagacagaauauuaaaagcaguaagggaaagaggucaaguaacauauaaaggcaggccuauuagaauuacuccagacuucucaccagagacuaugaaaaccagaagaucuuaaacagauguuauacagacacuaagagaacaaaagugccagcccagguuacuauacccaacaaaacucucaauuaccauagauggagaaaccaaaguauuccaugacaaaaccaaauucacacaauaucuuuccacgaaucuaguccuucaaaggauaauaaugggaaaacaccaauacaaggauggaaacuaugcccuagaaaaagcuagaaaguaauccuucaacgaaccuaaaagaagagagccacaagaacagaaucccaacucuaacaauaaaaauuaaaggaagcaacaauuacuuuuccuaaauaucucuuaauauuaauggacucaauucccaaauaaaaagacauagacuaacagacuggauaaauaaacaggacccaacuuuuugcugcuuacaggaaacccaucucagggaaaaagacagacacuaccucagagugaaaggcuggaaaacaauuuuccaagcaaacgguccaaagaauaaagcuggaguagccauucuaauaucgaauaaaaucgacuuccaacccaaaguuaucaaaaaagacaaggagggacacuucauauucaucaaagguaaaaucuuccaagaugaacucucaauucagaauaucuaugguccaaaugaaaggccaucaacauucauuaaagaaacuacaguaaagcucaaagcacauauugcaucucacacaauaauacugggagauuucaacaucccauucucaucaauggaaagauccugggaacagacacuaaacagagacacauggaaacuaacagaaguuaugaaaaaauggauuuaacagacagauaucuacagaacauuuuauacuaaaacaaaaugauauaccuucuucucagcaccucaugguacguccuacaaaauugaccauauaauuggucacaaaacaagccucaacagauacaaaaauauugaaauugucccaugcauccuaucagaucaccacagacuaaggcugaucuucaauaacaacauaaauaauacaaagccaacauugacauggaaacugaauaacacucuccucaaugauaccuugggcaaggaagaaauaaagaagucauuaaagaccuuuuagaguuuaaugaaaaugaaggcacaacauagccaaacuuaugagacccaaugaaaccauucgugagaggaaaacugauagcucugagugccuccaaaaagaaacuagagagagcauacacuaucagcuugacagcacaccuaaaagcucuagaacaaaaggaagcaaauucacccaagagggguagagggcaggaaauaaucaaacucaggggagaaaucaaccaagaggaaacaaaaagaacuauucaaggaaucaagcaaaccaggaggugguucuuugagaaaaucagcaagauagauaaucccuuagccagacucacuagagggcacagggacaguauacuaauuaacaaaaucagaaaugaaaagggagacauacaacaaauucugaggaaauccaaaauaccaucagauccuucuauaaaaggcuauacucaacaaaacuggaaaaccuggaugaaauggacaaauuucuagacagauaccagguagcaaaguuaaaucaggaucagauuaaugacuuaaauaguccuauauccucuaaagaaauagaagcagucauuaauagacucccaaccaaaauaagcccagaaccagauggguuuagugcagauuucuaucagacguucaaagaagaccuauuccaguucuucucaaacgauuccacaaaauaacaacagaaguuacucuacccaacucauucuaugaauccacaauuacucugauaccuaaaccacauaaagacccaacaaggauagagaacuucagaccuauuucccuuaugaauaucgaugcaaauauacucaaucaaauccucauaaagcaaauccaagaacacaucaaaaggaucauccaucaugaccaaguaggcuucaccccagggaugcagggaugguuuaauauacggaaauccaccaacguauauuaaacacuauaugaacaaacucgaagacaaaaaccacgugaucaucuuguuagaugcacagaaucauuugacaaaauccaacacccauucaugauaaaagucuucuaaagaucaggaauucaaggcccauaccuaaacaugauaaaagcaaucuacagcaaaccaguagccaacaucaaaguaaauggugagaagguggaagcaaucccacuaaaaucagggacuagacaaggcugcccacuuucuccccaucuauucaauauaauacuugaaguccuugccagagcaauuggacaacaaaaggagaucaaggugauacaaauuggaaaggaagaagucaaaauaucacuauuugcagaugauaugauaauauauauaagugagccuaaaaacuccaccagggaacuucuaaaccugauaaacagcuucagcccaguagcuggauauaaaauuaacucaaacaaaucaguggccuuucucuacagaaaggauaaacaggcugagaaagaaaucagggaaacaacaccuuucacaauagucacaaauaauauaaaauaccuuggugugauucuaacuaaggaagugaaagaguuagaaagggcaauuugcaaauucaucuggaauaaaaaccuaggauagcaaaaacucuucucaaugauaaaagaucugguggcaucaccaugccugaccuaaagcuguacuacagagcaauugugauaaaaacugcaugguaggccuuuucugucuggacuggaggcaggaagcugugaguggccggugugcucugaucuguuggagcuuacugcugccaggcaggcugccgaggccaggcguggcaccaguugagugaagauggugggccagaacagcgccaucgccgaggaugugugaggugcccucuucauuggguacugcauccacuucuacugcaaaagguggagugaccccaacuucaagaacgggcuucgagaacgaagaaagaaacggaagcuugcuaaggagagagcugggcuuuccaaguuaccugauuuaaaagaugcugaagcaguucagaaauucuuucuuggagagacacagcuuggugaagaguuauuagcacaaggugacuacgagaaggguguggaccaccugacaaaugccauugcuguguguggacagccucagcagcugcuccaauuuucugaaaaaccgccagacugauuuccagagugguuguacaagcuugcaaucccaccaacaaugaaggagaguuccucuuucuccacauccucgccagcaucugcugucaccugaauuuuugaucuuagcaauucugacugguuugagguggaaucucaggguuguuuugauuugcauuucccugaugauuaaggaugcuguacauuuuuucaggugcuucucagccauucgguauuccucaggugagaauucuuuguuuuacucugagccccauuuuuuaaugggguuauuugauuuucuggaguccaccuucuugaguucuuuauauauauuggauauuaguccccuaucugauuuagcauugguaaagauccuuucccaaucuguugguggccuuuuugucuuauugacagugucuuuugccuuacagaagcuuagcaauuuuaugaggucccauuugucgauucuugaucuuacagcacaagccauugcuguucuauucaggaauuguuccccugugcccauaucuucaaggcuuuuccccacuuucuccucuauaaguuucagugucucugguuuuauguggaguuccuugauucacuuagauuugaccuuaguacaaggagauaggaauggaucaauucgaauucuucuacauguuaaccuccaguugugccagcaccauuuguugaaaaugcugucguuuuuuccacuggaugguuuuagcucccuugucaaagaucaagugacauagguguguggguuuauuucugggucuucaguucuauuccauuggucuacaugauugucauuguacuaguaccaugcaguuuuuaucacaauugcucuguaguacagcuuuagguuaggaauggugauuccaccagagguucuuuuauccuugagaagaguuuuugcuauccuagguuuuuuauuauuccagaugaauuugcagauugcucuuucuaauucguugaagaauugaguuggaauuuugauggggauugcagugaaucuguagauugcuuuuggcaagacagccauuuuuacuauauugauccugcccauccaugagcaugggagaucuuuccaucuucugagaucaucuuuaauuucuuucuucagagacuugaaguucuuaucauacagaucuuucacuuccuuaguuagagucacgccaagguauuuuauauuauuugugacuauugagaaggguguuguuccccuaauuucuuucucagccuguuuaucuuuuguguaaagaaaggccauugacguguuugaguaaauuuuauauccagcuacuucacugaagcuguuuaucagguuuaggaguucucugguggaauuuuuggggucacuuauauauauauacuaucauaucaucugcaaauggugauauuuuggccucuuccuuuucaauuuguacaaguggauauuaucccagaaagucagaauacccaaaauacaauuugcaaaacacgugaaccucaagaagaaggaagacaaaaguguagauacuucgauauuucuuaccugggggaucaaaauacccauggaaggaguuacagagacaaaguucagagcagagacugaaggaagcaccauccagagacugccccacguagggauccaucucaugaacaaccaccaaacccagacacuauuguagaugccaagauuuugcugacaggagccuaauauaggugucuccugggaggcucugccagugccugacaaauacagaaguggaugcucacagucauucauuggauggaacacagggcccccaaugaaggagcuagagaaaguauccacggagcuaaagggguauguagcucuauaggagaaacaacauaaacuaaccagcacccccagagcucucuaggacuaaaccaacaaccaaagaaaacacauggugggacuugugucucuagcugcauauguagcagaggauggcuuagucauucaucaaugggaggagagucccuugguuuugggaagauucuaugaccugguauaggggaaugccagggccaggaaguggcagugaauggguuggggagcaggggggaggggaugauagggaauuuucagggaggaaacuaggaaaggggaaagcauuugaaauguaaauaaauaaaauaucuaguuaaaaaaauggacugcuucuucucaucagaauucuccauggugaacaacucagaaagucuuccucuaaagagccaagucuacucuccugcagaaggccucucugugcucccagccacaguuuccaccaagccaugcugccugccaggcaagccaaagacucuucucccagagggagacccagcuggggcucucuuccucccucuuuucccuuuggcucuggguaagauccagcccucaggccccaacuccagucucagcucuucugaggcauccaguggcaucuggaauguccaagagccugagaaccuguuguccuacaggaagcucaggcugugcucccguaaucuuggagaaggguccuagggcuucuugcaaccugacgcccuccuggcaccagcaugcauugcacacagucaaaacugcucacaucacaccucacccaggggcccaagcccugagccagauguaggccacccuuuaacccacaaacuaauggacccuuugggcucucagagacuuaaccaucaacuaaagaacauacacaguugggcucuaagucuauaugcacauagguagcagaugugcagcuuggucuuuguguggcccuugcuaaaaaaaucuguaguaggggcuaucucaaagggggucgccuaaaugcaggauaugcuguucuagcuggacugcccugacuggacucagugggaguggaagcaccuagccuccagagauuucauauuccagggcuggaagaugaccaggcggcccccacccacucaagaggacaaggggaggguaagaaggggcaaggauugugggagagacugacugggagggaacagugagcaggaugugaaguaaacaaguaaaaaauaaaaacaaauaaaaaaaaacauuuuccagaaaacaucacauggcacaaccgagacuccaauaaaacaauaauuuuugacuucagucuucuaucagauaaaacauuuuauuuauauauaaaauuuuuauauuuacauauauauaauauacuuccuccucacacacucugugugcauauaucaguguguguuggaguguucagcuccagcggcaucuagaagaaaagcaagaauuaucaauaguaucaucagccacaucauugguggcacugucaggagcagcagcaucagcagcaucagugucauuaucaucaggaucaauguaaugagaaacagugagaaggugaaggcuuguuuuguuaauuuuauucucagauguugcuuccuuuggaauguuuguuuccaggcugauacuauccucacaagucagaguucagaagagcagagauaaauagacaccaacguuuaacagacacuaauguuuucaaugggagugaaaaaaaauuaccucauuccaggaugggagacaaccaaguaccauggucaguuguguuggucuaaacugguuuuguuacacuaugugaaguauuuucaauaaguugggaaaaggaaacaauguuuucugauucuagguaaugcucaaauagcaugaaauguauuaaucaugacuauuaguaucaaagauaucuacuuuucuaucuaaaauaaaaguucaucuauuuuaagcaacuacugugguccaccuuaccggguuuaucuuuucucuuggagggagguccuuggccauuuucuucauagcacacuugcgaauuccauuucuaauccacaucaucauugauaacaggaauguaagaaaccacaucaagggcauuacuggcagcaguagcauaucugguucccaaagaaaaccagguaccuggacaguggacccgcuauggccagugagaucagcugacucuaaagcgucauaaaaauccucagcuauaucuucaucuaggucagcaacaggacuggguuccucaccugaagaaagaauagcauacuugucuuaugcuccaagcagugucagaacauucaggucaguucuuucaauggaaucuagggaacaguaagugcagguaccaggaguaggcucugggucacaaugggguguggcccuugcaugcuccauguaaaaaucugaaucaguuaugaaguccaacccaaugucacuaccuguuucugagucauauuuuucaucagauucagaacugucagaaggacauggggaaggaauuuuaccaauaucagaaggagcaggacugucaggagcacauugugaaggacuugguucuaugucagcaggaauccuggugucagcagcacagguggaaugaguuggcucaacaucagcaggagcaccccugucaggagcaaguugugaaggaguugguucuaugucagcaggagcccugcugucagcagcacagguggaaugaguuggcucaaugacugcaggauccucacagucaggagcacacugggaaguaguuggcucaacaucagcaggagccccauugacagcagcacagguggaagaauuuggcucagcaucagcaggagcccugcugucagcagcacagguggaaugaguuggcucaaugacugcaggauccucacagucaggagcacacugggaagaaguaguuggcucaucagcagcaggagccccauugacagcagcacagguggaagaauuuggcucaaauucagcaggagcccugcugucagcagcacagauggaaugaguuggcucaaugucaccaggagccucaagcacaugaauucuaugcuuccgaggaaagggacggaaaauaggugguuuauuuccucgcaccuauaaggaaaauuggcaauguuacuuuugauuuaaaguuucacugauuuuauucauuuuaucaccugucugcuaaugucagaaucuugauuuacaguccccaaaauguuucuguauucagaccaccuucaucacuaaggacacuaucugauauucagcaaccucugcuuccuuucugcaugaugaguaaaaggcccagcguaucuagaaaucuuugguggggaccugcuuaguguuaugcuuuuaucuucugcucuuugcuaccucacaucaucauucucuacaaaauggaaagacauaaaaagaaaggacaaaauguguccucuccugucuuuaugaccugaauuuugaauuccagccagaugaaguuaauagggcagugaggugcuuugagaacaaaaggaaccucucucuucugcacuacacuaacccuuccccaaugaaugaucuucuacaguuguccauuagauaccugggauaucagaacaguggggcugaauugugaaaugcaugaauaaaguaugucacuaccuauagcagaggggaauugcugaguuccauuuauggauucuauauaugccuuccaaaaucucaccuguuaacucuaugucaaaguaacuuuuaugcacuagguguaauuguaaucuuugaugcuagcuaccuccaucugagugauaaccuaggccuaguccuggaagcuucucgccucugugaaacuuagcauaggccuagaauauugucagccucucauacuuacugcugaauaagcacaccguuauuucugguucuuuuucaucucuggcugacugguucaacucagguguucuagcucaaagcugcuccccaugcuaacugauucagccuggauucucucuuggccucugauguuuuuuuguucugcuugaccucaaacuaacuagcaauuuuuuccuaaucuucugacuccuucauauucucugguucauucugccuucacccgugucuugcugguucucucuucaaugaaucucucuaaaacuuucuggguaaaaaugccuccucucucuguuucucucugcacuaccucucaaguagcuucccuuuccuuucuucuugagagaguuagacacauccuauuuaaucaaaacuuucucugauucaucaacuucucugccaugcaauuagaccucacuuucagacaaggugcuucauucuacaaacuaacuuuaccuugauuauuuaggauuaaggguguuuacuaaggaggugucuguauucuggcuagagggauuaaaguuuggugcaaaggcugagucacacaauaacuagacaagaguuuauugaguaaacaacacaaucaaacacaagcacagcaugaucaacuauccugcaucaccaugacuguuguuacacagagaggaugaauauaaugacuugauccagcaccucugugguggcuugaaugucagaggcccauagggucauauaaugcuugcucuccagauggcugaccuauucuggaaaggauuagaaguuguggccuuuuuguuggauauguguaacugggaugggcuuuaagauuacacuagacaggugccauucucguaaaguucucucuuuccuguguaggucaauaugugaucauucugcugcugcuucaguaccaugccugcugccugagccaugauggugaugugugcaucccacuggaaccaugaacccaacuucaaacacacccuuucuucuggaaguugucuuucucauggucuuuucuuacagccauagaaaguaacuaacauaaccauuaucuagguacaguaggagugacuucaaaugucugaaggauucauuccaagcugugaaggggcuuugcccaguggauuuggucauaaaacaagugaucaaauuccauaaugcuagcuuagauaggcuacccagagcacucacugcuucaaccagauacacuuaggaaaugugaguguuggaaguggauuugaugcggcauggcaaauaaggucuccauauauuuguugcuccuuacaccuccaugaaauucauaacuuagcagucaacuuuugcccuucaguaccagguuugaggaugggauaugcuacuuacaugaaaaagucacacuccaaaacauucucugcaucaucaaacaauauaacacagagaagguucaacaaaaugaguuaagcagcacuguugaucaaagggaaaggaugaggaagcaugcaaucucugugucuucaaacuguucaaauguuagaauuuaguucacuggauccacugagaaacagacuugaauacagcaaaguauguggaauuuucagacauaggcacguuuucauacaccacguguuaccggacucauuauccccuuccucauuguguaaacaugcuugagacaauuauuaaagaagaauaaaggaccauaugaugcaaaauuaaauuuccaggacaauugccacuuccaugaagauaacacugaagauaaaggagaggacccugaagagauuucccugaauuguuagucacacaacagguguauauuaacagcauuuauuuaccaguauacuuaaauucaugauucaaaauaaucuuuaucucagggguuugugcacaugugguuacauuacucugcuuauguuaugcuuguguguguauuucuccccuccuucucucugucucugugucucucucucucucuuguguguuucuguauguguguuuguguguguguguguguguguguguguguguguguguguguguguguguuuguguguguguauagacuggagagaaauuucaggagcuggauaucuucuuccacagaguuagaaagaggcucugaccauuucugcuucucucuauggucuaaucugucuagcuugucuuucagggcuguucuacucucuuagucuccaaucuggauuuaggggugcagagauuacaggcuuuuuccuuuuuucaggaugaaauucagcuuauuaggguuccaaggcaagucacuaacccacugagccaccugguugcuauauuuuauguauauauacaugcaugaguccauguauguguguauguuuuuauacauauauauguguauaugaauauguguauauauauguauauauauuaugcauuuauauucuaguuuuaaaauaaagggaagagagagagagagagggagagagggagagggagagagagagaacgcuagguuguuacccguuuacaaugcaaaugaaauggagaaaaguaugaauuucucauugacaugagaacauuuccuuugccccaagcuaguuagccucuuugaaacaugccugugucauugucaccccugucuggcuguaccucuucauaaagacuuauauuggguauucucuuagcaugcaauagagaauuguuauuaucuaccucagguccauuuuuuuuuaauuuuauacguauuacacugcaauugccacauaggcuucugggacguuuguguuaguuugauuuuaugcaagcuuaauaucagaaaauagcaucuauuuuauuucaaucacauaauucauuucuuugaagaauggaaacuaccuuuggcuaaguugugccuggcauauaucacugcuuuaaugauauuguggauuguauucuaauaauugguauauaaaagaaguugcuucauuucaugucaacuguaacuaaucugugguuaccauaugcuucaccauuauuauguacauucuguaucaucauaaaaauucuauuuaggggaaauguguuuguauuaggaauguuaguuuugaaaacucuaacggcuuuucacugaacuagaagaugauugccaagaaaauuucuguguucgaaaauuaccugaguucuaccuucuugcuuaguucucucuagaacaaaauuuacucgguucaucacauauuguagcuaauauuaacuugaaaacuaaauugagcuaggcuaaaaagaaggaacaguuaguugaguuugguuucugacaauaugaaguuuacaguuucuaaagguuucacugggucuaauacuuacaucuaaucugccccuuucuuaauggugaauuuagaggcauuacauuaagauaauuaguuagcuguuaacaguaggcaguggaggaagugcugugaguaagaucugcaaacagacccuccuguuugcuuuguaacuucucaguggggauuaaaacagaaaagagggcuauuauucuuuuacuuguuucuguaguugcucugacaaaaugucugaugggaaagucagucaguuacuuccagcaaggcaacagggugucccaguuuguggcacuauucuacugcuucucacaugcugguagaccaggaaacaaauaacacagaacugguaccacauguagucauaaccaugaaaaccuaccacugacaaccuugugcuaccuaggccauaucccgaauguuaaacccucucccuaaguguggcccaguauuaaaacccaggagaagucaucucucucugucugacccucccaugcacuggguaagagguguguaauguuauaaagacacacacacacuuuuuauauacucugugugugucucugugugugugugugugugugugugugugugcgcguguauguguauucaugcuaaagcauuuucagacaguguguaaaucagggucaucgagauggcuaaguagauaaagguacuugucaccaugacaaacaucuugaacuugauaccugagucugaaauuguggaaggagaagacugacuccuauuaguuaucauuugauacccacaauucccuuugccuuccucuacuucccauaucaauuaugaacaggguguccuugaacugacaaagacaauccugccugauuuguggguucaugaauuaaaggugugcccagcauaccgagccuccuauugugcacacccugccuauuaguccuuuggacuucaauagguaaaaugugaaggcugaggccuggguccaggaaguuaacaauuauccuaagacugacuacuuauuuccccuuaugauacuuuuaaucguuuucauaucaaacauauucacuguaggagcuagaaaacaggguugaggaguuuuuaacauguauuguucuugcauagcaccuggguuugauuuguaauacauaaacguuugcucacaaaauucuggaacaccaaguccaugagaagaaauaaccucuucugaugucugugcgacgcacacacacaugggacacagaaagaauacacaugcaaagcauucacacacuuaaagucagucgaucuaagaagagaaacacaaguauugguugcuuccauguugacuguaccuacuuccaggagccuguauuauuuacuuuuugucauuuuaugaauucuucucacuguguuacaaacaugcccauuuuuuugguuucuuucuuguuguuuccauagucuaauuuccuaacacuuacauuuuaacacagugguucucaaccuaucugucaugaccaauuggaggaggugcacagaacaggcucauacaaguugccuaagaaagucugaaaacacugauaggacauuacaacugauaacauuaucaaaccuacaguuauggagcagcaacaaaaacaauuuuaugguugggagucaccacaacaugaggaacucuauuaaagaaagggucacagcauuagggagguagggaagcacuaccuaauacagggccugacaaggagugaggauaugaaggagaggaggggacuguucaagcucaguuucucuucccugacacuacuugcaguacucaaccacaggcacacacauccaacauuuuccuccauaacaagcaaauauguuacuuaucaaauuggggagaauuaacauuagggaugcuuuuucuucauaaguguuaguuauuggcucuccccaagaacacacauaaacuccagaacuccaaaaacccacaaaauccuuuugcauccuccucuguggucuauguaaaguuuugcuagauucuuccagcaaugcaaagguauagaguuaacuuuuuguuugguugugaaauuaacucuuuucuuuuggggugcaugcuuucaaaucaacuuuacuucuuaguaaucaugggguauugacacaugauaauuaaaaacuguaauuacacaugaaauauuuucuaauacgcuuaucuauuuucaaauugcuaggauaucaucaaauguaaaaauauuuaggcuagacuagauuaagagaaaaucaugaaaugagaaacaagauauuguucuuccggguugagacuaagcuuaauucauuaugugccaaauuuucuccaucuuauauaagaugaucauuaauauugcuaaaaccucuuuuggcauucuuucuccuccauugcugggaggaacaaaauucacaguuuaccauuuuaaauaaaugccaguuaaauugccacugcaauccuuaucauaguaccuguggaacuacuuuauagaaacacauuggaucacuuaaucacauucaaaaaucauuaaaaugucacuuaucagucacacauccccucacucuaggguuacagguuauacagaaacaaguuuccuaaacuccaguaucucauagugauuaaguagccucauacugaauauggauguaucuaaauaaaacacuacaauauuuuaaguguuugaauauggcacaaagaauauacauguauauuucaaaaauaagaaaaagaagaacuuauauggacuuauauagcaauugacucucugcuucuagaaaugcuggcuaacuggggaaggaaaguuauuuuuuaacuagaugaagaacuuucaacauacccuuauaagaaucaaauagaaaauacucuaaucucuucauaaggcaaauuugaugaacauaauugcuaaauauccacaauuucuucucagucuaaaaacagaugaaagagagaaaccaaagagagccucucauauaugauccugaaauaggagugcccaaggguagauaaaacuuaugggcauucugcuggggguaaaggcacuuuggagauugcuggaucauugaaauaucuggacuuacuaaaugguauucuggucuauuaucacggucacauuuuuaaaucagucuaauguguauucauuucugcaaacauuacuuugucaaacaucaaacaccuucuauuaugugagaccugcacucagucuucacucccuaugucucuugaguccauucucauauugggccacuacuaccuauaaggacuuacugcucacuugcaauugauagaaaguuccacaucuacaauaugguuuucucugaaucaccuuuuccauauaaaccugggauaguuagacuacugcugaauuaagacaauucauaagaaacuugauuucacagagaagcauuuuaccuugauacaggaaguauaccugacaucuucuccuuuugaacaccuagaaacaacaaugggagguuugucagggagccauuagaaugcaaauaugcaaccuucuuucaacauuagauguguggcuggaucucuuguucauggagaaaaaccccaggcuaacuauccaguaaacuuuagggauucucugacaccaccuccagucucaccauaagggccccagcauacagcagcacaugagacugucagaucucauguggauucugggcauccaaacucucauucucacacaugcauagcaagcacuuuauccauuggaucuuccaccuaacuauggauccuuuucagcuuucaugcugcaugagagauaucaucaguaauuucaacaugguuugcucuauaaauaauuauucagcuugugauuauagaaaaauaaagagcugaaauugucuuacacagaggcaaagacagugucaggcucugaauguuauauuuucuacagauuaauguauuauaaaaugcacacuacauucuuaccacagugauguucuucuuguaauuuucucauuaacuacaaaagagggaggcaaaauuugucauuaaacaaugguagccagugccgaagcaaauauuuuugugaccugauaugcuuugacaccauuuaugaaaagcuuuuaagaugaauauugauuuguaagcaauaaauauacuagaacucuuccuguccucauucuuguauuuuuaaaauaaaaaaagaaaauuuuaucuaaaguuacuauuuauaauuaauugugcaaaauaccuacaauccugagcccuaucagacacaaaaagugucaucuuagccugaaguguuauuccacagugaauauuguugccauugcugcuuucugucucugcccuagggaugcuggcacaacucuaagugagcgaacucaucuuggacagaagugaagggacuucuccaaguauugacuugaacuuccuucacugaggggaaauauccauuccuacaacagggaagcucagucuauggcuaugcaacauagccaaauacaggagacccaaagcccuuugcaaaggauuuccagcugcaaguaugacaaagcucuagagagaucaguguguuacucuacucuagaucuucugaggaagaugcuaaaggcccucaguucuagcacuggucccuagcucaugugcaaugcaaagaagcucagcaucaacuuccauugcuucccauggcaugagcugcuggaaagacccccuuaguagcuaugcaaacugaaguauuacuccagagagaagcauggaagacacaaugaagcaguaauuccaagggacuaaugccucacacgaaacuuuuuuuuuuaaauuuauuucugcauauaaaccauugagugacucagguuucacuguauggaaaaagccugcucagcaaaccagcuaacaaauaaacaauucuuguuuacuuccuuugcaauauguaaaacuccacuguacccugcuggacauugcccauggccagagcacagccuuugucccaaacaagaaaugggcugagaaaguggaccucuggaggaccuuaugcuacucauguauggggccucugucaauccuuaucaccagaagaaagcucuaaugcugaaauaacuuaaaagaagcucacccacauuacacuaauaguauuucaucccaugcuuaugugaagacagccauuuagauuccucuacacuauucucuggcugguguuuuccaaagucaaaguaggugcgagagauacuguggugacaguugcugaaagcauaaacugugugguauuucucccacugugagaaucauauucagacugaaccaaugggcccuuccaugccaugcacuacaggaugauaggauuuucucaaccuuccuucuacuguggcaguuuuuucugcacauuaugucuuguagcauguaaaccaaguaucaguauaaauuugguaacuaauagaacuacagggaaaaggugcugucagaguagcccauauggaggcuguugcauagaauacugagaauggcaguuuucauuccacagcacuaccuacaaaacucacacaccagucaguuuuuuuaaaguuccuaauugagccaguuauuuauuguaucaggauauucacauuaaauggaagacaaauaaaaauaaccagaagacaauguaugaauuaucaaaugaguggaaauucagaaauucuaugauggaaaaaaaauccagagugcccuaaagacauuaaguccucaaaauacagugaaaguaauuaaauacucuauuuuuguuugcuuaacaugaccacauuuuauggacaccgauacacauacaacaacaugcagucaguaauauauaucaauuauaaaacugaaguaaaaauucauuucauaccaaagucaacuugcuguuauguaacuagagaggaucuacauuguagaauaggugaaaaaucuuuuuacuucuaaaaagacacuacaugcaucaguaguucauuuuaaauaaacaaacauauuucaggugauacaacuugaauuugaaguuucuuucaaacaauuccuaaauaaaucugaauccuaaaaauguuuggcagcaaauuaagaaaggcuauuguggggagcgggugugggggcagucccaaaggcgccagggacugcagcuaagucauaugacuugcaccugacuuccucauauaagacacaaacaucuugagugcugcgcagguguaccaggauacaggugaauccaauuugguggagauuugccccugcugcccugauuagcugaagccucgugacuggcaagggggcguggccugcggugcguggaugagagagaguaaaaaaggagugagagacccaggguucaggggagauauaaacaagaagaaucaggacugaauaaacugcuguuagaaggacugguggucgcgucauucuugcuggucgagagcgggcgcgacaggcuauaacuacuauuggcauauuugauuuccuuaguuucuauucuagcaggaacaaaauucuuuuugugauugggauagaaucaauagaguacuuacucuuaaacuuaccuggauuauacuggacaguguuuuucaagauagauuuaagcuauccugguggucuuguuucacuguggcauauuuuaagaguguuauuuuaauauucauauaaaaauuaaucaaagacuuugaauucuuuguuguuugauuucccaauuuaugcuacauuacaaaccaauaaaaucuauuaacuuguucuucaaccaguugauuacauuuggggacacuuuccuuacaacuucuccucauaugggagaaguuagcccacaaaauauagcccuacaaaaccacucacagauacagacaagcacgcgugcacacaugcauacacacuaguaccucuucagccuuuguuuuaacagcuuacagaauuuuuauuuuuaauguauugacucaauuucagucuuugcuccuggaagggcaaaguacuucucucaugauacuuugugcauauuucauugauuaugauguuaccacacaagaggaugcuuugugcaccaucaaguagauuucuagaacucuaaacaacccaccacagcuuucauaauguucaagcugcuccuucuguucucauguaugacugaguccugauaucguagucugcuuguuucuauuccaaacaagcauuucuaggaacauaauaagauaguaacaagagcaaagaacaauaaacuuuaguugacacuugcaguuuuacuguggaaccguuuaggauuccaaauagaagucaacauguguauuuuucaaggaguuucugaagaguuuuaaguacugaagauuuuugaaucuucacuuucaacauuaccuuugaugauuuugggaauuuucaaacauggauucaguaagcuauuuaauaauguuuugaaaauguuuguugauacauagcacaaauaaagaggacaauauaauuguccucucuuguggaaguaaugaauccuaaugagcacagaauuaccuugaaauacaacuuuucauuuucuaucaaaccagugucuaaccuaucauccuggacaggaguggaugggccuucaacucuauggucaugucuaacugauguggaagacaaaacccccuuuguagagagauaauuauuaguuacacugucauucagauaaucaauugagagucaaaggaaucauuccgguggaaaacagaucaugggaacagaucauugauggauggaacuuucuggaagacaugggugucuucuaacagcuaugaaagaugcuacaccugaacaaaaagguccuuugcauguaaaguaaagcucugucagaagaggaaagaaauuuguuggcauccuguagugaugacugacaacugagaaucauccuaaauuauguaaacucucagacaagagaaaugccugaaaugauagcuacuagugugggucuuaguucacaaacugaauccaguaaggcuuugaaaagccaaugaaucuuagauggacauccauaugcauagcuaaucccagcaggcucuuuuuccaaacuucagaguugguucuuggaaauggugggugacuaucguguucauguucuuaugaacuacacugagcgaguuuccaagcuaaaacauauauucauaauauugugggacuuguaagacacaggucucaaaguacucacaacaagaauuugcuucuuauuuuugaauuuaccuacuacuaaugaauuguuaaaccuuaccaggacaaaggccuuuuuucuuuaaaauauaagacuucugaaaggaaaaacaaaauauauuuuauuacaacuauagaaaaacauuacauauaaaaacgaucagacucauuguuaguaucaauuucuaugagaccaaucuagagacuauucaagaguaaauauccacuuuuagcaaauuacuuugcauagaaauauucauucccuguauauuucaaauuaaagaugacaauaauuuaucaaacauuaaugccuaacaauauacacacauacacauuuguaaugauccuaaaugaacucucacagucugauagcgaggacaauccugaccagaauaaacaacuguuucaaaaauaacuucuugagauucuuuuuaacucuaggcuaaugguucugaaaagaauuauagauugagucugguggcacacaauuugaaucucaacacuuaggaggcaaaagcagauggagaaacugugacucccuggacaaacagagcuauauuuagugagaccaugucucaaccccuccccuaaaaagaguaaaguccagagcugagcuucaagauguucuccccugagugccagucuuuggcuacaauuaaacccacauuaagcaggccugcuguaccaggaacauccaaugcucugcccaguuuccuggagacauacacugucaccugauuuccaauguccaggcaaaggcagcccaccucaaacgccugugacagaaacuccccgggauaaccaguuggcuaaaggccaacauaagaacacaaucacagagaacuaaaucaauaugacauauccacagcccagguauucuacuauagcaagcucuggauauccuaacacaaucaaagcacaguaaaaugucuuuaaauccaaucuuaugaagaugauagaggccuuuaaauagggaaauuaauaaaucccuuaaauauacaggaaaauagaaucaaacaggugaagaaaaugaauaaaacaauucaauaucugcaaaugguaaaagaagcaguaaagaaaauacaaacucagggaaccuuggagauggaaaaccuaagaaggacaacagagacagaagcacagccaacagagcaaaaauaauggaagagaugaucucaggcauagaugauauaacaaaagaaaauguuaaaccuaaaacaauuucugacucaaaguauucagguaaucugugacacucuaaaaaaaaaucuuuuuaugaauaaugggaauaaacaacaagccaagagaguaccagcucaaaggacaaggaaauauuuucaacaaaaucauagaagaaaauucacccaaacuaaagaaauaaugccuaccaacguagaaaaagcuuacaaaacaccaacuucauugguguucucaacacauaaucaucuucccuccacauacaucaaaauaacaggaauuaacaaucauugguuauugauagcucucaacaccaguaaacucauuuuccacaauaaaaagauauaagcugacagacuggauaugaagucagcaucuaucauucugcuucaugcaagaaacauaccuuggccaacauacagagacaucaccuaagaaugaaggacuguaaaaaguuuucccaagaaaagguacucaggaugaaagcuaaggagcaauuguaauaucuaaauaaaagagacuuucaaccaaaaugaaucaaaagagauagggaaggauauuucacauucaucaaagaaaaacacaccaagaagacuucucaauucugaauccccacauuugcaacuuaaauccuacuuuuaaaggugcuaauggggguuggggggcacaaagcuagcagugcacaagcaguagaacagaugagacaguguacuuucugccuccaucugcacccaggagcuggggcuguuccacagcccucugugcaugggcccugccagggugagcuggucucccagaagugcugacacagacuuacaggcccccaggagggacaaggucaacccagagacagcaagaccaacuaacaccucagauaaccagaaguaaaaaggcaagcccaagaaccuaaccaacagaaacaaggcuacauggcaucaucaggauccaguucucacacaagagcaaguccuggauaccccaacauaccggaaaagcaagauuuggauugaaaaucacaucucaugaugcuguuagaggacuuucaggaggaaauaaauaagucccuuaaagaaauacaagagaacaucggaaaacagguaaaagaacuuaaagagaaaacacaaaauucccuuaaaucauuacauggaaacaaacaaacaaacaggcaaaggaauugaacaaaaccacccaggauccaaaaauagaaguagaaacaaaagaagauaccacaaagggagacagcucuggagauagaaaaccuaggaaagaggucaggaguuauagaugcaagcaucaccaacaaagagauagaagagagaaucucaggugcagaagauagaagagagaauacaagagauagaagagagaaucucaggugcagaagauaccauagaaaacauuaacacaacagucaaagacaaugcaaaaugcaaaaaacaacaacaacaacaacaaaacuccuaagccaaaacauccaggaaauccaggaaaaaaugaggagaccacaccuaaggauaauagguauagaagacagugaagacccccaauuuaaagggccaguaaauaacuucaacaaaacuacagaagaaaacuuacguaaucaaaagaaagaggugaccauggacauacaagaagccuacagaacuccaacuagauuggaccagaaaaaaaauuccuccugucauauaauaaucaaaacaccaaaugcauaaaacaaagaaagaauauuaaaagcaguaagggaaaauggucaaguaauauauaaaugcauaacuaucagaauuacaccagacuucucgccaaagaauaugaaagccacaagauccugggcuuaugucauauagacccuagagaacauaaaugccagcccaggguacaauacccaauaaaaaucucaauucccauagauugagaaaccaagguauuccaugacaaaaccacauuuacagaauaugauuccauaaauccaguccuccaaaggaugauaaaucccagaagauggagagaucuaccaugcucauuggcaggauuaauauagucaaaauggcuauccugccuaaagcaauccacagauucaaugcaauccccaucaaaauuccaacugaaaucuucacugaguuagaaaaagcaauuugcaaauucaccuagaauaacaaaaaaccuaggauagcaaaaagucuucucagugauaaaagaaucucugguggaaucaccaugccugaccuaaagcuguacuacagaacaauugugauaaaaacugccugguacugggauagcgacagacagguagaccaauggaauagaacugaagacccagaaaugaacacaaacaccuauggccacuugaucuuugacauuggagccaaaaccauccaguggaaaaaaauacagcauuuucaacaaauggugcuggcacaacuggcuguuaucauguagaaaaaugcgaauugauccauucuaaucuccuuaucuccucaagucuaaguggaucaaggaacuccacauaaaaccagagacacugaaacucauagaggagaaaguggggaaaaguauugaagauaugggcacagggggaaaaaauuccucaauaggacagcaauggcuugugcuguaaguuugagaauugacaaaugggaccucauaaaauugccaagcuucuguaaggcaaaagacacugucaauaggacaaaacagcaaucaacagauugggaaaagaucuuuacuaauucuacagcugauagagggcuaguauccaauguauacuaagaacucaagauguuagacuccugauaaccguucagaauggcuaagaucagaagcucaggggagagcaguuguuggugaggaugugaagaaagaggaacauucuaccauugcuggugggauuguaaggugguacacccacucuggaaaucaguuuggugauuccucagaaaauuggacauaguacuaaucagaggacucagcaauaucacuccuguguauauacccagaagaugcuccaacacauaauagggacacauucuccauuaugcucauagcagccuuauuuacaguagucagaagauggaaagaacccagauguccuucaaaagagaaauugauacacaaagugugguacauuuacacaauggacuacuacucagccauuaaaaaggaugaauucaugaaguucuuaggcaaaugaauggaacuaguaaauauuauccugagugagguaacccaaucacaaaagaacacacaugguauguacucacugauaaauggauauuagcccagaaguucagaauacccaagauacaauucacagaauacaugaagcucaaguagaaugaagaccacagugugacuacuucaguucuucuuagaagggggaucaaaauacccaugggaggagauacagagacaauguuuggagcagaaacugaaggaaacgccauccaguuacugucccaccagagaauccaguccauauacaauuaccaaacccagacacuauuguggaugccaacaagugcuugcugacaggagccugauagagcugccuccuuggaggcucugcaguguuugacaaauacagagguaaaugcacacagccaaccauuggacugagcacagggucuccaauggaggagcuaagaaaggacacaaggagcugaaggaguuggcagcuccauaggaggaacaacaauaugaaccaaccaguaacuccagagcucucagggacuaaaccaccaaccaaagaguacacauggugggacucauggcuccagccacauauguaacagagaauggacuugugggacaucaaggagaggagaggcccuugugcuugugaugggccccaguguaggggaaugccaggacagggaagcaguagucgguggguuaguuggaagggggaggagggauggcauuggggugguggugguggaggggaaaugaggaaaggggacaaaguuugaaaugcagauaaagaaaauaaauaaguaaauucaaaaaauaauuugaaugacugaaaacaauuagauuaauuaaaaaaaaaaaagaauuguaguccggagacacagcucaacaguuaagcacacccagugcucuuugagaggacugcuguucaguucucaguacugucucuaaaacuccaacucuaggagaaugccuuccucuggcuucaagggucacaugugcacauagaauuuuaaaaauaaaaauuauucuuuaaaaauggcaaaagagaaugugguauguguauacaaugaaauucuauucaacuauuaauaguaaagacauaaugaauuuugcaggcaaaaggauaguacuugagacuaucauccugaaugaaguaacccagaaccaaaacaucgaugguuuguauucacuuauaaauggauauuaguaauaaauuacaggauaaccuuaccauacugcacagaccaacaggagauaaacaagggguaaggaccaaacaaaguuguuugaaccugacuuagaacagagaauaaaauagucauaggagcaaaauggaaggagagaacuaggugggaguggggauggucagggaaaugggguguuucaguaucagauguagggagacacaggggagaugaccugauguccaugagaaugaauggauauacacagguggcaggcguugggguuugggacaauauucacauguuugucacaugcuuaugugaagacagccauuuagauuccucuacacuauucucuggcugguguuuuccaaagucaaaguaggugcgagagaugcuguggugacaguugcugaaagcauaaacugugugguauuucucccacugugagaaucauauucagacugaaccaaugggcccuuccaugccaugacuacaggaugauaggauuuucucaaccuuccuucuacuguggcaguuuuuucugcaaauuaugucuuguagcauguaaaccaaguaucacuauaaauuugguaacuaauagaacuacagggaaaaggugcugucagaguagcccauauggaggcuguugcaaagaauacugagaauggcaguuuucauuccacagcacuaccuacaaaacucacacaccagucaguuuuuuaaaaguuccuaauugagccaguuauuuauuguaucaggauauucacauuaaauggaagacaaauaaaaauaaccagaagacaauguaugaauuaucaaaugaguggaaauucagaaauucuaugauggaaaaaaaaaauccagagugcccuaaugacauuaaguccucaaaauacagugaaaguaauugaauacucuauuuuuguuugcuuaacaugaccacauuuuauggacaccgauacacauacaacaacaugcagucaguaauauauaucaauuauaaaacuuaaguaaaaauccauuucauaccaaagucaacuugcuguuauguaacuagagaggaucuacauuguagaauaggugaaaaaucuuuuuacuucuaaaaagucacuacaugcaucaguaguucauuuuaaauaaacaaacauauuucaggugauaaaauuugaauuugaaauuucuuugaaacaauuacuaaauaaaucugaauccuaaaaauguuuggcagcaaauuaagaaaggcuauaacuacuauuggcauauuugauuuccuuaguuucuauucuagcaggaacaaaauucuuuuugugauugggauagaaucaauagaguacuuacucuuaaacuuaccuguauuauacuggacaguguuuuucaagauagauuuaagcuguccugguggucuugcuucacuguggcauauuuuaagaguguuauuuuaauauucauauaaaaauuaaucaaagacuuugaauucuuuguuguuugauuucccaauuuaugcuacauuacaaaccaauaaaaucuauuaacuuguucuucaaccaguugauuacauuuggggacacuuuccuuacaacuucuccucauaugggagaaguuagcccacaaaauauagcccuacaaaaccacucacagauacagacaagcacgcgugcacacaugcauacacacuaguaccucuucagccuuuguuuuaacagcuuacagauuuuuuguuuuuaauguauugacucaauuucagucuuugcuccuggaagggcaaaguacuucucucaugauacuuugugcauauuucauugauuaugauguuaccacacaagaggaugcuuugugcaccaucaaguagauuucuagaacucuaaacaacccaccacagcuuucauaauguucaagcugcuccuucuguucucauguaugacugaguccugauaucguagucugcuuguuucuauuccaaacaagcauuucuaggaacauaauaagauaguaacaagagcaaagaacaauaaacuuuaguugacacuugcaguuuuacuguggaaccguuuaggauuccaaauagaagucaacauguguauuuuucaaggaguuucugaagaguuuuaaguacugaagauuuuugaaucuucacuuucaacauuaccuuugaugauuuugggaauuuucaaacauggauucaguaagcuauuuaauaauguuuugaaaauguuuguugauacauagcacaaauaaagaggacaauauaauuguucucucuuguggaaguaaugaauccuaaugagcacagaauuaccuuaaaauacaucuuuuaauuuucuaucaaaccagugucuaaccuagcauccuggacaggaguggaugggccuucaacucuauggucaugucuaacugauguggaagacaaaagcccucuuuguagagagauaauuauuauuacacugucauucagauaaucaauugagagucaaaggaaucauuccgguggaaaacagaucaugugaacagaucauugauggauggaacuuucuggaagacaugggugucuucuaacagcuaugaaagaugcuacaccugaacaaaaagguccuuugcauguaaaguaaagcucugucagaagaggaaagaaauuuguuggcauccuguagugaugacugacaacugagaaucauccuaaauuauguaaacucucagacaagagaaaugccugaaaugauagcuacuagugugggucuuaguucacaaacugaauccaguaaggcuuugaaaagccaaugaaucuuagauggacauccauaugcauagcuaaucccagcaggcucuuuuuccaaacuucagaguugguucuuggaaauggugggugacuaucguguucauguucuuaugaacuacacugagcgaguuuccaagcuaaaacauauauucauaauauugugggacuuguaagacacaggucucaaaguacucacaacaagaauuugcuucuuauuuuugaauuuaccuacuacuaaugaauuguuaaaccuuaccaggacaaaggccuuuccucuuuaaaguauaagacuucugaaaagaaaaacaaaauauauuuuauuacaacuauagaaaaacauuacauauaaaaacgaucagacccauuguuaguaucaauuucuaugagaucaaucuagagacuauucaagaguaaauauccacuuuuagcaaauuacuuugcauagaaauauucauucccuguauauuucaaauugaagacgacaauaauuuaucaaacauuaaugccuaacaauauacacacauacacauuuguaaugauccuaaaugaacucucacagucugauagugaggacaauccugaccagaauaaacaacuguuucaaaaauaacuucuugugauucuuuuuaacucuaggcuaaugguucugaaaagaauuauagauugaguaugguggcacacaauuugaaucucaacacuuaggaggcaaaagcagauggagaagcugugacucccuggacaaacagagcuauauuuagugagaccgugucucaaccccuccccuaaaaagaguaaaguccagagcugugcugugcuucaagauguucuccccugagugccagucuuuggcuacaauuaaacccacauuaagcaggccugcugcaccaggaacauccaaugcucugcgcaguuuccuggagauauacacugucaccugauuuccaauguccaggcaaaggcagcccaccucaggacgccugugacagaaacuccccgggauaaccaguuggcuaaaggccaauauaagaacacaaucaaagagaacuaaaucaauaugacauauccacagcacagguauucuacuauagcaagcucuggauauccuaacacaaucaaagcaaaguaaaaugucuuuaaauccaaucuuaugaagacgauagaggccuuuaaauggggaaauuaauaaaucccuuaaauauacaggaaaacagaaucaaacagguaaagaaaaugaauaaaacuauucaauaucugcaaaugguaaaagaagcaguaaagaaaauacaaacucagggaaccuuggagauggaaaaccuaagaaggacaacagagacagaagcacagccaacagagcaaaaauaauggaagagaugaucucaggcauagaugauauaacaaaagaaaauguuaaaccuaaaacaauuucugacucaaaguauucagguaaucugugacaccuuaaaaaaaaucuuuuuaugaauaaugggaauaaacaagucaagagaguaccagcucgaaggacaaggaaauauuuucaacaaaaucauagaagaaaauucacccaaacuaaagaaagaaugccuaccaacguagaaaaagcuuacaaaacaccaacuucauugguguucucaacacauaaucaucuucccuccacauacaucaaaauaacaggaauuaacaaucauugguuauugauagcucucaacaccaguaaacucauuuuccacaauaaaaagauauaagcugacagacuggauaugaagucagcaucuaucauucugcuucaugcaagaaacauaccuuggccaacauacagagacaucaccuaagaaugaaggacuguaaaaaguuuucccaagaaaagguacucaggaugaaagcuaaggagcaauuguaacaucuaaauaaaagagacuuucaaccaaaaugaaucaaaagagauagggaaggauauuucacacucaucaaagaaaaacacaccaagaugacuucucaauucugaaugccccacauuuacaacuuaaauccuacuuuuaaaggugcuaauggggguuggggggcacaaagcuagcagugcacaagcaguagaacagaugagacuguucuuucugccuccaucugcacccagaagcuggggcuguuccacagccgucugugcaugggcccugccagggugagcuggucucccagaagugcugacacagacuuacaggcccacaggagggacaagcucaacccagagacagcaagaccaacuaacaccccagauaaccagauggcaaaagacaagcccaagaaccuaaccaacagaaacaaggcuacauggcaucaucaggauccaguucucacacaagagcaaguccuggauaccccaacauaccggaaaagcaagauuuggauugaaaaucacaucucaugaugcuguuagaggacuuucaggaagaaauaaauaagucccuuaaagaaauacaagagaacaucggaaaacagguaaaagaacuuaaagagaaaacacaaaauucccuuaaaucacuacauggaaacaaacaaacaggcaaaggaauugaacaaaaccacccaggauccaaaaauagaaguagaaacaaaaaaagauaccacaaagggagacagcucuggagauagaaaaccaaggaaagaggucaggaguuauagaugcaagcaucaccaacaaaauacaagagauagaagagagaaucucaggugcagaagauaccauagaaaacauuaacaaaacagucaaagacaaugcaaaaugcaaaacaaaacaaaacaacaacaacaacaacaaaaaaacuccuaagccaaaacauccaggaaauccaggaaaauaugagaagaccacaccuaaggauaauagguauagaagagagugaagacccccaauuuaaagggccaguaaauaucuucaacaaaauuauagaagaaaacuuacguaaucaaaagaaggagaugaccauggacauacaagaagccuacagaauuccaacuagauuggaccagaaaaaaaauuccuccugucauauaauaaucaaaacaccaaaugcauaaaacaaagaaagaauauuaaaagcaguaagggaaaauguucaaguaauauauaaaugcauaacuaucagaauuacaccagacuucucgccaaagaauaugaaagccacaagauccugggcuuaugucauauagacccucagagaacacaaaugccagcccaggguacaauacacaauaaaaaucucaauucccauagauugagaaaccaagguauuccaugacaaaaccacauuuacagaagaauaugauuccauaaauccaauccuccaaaggaugauaaaucccagaagauggagagaucuaccaugcucauuggcaggauuaauauagucaaaauggcuauccugccuaaagcaaucuacagauucaaugcaauccccaucaaaauuccaacugaaaucuucacugaguuagaaagggcaauuugcaaauucaccuagaauaacaaaaaaccuaggauagcaaaaagucuucucagugauaaaagaaucucugguggaaucaccaugccugaccuaaagcuguacuacagaacaauugugauaaaaacugccugguacugggauagcgacagacagguagaccaauggaauagaccugaagacccagaaaugaacccaaacaccuauggccacuugaucuuugacauuggaacuaaaaccauccaguggaaaaaagucagcauuuucaacaaauggugcuggcacaacuggcuguuaucauguagaaaaaugcgaauugauccauucuaaucuccuuaucuccucaagucuaaguggaucaaggaacuccacauaaaaccagagacacugaaacuuauagaggagaaaguggggaaaagcaucgaagauaugggcacagggggaaaaaauuccucaauaggacagcaauggcuugugcuguaaguuugagaauugacaaaugggaccucauaaaauugccaagcuucuguaaggcaaaagacacugucaauaggacaaaacagcaaucaacagauugggaaaagaucuuuacuaauucuauagcugauagagggcuaguauccaauguauacuaagaacacaagauguuagacuccugagaaccuuucagaauggcuaagaucagaaacucaggggagagcaguuguuggugaggaugugaagaaagaggaacauuccaccauugguggugggauuguaagcugguacacccacucuggaaaucaguuuggugauuccucagaaaauuggacauaguacuaaucagaggacucagcaauaucacuccuguguauauacccagaagaugcuccaacacauaauagguacauauucuccauuaugcucauagcagccuuauuuacaguagucagaagcuggaaugaacccagauguccuucaaaagagaaauggauacacaaagugugguacauuuacacaauggacuacuacucagccauuaaaaauaaugaauucaugaaguucuuaggcaaaugaauggaacuaguucuuacacgcguucgcgaccggccaggaagaacgcaacaaaccggaaucuucugcggcaaagcuuuauugcuuacaucuucaggagccagagagcaagagagagaauggcaaaaccccgucccuuuuaaaggagaauuauccuccgccuaggacgugucacucccugauuggcugcagcccaucggccgaguugucgucacggggaaggcagagcacauggagugaagaacuacccuuggcacaugcagagauuauuuguuuaccacuuagaacacaggaugucagcgccaucuugcaacggcgaaugugagggcggcuucccacagaucccccuuuucuuuuaauaagagcaauaggccacccauauuaaugagaguggagauagaggucaaauccccagugugcagguaaaggagccguacacauaaccuccucuuaggcucaucacccacagggguccuggucuggucccgugucguuuuuccuggggagaaggacacuugaacacucaaccuucuugaaagaugacaugucucccuagaauaggcucauauaugccgcagagcccuucuacugcagugcuuagccgugcaacucucucgggcugcugaagcacacucacucuaucccgugcaaugagacuagccucauggggugcaagagcugaauggccagcgaccuauugcuuaagcauagauaaccauauaucaggggaagcaccauguucuagagcugcaagugccugggcaauaaccaccuugucucuccuaguuugggccuuaagcuuacagaccaaccagagaagcaacacuaauccacagcaaaguguaucuccaaauaauaucaaucccacccauucuuuaaagaaggaaaaugcugaggagauccaauuggguaauccuuuggucagggacagguccaagcgcguggaguugaccugaauaauggcaauucucaauucccgaagggucuguucaaauucagccauccuauucuguaacauauacugagaaagacuuuuugacaaauuagcugcccuaguaaauuuuucauacugaauggaaguaaugcacaaucccggaaacuuuuguucacaucccagcugagcuauuugccauaauacaucuaguuguuccuggacaagaucuaugcguugauuaaccagcaugagaccucccuguaucuugacauuagcugaggccuguuuaucuaugacuguggucaccgaggcugacaauguguuaauggugucagucgucuggaccuguccagacagagccaagacugucugaaucaaggccaaacccaguuccuuguuacugguaaaaaagcaggggaauacuugagcauuauacaucaccggcauugggaguggaaaugucgacauuaucucccaacgcugcucucucuuuguuauugucacccuggacaucaccaagacgagggacaucaguauucccuuggucagucuggauuuuucgggugagucuuucugguauccaaaauggguugucuucauucuguggaaaaacacaaacagcuccccuggaucuuaucaaaauaggauccgggccauaccauuuauuaucaaggacauuuuuccauuuaaccaucucauugggccuaucuggcucugaacaaugacguucagccgcaguauggccaugagcaucaagauuuaaaaaauugaguguaaagagugccauagacacagacacucuugguacucgggguagagccucgacuccccuuuucuguuuuaauagaugggauuugagggugcgaugcgcacgcucaacaauacccuguccuugaggguuguauggaaguccagucaggugggucacguccaucugacggcagaacugcuggaauuuuugagauguauaagcugguccauuaucagucuuaaggaguuuggguuucccccaagcacuccaugccucaaggcaauguugaaucacaugugaggccuuuucuccgguuaacggagaagcaaacaugaugccagaacaugugucaauggacacauggagauauugaaguuuuccaaaggaagaaacauguguaacauccauuugccagaccuguagaggucgaauaccgcguggguuaauucccacaugaggaacuggcaagaacucacagcagcuuugacauugaguaacaaugucacgggcuucuuuucuugucaaggagaaaugacugcguaauguuucagccgucacaugaaaauuguuaugaaaauuucuugcagccucuaccggggaugauagggcagcagccaccacuuuaguggccuuaucugccaaaucauuucccagagccauggggccagguaggccugaaugggcucuaacaugaguaauauuaacaggaaaucuucuagauaacaaaacuaauuguaucugcugaaaaauauuggcaacuuuacuggaaggcuuaaucacuccagccacuucuaaaagauuuacugcauuaaccacauaacaggaaucugacacaauauuaaggggguuccaaaaagguuuuuaaaacuucuaaaaccacuaaacauucuaccacuugaggugaauuuucauuauauuguuuggauaccacuuuaccauuagccacauaggcaccuaugccaguuuuugaucuaucaguauauaccacaaucccguuuuuaaguggguuucuuaccguuauuuguggaaacacaacagauugauuuugggcaaacuguaaaauuggauguuuuggauaaugguuaucuauuuguccugaaaaggagguaacuaaaacugcccaaucauuagauguggcugccaagguuugaaccugugcagcgguauaagguacaauuaagauauggacuuuguccaaagugggugauugcugcuuuuaggccuuuaagggcaagcugugcaauugcaucaggauaccaaucuauuauuuuagcuggggauauguuuggauggauccacaacaauggcccauucugccacaaaacugcgguuggcaauugugcugucuuaaagacacacaaacugaaaggcugcgaauccucaauacguuguaauugugcauucuguaaggcauuuuccacuuuuuguaaggccugguuagcagcuagaguaagagcccuaggggaggagauaugaggaucuccuucuaaaauaccaaacaaaggccuuaacucagcggaaggaaucuucaaaaaaggucugagccaauuaauaucucccaacagcuuuugaaaaucauuuaagguauggaggugaucucuucuuaucucuaccuuuuggggcacaaucuuaucuggggacaccacagagcccaagaauugucuuguaucagaaauuuggacuuuuucuguggcuaucuguaaaccccacugacuuaaaguuuuaaguagaaaaggauaugccuuuuguagcuagguaagcuuuuuauggcacaggaggaugucauccauguaaaggagcaaaauuaaagaggggaauuguucccucacuggcaaaagagcuucuugcacauaaaguuggcacauuguaggacuauuggacauucccugugguaagaccuuccauugauaccucuuaucagguuccaugugauuaauagaggggaugguaaaggcaaaucugggccuaucccuuggacacaaagguauagaaaagaaacaaucuuuaauaucuauaauaauuaaauuccagccacgugguaaggcggaaaguacagggagaccccucuguaccgggccaaauaaguucauuugcucauuaauggcucugaggucauggagcagucuccacuuuccugacuuuuucuuaauuacaaaauuggaguauuccaaggugagguagaugguucaauauggccuaguuuuaauuguuccucuaccaguugaaucacagcuuccaguuuuucagaggauaggggccauugaggaacccacacuggauccccuguuuuccaugguaugggucaugcugccccaauggccccuagggaaaacccagacccugucugucuugguuuccauuaggugagaugggcucuauccuucccuguucuugauguccuaacccuuuuccuucuuuauaacccaucuuugccaugauauuuuuugcuuuagcugaauacccucucgauggggcauuuucauuggacaaaauaaggcccaaaugcugcauaauaucccuuccccagagguuaaccgggagugggagcacauaagguaugaauuucccuugcugcccuucagaggauucccacgucaaggcaacggagcuuauagugggacaugauugauauccuaggcccuguaaugaaugagaugacucugugguaggccaugcuuugggccaccaauguguagagauuauacuuuuaucugcuccgguaucaaggaugccuucaaacucuuuuccguugaucuuaaggaggagcuuaggucuaucauucaaagauacaaccaaauaggcagaaucauuucccgaggagcccauuuucuuuaucucagguccugcagauuucucccuggcauuaucagggaggagcagcagcugagcuauccuaucuccuuuacuaauagaaaaaacacccuuagggcuugagcacaggaccuguauuucaggggaauguugacaauccauaacuccaggguggacuacuaagcccugcaaggugagugaaccccagccgagaauaaggcccaugguuccugggggcaaggaugguauaggcuccaccggcaccggcugaauacucauuugaggcauuaguaggaagucggaggcggcacgcagguccacccuugugggucuuccugggucgccucucugacugcuuccuggguccugacaaaccgguucccauaucuuugagggcccugggaccgagggccccauggcccguuuuuugacacaucagcugauugguuaucaggugggggaaggagucugcccuuuauauuccucacagagcgacacuggucggcucuaugauaacccuugccacacuuagagcaaagagugagagucccccccuguuuaucuggagcucugcaaucuuucuuaagaugcccaggcuucccgcaguuaaaacauguccucugaucauuucugcccauggagcguuuuugggauuggaggauggcggccgcuaagccugcauuggugagaggucccccaagcucccgacaaacccugagccagucuuguaaaccuuuguucuuucuuggggcuauggccgcucggcacuccuguguggcuugcucauaaaugagcuguucuaccagaggugcggcuugcucugaaucuccaaaaauacgcucugcugccucugucauucuggccacaaaaucugagaaugacuccugaggucucuggacgaucuuuguuaguuguccaguggccucaccugcucgggagagcgccuuccaggcccuaauagccguggaggaaauuugggcauaagcuccccagugguaguuuguuugaucagcaguauaagcucccugacccguuaacaagucaaaaguccaaucucucugcucuggagucaaagcagcagcguuugcucgggccugcgcuugugcagccucuugccauagagcucuccauuccauauauuugcccauacuagggagagcggcuuuugcaaucauuugccagucggcaggaguuagugccaugccagcaagccugucuaacugcaccaagguaaaauuagcauugguuccauauuuacggaccgacucggcaagcucuuuaaucugcacauauucuaccggagcguggacacgcccacucucggcuccuucaaagaccggaaaugccuguuguauuuuccuuuguuccuccuuuggaaugaacgagucugcgcauugccucucugcgcagggcugacgcacuacgcagggcgggggcuccgcauagggcggaagugcacuauaccuugaagccgacugcucggaggcugagcagcaugcuggccuucgccagccgcuuuuggcuuuuuccuuaacugauuagcuagcauuuuaucuggcugguacccuuuucucucauaaugagcugcuuccuccuccaagucuguuucuucagaggagaauucuucaucugauucagagcuacuaagagcuggcuccuugagcucaucuagugaugaguauaggcuccuucuccuagagaccucugcuaauugaucuuuuuucuuuucuuuuuucuuuuccuuccuucuaaucucuccccagguauucuuaccugaccuaaacuuuuccucggguucaagacccguggaaaggccuguauacuuauuuuguguaccauauuuccucuuugcuccuacucucucuccccgcuuuacuucugauagauugcccugaauuucauccagaauuuucagcccugccuuaaccgcuugauaacaugugaaaaggaacaaaaagguuccuaacacuagaaaaaguucaaggccaaacauaccuuguaaagcuauuucccacuuuacuucugauagacugucuugaauuucguuagaaaguucaagaccagacuuaccuuguaaagcuauacuuacggguacccuguuccccagcugaagaguucugaauucacgcaguugaauccuucucaacagucuguuuuacgggaacacuucauuaccaccguuccccagcugaggaguucugaauccaggccggauccuucucaacagucuguuuuaugggaaccuuuaugaccgugacccgcaguucugguuccggaaugagggaucuuccuugcgccggugaugguaaccguccaggguuuucucaucccaggauuucucgucccggguuuucucgucucggguuucagcaccaacucuuacacgcguucgcgacuggccaggaagaacgcaacaaaccggaaucuucugcggcaaagcuuuauugcuuacaucuucaggagccagagagcaagagagagaauggcgaaaccccgucccuuuuaaaggagaauuauccuccgccuaggacgugucacucccugauuggcugcagcccaucggccgaguugucgucacgggaaaggcagagcacauggagugaagaacuacccuuggcacaugcagagauuauuuguuuaccacuuagaacacaggaugucagcgccaucuugcaacggcgaaugugagggcggcuucccacgacuaguaaauauuauccugagugaggugacccaaucacaaaagaacacacaugguauguacucacugauaaguggauauuagcccagaaguucagaauacccaagauacaauucacagaauacaugaagcucaagaagaaugaagaccacagugugacuacuucaguucuucuuagaagggggaucaaaauacccaugggaggagauacagagacaauguuuggggcagaaacugaaggaaacgccauccaguuacugucccaccagagaauccagcccauauacaauuaccaaacccagacacuauuguggaugccaacaagugcuugcugacaggagccugauagagcugccuccuaggaggcucugcaguguuugacaaauacagagguaaaugcacacagccaaccauuggacugagcacagggucuccaauggaggagcuaagaaaggacacaaggagcugaaggaguuggcagcuccauaggaggaacaacaauaugaaccaaccaguaacuccagagcucccagggacuaaaccaccaaccaaagaguacacauggugggacucauggcuccagccacauauguaacagagaauggacuugugggacaucaaggagaggagaggcccuugggcuugugaugggccccaguguaggggaaugccaggacagggaagcaguagucgguggguuagugggcaggggaggagggaugggauuggggugguggugguggaggggaaaugaggaaaggggauaaaguuugaaaugcagauaaagaaaauaaauaaguaaauucaaaaaauaaugugaaugacugaaaacaauuagauuaaauuaaaaaauaaauaagaauuguaguccggagacacagcucaacaguuaagcacacccagugcucuuccagaggacugcaguucaguucucaguacugucucuaaaacuccaacucuaagagaaugccuuccucuggcuucaagggucacaugugcacauagaauuuuaaaaauaaaaauuauucuuuaaaaauggcaaaagaaugugguauguguauacaaugaaauucuauucaacuauuaauaguaaagacauaaugaauuuugcaggcagaaggauagaacuugagauuaucauccugaaugaaguaacccagacccaaaacauggaugguuuguauucacuuauaaauggauauuaguaauaaauuacaggauaaccauaccauacuccacagaccaaaaggggauaaacaagggguaaggaccaaacaaaguuguuugaaccugacuuagaacagagaauaaaauagucauaggagcaaaauggaaggagagaacuaggugggaguggggauggucagggaaaugggguguuucaguaucagauauagggagacacaggggagaugaccugauguccaugagaaugaagggauauccgcagguggcagggguugggguuugggacaauauucacauguuugucacauugcauggugaaaaaagccuuugauaaaaucaaacaccccuucauguugaaagucuuggagauuucagugauaaaauuugcacaucuaaccaaaauaaagguaauauaugacaagucaauagccaacaacuuaaauggagagaaacuuaagauacuaaacaaggcugcccacauacauaagagaccucaaacaaucuaccaaagaaugccuacaccaaaggugauaaacaccuacagcaaaauggcugaauaaaaaaaauugacccaaagaaaucaguagcccuccuuuauacaaaagauaaaagggacaagaaauaaaacccuucacaauggccacagaugaucuaaaauaucucaguauaacucuaaccaaccuacugaaagacaugucuaccaaaaacuucaauucccugaaaaagaaguugaagaaaacaucugaagauggaaagaucuccugugcucauggauggacaggauuaacauggugaaaauggccacuuuaccaaaaccaucuucagauucaauacauuucccaccaaaauuccaacacaauuacuuacagaaugagaaacagcaauucuuaguuuccuaucaaaaacaaaaaaugcaagaugaauauauauaauaaaauaauuccuggauguaucaucccuggucucaagacguaccacagagcaaucagaauaaaaacugcauuguauaccuauggaaaugaacaaguuggucaguggaaucaaaucgaagacccaaaaaugagucacauacccaccaacacuugauuuugacauaaaagucauacaauggaaaaaaagaaagaaaauaucuucaacaaauguugcaggucuaacuagacgucuaugagaggaugaaugcauauagacccauauuuaucccccagcacaaaacuugaguucacaggcaccaaagaccucuagaccacuaaaccagauacacuaaauuuacuaggagacaaggugggaaauauccuugauacauugguucaguagacaauuuucugaacagaacaccaaugucucaggcucuaagaucaauacuugaaacauagggacucaugaaacugaaaaacuucugcaagacaaaggacauugucaauaggaaaaaauggaaaccuacauauugggaaaagauacccaccaacccuacacuugagagagaacuaaaguccaaaauauauaaagaacacaagaaguuagggaacucauaaaucaauuuaaaaauaggguaaauagcuaaacagagaauucucaacagaggaaucucagaaguuugagaaacaccugaauguucaaagucuucaguccucagugaaaugaaaaucaaaaggacucgaagaauccaucuuacaccagucagaauggcuaaaaaucaaaaccuggagugacagcacaagcuggcaagaauauugggcaaggggaacacucuucuauugcuggugggagggcacauguuuacaaccccuuuugaaaaguaauuugggggacacccccaaggaaccacacaggauuccccacgggauccuaagaccucuggugaguggaacacagugucugcuccaauccaaucgugcgggaccugagacuccauuaauuaaggaagcagauaacccugccugaucagaggcacaagucccuucugguucacuccagcaucggaguuccuugugcgcggaguuucuggacacccccaagguccucacaggacccuccauggaaucuuaagaccucugaugaguggaacacaacuccugccaggaggcagguucgaacaccagauaucugggcaccugcccugcaagaggagagcuugccugcagagaguacucugaccacugaaacuaaggauagaucuagucucccagaucugcugauagaggguaaaauaaucaccugaggaacaagcucuaaccagagacaacuauaacaacuagcuccagagaauaccagauggugaaaggcaaacguaagaauccuacuaacagaaaucaagaccacucaccaucaucagaacgcaagggugaaaucaaccaaguguaaacaagaagaacuauucaaaugaggaguugguucuuugagaaaaucaacaagauagauaaacccuuagcuagacucacuagagggcacagggacagcauccuaauuaacaaaaucagaaaugaaaaugagaagggagacauaacaacagauccugaagaaauccaaaacaccaucagcuccuucuacaaaaggcuauacucaacaaaacuggaaaaccuggacgaaauggacaaauuucuagacagauaccagguaccaaaguuaaaucaggaucaaguuaacgaucuaaacagacccauauccccuaaagaaauagaagcagucauuaauagucucccaggcaaaaaaaaaaagcccaggaccagauggguuuagugcagaguucuaucagaccuuuaaagaagaucuaauuccaguucugcacaaacuauuccacaaaauagaaguagaagguacucuacccaacucauucuauaaagccacaauuacucugauaccuaaaccacagaaagauccaacaaagauggagaacuucagaccaauuucccuuaugaauaucgauguaaaaaaaacucaauaaaauucucgcugacugaauccaagaacacauuaaagcaaucauccauccugaccaaguagguuuuauuccagggaugcagggaugguuuaauauacggaaauccaucaaaguaauccauuauauaaacaaacucaaagacaaaaaacacaugaucaucccguuagaugcagagaaagcauuugacaagauccaacacccauucaugauaaaagucuuggaaagaucaugaauucaagguccauaccuaaacaugauaaaagcaaucuacagcaaaucaguagccaacaucaaaguaaauggugagaagcuagaagcaaucccacuaaaaucagggacuagacaaggcugcccacuacucccuaccucuucaauauaguacuugaaguccuagccagagcgauucgacaacaaaaggagaucaaguggauacaaauuggaaaagaugaagucaaaauaucacucuuugcagaugauaugauaguauauauaauugacccuaaaaauuccaccagagaacacccaaaccugauaaacagcuucagugaaguagcuggauauaaaauuuacucaaacaagucaauggccuuucucuucacaaaggauaaacagacugagaaagaaauuagggaaacaacacccuucacaauagucacaauuaauauaaaauaccuuggcgugacucuaacuaaggaagugaaagaucuguaugauaagaacuucaagucucugaagaaagaaauuaaagaucucagaagauggaaagauaucccauacucauggauuggcaggaucaacauuguaaaaauggcuaucuugccaaaagcaaucuacagauucaaugcaauccccaucaaaauugcaacucaauucuucaacgaaucagaaagagcaaucugcaaauucaucuggaauaacaaaaaaccuaggauagcaaaaacucuucucaaggaugaaagaaccacugguggaaucaccaugccugaccuaaagcuuuacuacagagcaauugugauaaaaaccgcugguacugguauagugacagacaaguugaccaauggaauagaauugaagacccagaaaugaacccacacacguauggucacuugaucuucgacaagggaagagcuaaaucaaguggaaguaagacagcauuuucaacaaauggugcugggacaacugguuguuaacauguagaagaaugcaaaucgauccauuccuaucuccuuguacuaaggucaaaucuaaguggaucaaggaacuccacauaaaaccagagacacugaaacuuauagaggagaaaguggggaaaagccuugaagauauggccacagggggaaaaauucugaauagaacaggcuugugcuguaagaucgagaauugacaaaugggaccucaugaaacugcaaagcuucuguaaggcaaaagacaccaucaauaagacaaaaaggccaccaacagauugggaaaggaucuuuaccucuccuaaaucagauaggggacuaauauccaauauauauaaaggacucaagaagguggacuccggaaaaucaaauaaccccauuaaaaaauggagcucagagcugaacaaagaauucucaccugaggaauaccgaauggcugagaagcaccugaaaaaauguucaacauccuuaaucaucagggaaaugcaaaucaaaacaacccugagauuccaccucacaccagucagaauggcuaagaucaaaaauucaggugacagcagaugcuggcgaggauguggagaaagaggaacacuccuccauuguuggugggauugcaagcuuguacaaccacucuggaaaucagucuggcaguuccucagaaaauuggacauaguacuaccggagcauagugcaauaccucuccugggcauauauccagaagauguuccaacccguaagaaggacacaugcuccacuauguucauagcagccuuauuuauaauagccagaagcuggauagaacccagaugccccucaacagaggaauggauacaaauaaugugguacauuuacacaauggaguacuacucagcuauuaauaagaaugaauuucugaaauuccuaggcaaauggauggaccuggagggcaucauccugagugagguaacauaaucacaaaagaacucaaaugauauguacucacugauaaguggauauuagcccagaaacuuaguauucccgagauauaagauacaauuugcaaaacacaugaaacugaagaagaacgaagaccaaaguguggacacuuugccccuucuuagaauuggaaacaaucacccauggaaggagucacagagacaauguuuggagcugagacaaaaggauggaccaucuagagacugccauauccagggauccauccccuauuuagccuccaaacgaugacaccauugcauacacuagcaagcguuggcugaaaggaccuugauauagcugucucuugugagacuaggccggggccuagcaaacacauaaguggaugcucacagucagcuauuggauggagcacagggcccccaauggacgaguuagagaaaguauccgaggagcuaaagaggucugcaacccuguaggugcaacaacauuaugaacuaacaaguaccccggagcucuugacucuagcugcauauguaucaaaagauggccuggucggccaucacuggaaagagaggcccauuggacacacaaacguuauaugccccaguacaggggaaugccagggccaaaaaaugggaauggguggauagggaagugguggggaggguaugggggaauuuugggauagcauucuaaauguaauugaggaaaauacguaauaauaaauaaauaaaaugauaaaauaaaauuagauucccaaguauuaaaaaaaaaaaaagaaaaaaaaagaaaaguaauuuggcagguuuuguuguuguuguuguuguuuucugaaaauuaggaauaguucuaccucaagacacagcuauaucacucaugggcauauacccaaaagauguuccaccauaccaucucaauaacuguugcucaacucuguuaauaaaaccuuuauuugucauagccagaaacagaaaaccgagauggacuuuaacugaaaaauagaugaauaaaaugugguauaccuacacagugaaauaucauuccacuguuuaaaacaaggaauccaugaaauuugcaggcaaauggguacgcuuugaaaauaucaucuggagugauguaauccaaacccagacacacaggcaugguauguacucacuuagaaugaguacuuuuccagacauauagugcaggauaaucaugcuaagauccacagacuuaaagaagcuaaaacacgagaacaaaaggaaaaugcuugauucucacucagaagggaaaauaaaauagacauuaggauuugauuuagggagggaaauuugugggagauggagagggaacuaagguggggagcaagaguagggugguaucagggagaagagauaccugaggagaggcaccucugugaugaaacaaagaccagggacugugggggcucuuaggaaucuauaggggugagucaacuagcagcaggugauauggagcccuaagcaaucuucuccuguaaccagaagggacuuccaguggaaggaggggaauaccaaugcccucacaacaacaucaacccaaaauuuauccuaccuacaagauauucagggauuacaauggaacagagauuaagggaaucgccacccaauaacuggcccaacuugagacccacacugugggagagagccaggcuuugacaccauuaaugauguucugcuaugcuuguagacaggagccuaggauaacacuuccaagaggcuucauccagcagaggauggaaacaaauguacagaaccacagauaaacaucaaggggaguuuggagagucuuguggaagaguuggggaaggacauugaacucaaaggagaacauugugacugaggggucagggacaccacaagaaaaccuacacaaucaaguagccugggcccaugagggcucacagagauugaaccaccaaucaaagagcauucaugggcugcacauagacccccuccccauauguagcagaugugcagcuuggucuucaugugaguucucuauaaacugaagggcggaccgcuucacacuguugucugcauuuggauuccucucugcuaguugagcugccuugucuggacucagugggaaaggagcuuaaucucuacucuuauuuaggguaauaggauuggcuacuauauaccauauuuauauucacuauaaaaaucuuaccuucauugaaccugacaugcuucacuucaguucucugagcugaugauccaguacugugacauagauuuuaaaguuagcauuauugugcuauucauaagaaaaauauuuagcaaguguuuuaaguacuuuauauuugugucccuucuguaucuuacuuuagauguuuacaaacaauauuuuuuuugaaucaggaucucacuauguauccaugcuggucugaaaauugcucuauggagcauguuggccuuaacucacagaaaucuguucauguccuccuucccaaguucugggaugcaaugcaugggccaacaagacuagacaaaauguugaauucacuuuucagcaauugacuaugauugcugacugcucagcucccaccuuuucucaagaggaaauaugaggaauacuuagcucuuaauuaaaacacaaacaaagugcacacacacgcaaacacacacacacaaacacaaacacacacacacacacuaaaaagaauuaaagacaagaucgggcaugcucagggugguuuggcuguagacacuuauggaagucuaaaaggaaggauuccaggccugaaggagauaggaacuccagaggaugaccaacuaccagaaucaaauaacaugaacccucagggcacucagagauggaacaaugaaacaaagaacaaacauggguuggacggauaucuccgagcaccuauguagcagaggggcagcuaggucuucacaugggucccaaucaacuggaauggggguaucaaaaaaagcuguucauccuaccucaguuuuauucuucuagcugagcuacuuuuucuguccucagagagagacgaagugccaggguuuggacauacauggagucccaaacugcucagaggugaaguggaggaggggcagggagagacugugggacugggugaccaggagggggucacugagcuagauguaaacaugaacaagaaaaaaauaaaauuaaguuuuuacauauaucauuaaaguuuugaaauguaucuuaaaucacagaaagaacuguuauuuggaaauaauggcucaacauaaacaacagauauacauguccacuaaacagaaaauuucagcauaaagagauguauuccauauggaaaaagcauguggcauuguaagagcaaacucuuucagagcuaaauauucacagaauucaguacaagauuuauaacgcuaauuaaaguaguagacucugcggaaagaaaugaacuacuuauauauccacuuugaaagcuccaucugaaguggggaagaaaaaugucuugaacugcggaaucaccaaaguugcuggguaccugugcuaggacaguuuaagaacaucucccagugaaagguaguuuucugcugacuuggacauuucaggacucaaacaucauuuggaaacacugcuugguaccugugauuauguaugguauaauucuaaagaaauggcuuaugcugucaucuuuggggucacagguuauaaguuuucaggcuuagggacuguggguguuuaucaugguagaacacuugccauagacaccuauggcucuuaauucagugacaaacacuuucaaaaguaaaaauacaguggcaguggagcagcaaccgaucuugguuauccuuuggcuugguggauggcucaugaggugaacuccugaacuaggcagugaucccuggugcaugcuguucuuuguuguggugaaacugucucuuuuccagcucccacuucaugugugcuaagcuuccuaacuaugccucugaguuucuuacaaucucucuaucauuuuaauacuccugacuuaagcaauugucacccucaagagcagcacuaagauugaagaaaagaagaaacuguaccuuuuugcacacuuugcugcuaaaaauucuaccauuucagguuucuguucaaauguugcaaguugcaauggugucaagccauacuauaaaggaaaaaaauauugcauuuuacaaaacuacuuguuucucaacaaucugcucaucaccgauuuuaugaagauaaauagacaagaaaagagucacaagggaucauucacccuacaacaccugcugcacuuucccacacacagcugucuuuucccuuugacacgccuuuucccuguccaacacugccuauaacacggcucccuuccagaacucucuccaaacacucaaggauugcaaucuucuuagcuccguggaguggggccuccauugccacagcccagaauacagaguacacugugcuaugccccuguugaaggagugugcucaggaggggucuggagcagaguuucucaaccuguauuucaaauauauuucuuuucuaaacuaagaauuuaucucagaagcuugacagccucucccauguacaucaaaacuuuuuaaaccuuaaauaacuuuuuuggcauauuuucuccagugaccaaauuucuucauuugccuguuaccucucucguuuuccagucuacccuuauccuaagccaaacacauaucaguaccuucuuugcaccaacacauuucuauuuauucuacaaucacuuaacuugaaaugaauuuauuuuuauugucugugcguaugugauguuugugugguccuaaauacuuuauuuuugaauuuuaaaaucaaggccaauucugagacaaaauacacuauuuuuuuuaaugaacuagcaaaaaauaugaaaaaauauauuuggugaaaauaaaaggguuccacugaauagauucagugagaaugcaugagcuucuguguguagaaaauagaugugcaugucacugcuagaggugcccugggaaugaaguugagugaucuuuaccucuguuuuggcuucaaugucuacguugugcucaaggagcauuuuuacaauccuuaaguuaccccuggauauagcaugguguaaggcuguguucccacugaaaucuaucagauuuggauccgcauugugggugagcaauacggaagcacaauccacauugucucguuggguggccuguaaaauuguacaaagaaauacaucuuaaauucaaggaagucaagagagauguuuucuaccauugcacugaauacuuucccuuaaauaaaacauagaguuucacuucugcauauuaucacucucuuuagacacaaggucuuuuaagaacccccaggcuugcuugccuaacuuuauaaucuccccaccacaucucuuucccagugguagaauuuaaggguucuguuaacacaccuagauauucuaagaauucaggcucugugcugguuuguuguugcauuucagagauuaguucuuugguuagguuuuuuguuuguugguugguuuuguuuguuuguuuguuuguuuuucuuuuugccagugcaacacaggcuuaacacaccuagaaagauucucacuugaggaaaugccucuaucagacuggccucugggcaacuauguggacuuuuuuuuuuuuaauuuuaaauugagauagaaguuggaaagucucgguuuuaggaguugggguaugccugggacaaaguccucaauuuuguuaaaaaacaaaaacaacaacaacaaguaaacaccugagcaaggcuugguaaaagccauggaaaagcugcauucuccugugaacuccaguucaguucuucccuccaguuccugauuugagcuccugcccugguuccccuugagaaugaucugugauauguaaauguaagccaaauaaccauuuccucuccugaguuguuucuggucaguguuuuaucacagcaagagaaaccaaacaaggacaaccucuauccauuuucaugucaaaacagauggccaauagcuaccuuaaucaagggugugcagccuucaucaucccggauguuaaugcuggaauuauuuucuaauaauagugucaccacgucuggaugguugugggcacaugcauaaugcagcgaaguccugcaaauggaaagggcauuuagggacauucccaaaugcuaaauaagagccccaucuccuuuaagcaccacauacuaugaagcuaauuuucuucugauguaagaaaauaacuggaauugccuuauuuauuuaugacuacucaaauguucauuuacugugcuagggauaaugugcauggcuguguccacauaaggcagguguucucucacgaccuucaucccuguacaaagaaucauagaaaaguucccaguaaguucaucucagcaugaauucaaauccuacucuaauaucugguacucacuagugacuacuugggauuucuaugagcuccaugacuccauuuccagauccaaagaauggagauuaagcauagcuguuaucuuacccggggcugcugggaggcuucagguuggaugggcaagaacucugcuagaacauuacaagcauuuacagcuccugagaguucagcauuugcucaucaugauaaugauuucucuuccuuguuauaacaagcacaacauuucagugaagguaaaacaggauucuaucaacaguacacauauaaaacuuuucuagucaaagaagcuuacaugucuuuaaaaauaacucuuuuucaccaacuaagucuugaacaugauaauccuccuaacucauccuaaauaguggccagugacacugggcucacugucccuuuucauucacauuuuagccucucuaacauuggaaugucauuuaucauuucuauuauuuagcaacuauaauugccaauauuuuuaacuuuguuucucuacaaaauaaaggguuaucaugaaacccauugugccuuacauugaacaaaauauggcacaauccgcagguaaauggcaaugauacagaucacuuguaucuauguaaauucuuaaaaacaaacaaaacucuaagacaucagccaucaauucuuugucuguuuguuuuucauuucuacaguucauuuuuuuaugcccaugaguaguguuuccauaccugguagcagggggagcacaaccuaguuguuagguaauagauacaguauccaugguaauccaggcacuagaugguagcaaaggaggaccucaugcuuugccauaaaauggucaaugugcuccuggacucacaccaaaauugggucaauauccauacaaggugauaaccuaugccauccuagcuccuaugcuugauauucaaaaggcuacaagcucaaugaagcaaggguuccaaugagcaugcuucaguucauuuaacauuuaaauuuauagaauguaaggaagcuugacugggcagagaaacauaaugguauaagacuggaaagaucuggagagauagcagaauguguauucuacacaguagauaucuaacuuauguguggggaacgaaugggcugacagaaugaaaaacuacaguuggacaacucaguguuuuuaaagaaaacauucauuaagcaaacgaguauccuaaauuauaauuuauaauuuauucaucuauuauuuauaugaagcuccaacuucaagccucuuugaacuacaaaauguucaaaaagcuuguggacuacagaaaaucuacaguugugucauugauucccguucauaaccuaguaugaccuaaaaauaggaaauaagaaugaggggcugggauggugguaaaacucaauugguaaaacacuugcccuggaaaccugaaugcagauguggggauaugggaauccccaaaccuuacucgccuacaagucugagaaucagugugcuccaagagaguaaaucaaacauaccaugggauuugggugagugaacaugucucuaaaacugagggaccauuggguggaacccaccaggggcccugauggccagaguucaguucccagaacccacaauguggcagaagagaacugucaagugucgauuucucugauuaccccacacuuaguuccacaugugugcgacacagaaaagugagaggaagacaaugucagucccuuaacauguguaucaaugcacaaauaacauguacauaugaugagaaaugggauuggugguggugggggaaauguauauuuguuccaguucaaaaugucuuugauccauuaacaaaaaugggucauauugaucuaagauuucauagugauuuuuuccauuucaguugacaauuuaucuuaugauaaauuuuccaguguuguauauuaguguuaauggucuauauauugagacaaaucuagacagguggcuuggcaguuaacagcucuagguauuuuuucuagaacacucagcuuugauugcuagcacccacauggcagcucacaacuguguauagcuccaauucgaggggaccaagaaccugauugugucacacauggugcaucgaaaaugcacauagacaaaaccuuugugcgugcuuguguguguguguguguggguguguuuguguugcugugcaugagugucuucaaaguuuuaguguaacauaaaaauaaaaugauguaguuuaaucaaggccuagggccugguguuccaggguaugcaggucucauauuacuaagagcauuaaacacaaugcaggagaccccaguggaaaugacccuaagcaugacaucucuccuuuauuaguauguggcccugaaaguugauuuuucuguuuaucucugaguauaccugacagaucccacccaccucuguguacccccccucaccaauuucaagccccauuaccuuuuccuucuaucagauucauccacaugauguugacuggaguggauuaacuucucuguuguaucaaggucacccacgcuggccgcucguuguaauggaccuauaggaucauagccaaucaaguagaggggauauuucuucuuuuucugaggaugcaugcaucuaagacccagacaugaaugccacaggcggguguaccagcgucuccuucuggggauguucauugucugggcaccauaauugauuucuuccuccauu

SEQ ID NO: 4468 - RNA, 4663 nt, Mus musculus
aaaucagcagauccuaaaggagacacugggaagguagauggagggaaagaugcucauguucuuagccucaguagaagggcuggauugggaacaagaucuauguuuuaaaaacuuugaaugugugaaaucacugaaagucccaaaauucuuccccuaguagaaugaaugaaugaaaccaugaugaaaugaaaccaugucugcuucagguugggagauuuuguuacacuguaaauuuucagaaauccagaauuagaugacaagguaaagaugcucaacuauuaaggguuuuuuuugucuugauuuguuuuguuuuguuuuuugguuuuuuuuuucauuucuuuagaaaaggggaaacaaauauaggagcugauggcuaacauuuaaaacuagaucaagugagccucaaaccccccuacucucuggagagagaaagaaaauaucaggaaguggaagauaauuuucauaggauuguugucuccugcauuaaauauaguuuuccauucacgucauaucuauggaaacaaaauccucagauuucaugaagggaaauauaucuuaagcaaucuaagagugcucuuuaaagagucagagguggaagaaauaagagauacugcucuguauauucucccuaguacuugagguuucucacagagcuacugucagucuguuuucugauagauagugagagaaagucuugucugaaguugggcuucaucccuaaaaaaaggcuugaugaagucuugcaaacugaucacuacaaccagggaagggagugccugaagucaccagaacccaguaccagaucuucugucagagaauuauaauccaugguguuagccucccagauccacaagcaucacuuuagcucaaccagaggaaugaggaaugcagagucaaacugcuuccaauuaccagaagccugguucucuccagagugugggugggcuauuucagaggucucuuucuuaaucuucugucuggaccaccccauauggcucagggcagucuaaauaaaccaugggacauauuuaaaugccucuuuuauaugccuguguauauuacaaaggaugucuuacccauuuauuuuuagaaagcuucauaauuaucucacuguuguuucaauaaauccauccauuaaaacacucuuuuuuuuccuucaguaaauuaaugccauuuaucagaaagaaugggauauuuuugaaguaaugaugaaagaaaagcaauuggauacagcaaacucacccaugccuccuaguaauuacuaaagcaugagccuaccacccuagacagauggaacuuuccaagguaaugucaaguguccuuuuugggucacagagagaggacucauuuaauuaguuucuauaauccuagguuaauccugcugagaauuacugaugugauuuuuacuuauguagaagaauaaucuauuguuccacacacauuucuggcaaaacaaauuaaaaaucauguaccuuguuuuuaauuuauuagugccauaauaaagaaagguuuccccuuucauuuuccucaguuagaaaugccaauuuccuuuccuuuggaucacauuguugauuaacaaauucaaauaggauauuucaacagaagauaauguaggauacauuuaauucuccaaaauuuuagaugguaacucuucauuauaguccuugcuauuguguacaaaggaccaugagaacaaauugauuuuaccuucaugaaauugaauaccuagacuaucuacucuuacccuggcugaacaccugaaucacgugggaaacuuacaaaauuccuuaccacacccuaaaucaaacagagauaaaguaaucccagaauauaguauuuuuaagguucuaaggggaccccauuguccauagcucuuaaaauuauuucaaguuacgcuuuagucccaagugucuuaaugcacuaguuccauuuaagucacuuugaucagcuauucugagagguuauuaaagucccuguaaaacgcuuuaguagucacucacugucuuagaugugaaaacuaaccucugaagcagguaauguuuguugaugaaugaaguuauacaaaugaugcuguaccgggcaccugauaucuacgacuaccuugcugcuucauguccucaaccccaucuucaugucugugaaaugaagggcuucguaucucgggugcccacuaaaggaaaucucagaaaaacaugacaaaaccaaauucacacaauauuuuuccacaaaaaccagcccuucaaaggaugauaaagugagaacuccaacacaaggagggaacuacacccuagaaaaagcaagaaagaaaucuuucaaaacaccuaaaagaagaaaaucacaugaacagaaucuuaacucucacaacaaaaauaacaggaaaccacaauuaaagaagaugagauggaaagucaauagacauguuagccuggaaguggagauggggauauauuacuucagggggaaauccacccacuaaggggaacaaagauacuaaauaaaauuaauaugaaaaacauaaaggaagaccaccaacuauuauuugucuguacacuauauguuaauuccuuuaaucuacucagaauuucauaauuaguauuauuauugucucacuuuauagcaggcacaaacggacugcaaaaugaagacagcuucuggagguaagaaguggggucagguucaaccccaggcagcaugcucaggcccucaugcuuauguucuaagaggaagaagagcauagggacagaugcuacauuuccuuucuuugugaagcccgguuccuguuugaaauggggaugcuguuccaccaaaccuauaaaacugaaggagauaaucacuaaaguuaacgcagucaccuuagcuuuacacauguggaagcccuucauaugaguccuuuggucauuugugacugucgccaacucaacgagaaggcauugauuuaucacacguucuccacacaaagagagaagacagaacaaugaaguuccacagagauggaggaggcaccuccugucuaaaagguaaccaacuguauaggaggaaaugagcugucaugggacaaucagucugaagguauucuucauguaguauaaccagcuucugggaagucauaugccaucguaggagguguacuaaacugacauuuagagaaccugcauucaaguccuggcgcuguuagucaaguuaccacacagguaagagccucaguucagaagaucugcugggauagaagcuuuucucucauguauuuccgcucagcacagaggcuucacagcgccuuuaagagcaucugaccucuuuuuguuuguuauguuuuugaaagagggacuauuuacuccuggaacuauguagaucaggcuggucucgaacucagagaucuucugccuccagagugcugaaagaguuacaggaauaaagaucccuaauguuugggaagcuauuuaaauauuacagucaguagacaugguuacaucagaaagcucacacagugagcacauucgguguuccuuugaggguccaauuccucauccauaagauaggguuagucuuuaccuguuuaauuaguaguuaguaaguucuucagcaaguuauuuauccuccaaagucucagcugcaaugugagacauguaaaugagacauuuuguaaugcugaacagugccuggcuuguuguagguacucuagaaauauuagucaucaucaucuaccuaagauguaggcuggccaaggacauucaugcaaucaguucuuucuaacauuaauuacugugcuucugagcacuaagagaugggcguugcucuagggaucagaagugugcaacauuucaagccugguggagcuuugucuuuuaaauuaauuccuuaaugaauauuuacuacaugccagcgaacaagacaguaaguccuaagaaauucucauuuuacacuuaacuacgaaaugugcagagaucccaaacgugcgccacagucccacaaguaguuucucccugcgauuaggcaagaguggggcgugggcugaugcccugcaggguuucccccaccagcacagcauccuugcagaagcggaaucggaaggccaccgcgaccuugguggggcuccaucuggaagcagggcacuccaccaggccacccgcaagcacucgccgcggcagccacguccccaggcggcgacuccacgcagacugccgcagcgcccaaagucucgcuaacagugcgagcccgccggaaaacggaggcccugaaaagcaggccgggcccgcccgcguccaugaacuuccaagccaggccggcgacgcguggcaagcgaccccagauaccaugaggccugggccaggcagggcccagccccgcacggauaacugugcgcuucagcagcguaggaaucgcggagcggacgccgcacuccgcauuccccagcccgcccgaagcggcccgccuugcggagcuaccugcaggucccagccagccgacuccaggaagaaacgagcccuuuccuccucagugcccgucaccgccacgaacucccucaacgccuccugcugcuccgccgccaucuccgccccgugcacuucccaaaccgcuccaaauagcucuggguacauuacccaauggucaguuucagaaaaggaagccaaccaugucagaaaccauaguugucuguccuccuaac

SEQ ID NO: 4469 - RNA, 4663 nt, Mus musculus
guuaggaggacagacaacuaugguuucugacaugguuggcuuccuuuucugaaacugaccauuggguaauguacccagagcuauuuggagcgguuugggaagugcacggggcggagauggcggcggagcagcaggaggcguugagggaguucguggcggugacgggcacugaggaggaaagggcucguuucuuccuggagucggcuggcugggaccugcagguagcuccgcaaggcgggccgcuucgggcgggcuggggaaugcggagugcggcguccgcuccgcgauuccuacgcugcugaagcgcacaguuauccgugcggggcugggcccugccuggcccaggccucaugguaucuggggucgcuugccacgcgucgccggccuggcuuggaaguucauggacgcgggcgggcccggccugcuuuucagggccuccguuuuccggcgggcucgcacuguuagcgagacuuugggcgcugcggcagucugcguggagucgccgccuggggacguggcugccgcggcgagugcuugcggguggccugguggagugcccugcuuccagauggagccccaccaaggucgcgguggccuuccgauuccgcuucugcaaggaugcugugcuggugggggaaacccugcagggcaucagcccacgccccacucuugccuaaucgcagggagaaacuacuugugggacuguggcgcacguuugggaucucugcacauuucguaguuaaguguaaaaugagaauuucuuaggacuuacugucuuguucgcuggcauguaguaaauauucauuaaggaauuaauuuaaaagacaaagcuccaccaggcuugaaauguugcacacuucugaucccuagagcaacgcccaucucuuagugcucagaagcacaguaauuaauguuagaaagaacugauugcaugaauguccuuggccagccuacaucuuagguagaugaugaugacuaauauuucuagaguaccuacaacaagccaggcacuguucagcauuacaaaaugucucauuuacaugucucacauugcagcugagacuuuggaggauaaauaacuugcugaagaacuuacuaacuacuaauuaaacagguaaagacuaacccuaucuuauggaugaggaauuggacccucaaaggaacaccgaaugugcucacugugugagcuuucugauguaaccaugucuacugacuguaauauuuaaauagcuucccaaacauuagggaucuuuauuccuguaacucuuucagcacucuggaggcagaagaucucugaguucgagaccagccugaucuacauaguuccaggaguaaauagucccucuuucaaaaacauaacaaacaaaaagaggucagaugcucuuaaaggcgcugugaagccucugugcugagcggaaauacaugagagaaaagcuucuaucccagcagaucuucugaacugaggcucuuaccugugugguaacuugacuaacagcgccaggacuugaaugcagguucucuaaaugucaguuuaguacaccuccuacgauggcauaugacuucccagaagcugguuauacuacaugaagaauaccuucagacugauugucccaugacagcucauuuccuccuauacaguugguuaccuuuuagacaggaggugccuccuccaucucuguggaacuucauuguucugucuucucucuuuguguggagaacgugugauaaaucaaugccuucucguugaguuggcgacagucacaaaugaccaaaggacucauaugaagggcuuccacauguguaaagcuaaggugacugcguuaacuuuagugauuaucuccuucaguuuuauagguuugguggaacagcauccccauuucaaacaggaaccgggcuucacaaagaaaggaaauguagcaucugucccuaugcucuucuuccucuuagaacauaagcaugagggccugagcaugcugccugggguugaaccugaccccacuucuuaccuccagaagcugucuucauuuugcaguccguuugugccugcuauaaagugagacaauaauaauacuaauuaugaaauucugaguagauuaaaggaauuaacauauaguguacagacaaauaauaguugguggucuuccuuuauguuuuucauauuaauuuuauuuaguaucuuuguuccccuuaguggguggauuucccccugaaguaauauauccccaucuccacuuccaggcuaacaugucuauugacuuuccaucucaucuucuuuaauugugguuuccuguuauuuuuguugugagaguuaagauucuguucaugugauuuucuucuuuuagguguuuugaaagauuucuuucuugcuuuuucuaggguguaguucccuccuuguguuggaguucucacuuuaucauccuuugaagggcugguuuuuguggaaaaauauugugugaauuugguuuugucauguuuuucugagauuuccuuuagugggcacccgagauacgaagcccuucauuucacagacaugaagaugggguugaggacaugaagcagcaagguagucguagauaucaggugcccgguacagcaucauuuguauaacuucauucaucaacaaacauuaccugcuucagagguuaguuuucacaucuaagacagugagugacuacuaaagcguuuuacagggacuuuaauaaccucucagaauagcugaucaaagugacuuaaauggaacuagugcauuaagacacuugggacuaaagcguaacuugaaauaauuuuaagagcuauggacaaugggguccccuuagaaccuuaaaaauacuauauucugggauuacuuuaucucuguuugauuuagggugugguaaggaauuuuguaaguuucccacgugauucagguguucagccaggguaagaguagauagucuagguauucaauuucaugaagguaaaaucaauuuguucucaugguccuuuguacacaauagcaaggacuauaaugaagaguuaccaucuaaaauuuuggagaauuaaauguauccuacauuaucuucuguugaaauauccuauuugaauuuguuaaucaacaaugugauccaaaggaaaggaaauuggcauuucuaacugaggaaaaugaaaggggaaaccuuucuuuauuauggcacuaauaaauuaaaaacaagguacaugauuuuuaauuuguuuugccagaaauguguguggaacaauagauuauucuucuacauaaguaaaaaucacaucaguaauucucagcaggauuaaccuaggauuauagaaacuaauuaaaugaguccucucucugugacccaaaaaggacacuugacauuaccuuggaaaguuccaucugucuagggugguaggcucaugcuuuaguaauuacuaggaggcaugggugaguuugcuguauccaauugcuuuucuuucaucauuacuucaaaaauaucccauucuuucugauaaauggcauuaauuuacugaaggaaaaaaaagaguguuuuaauggauggauuuauugaaacaacagugagauaauuaugaagcuuucuaaaaauaaauggguaagacauccuuuguaauauacacaggcauauaaaagaggcauuuaaauaugucccaugguuuauuuagacugcccugagccauauggggugguccagacagaagauuaagaaagagaccucugaaauagcccacccacacucuggagagaaccaggcuucugguaauuggaagcaguuugacucugcauuccucauuccucugguugagcuaaagugaugcuuguggaucugggaggcuaacaccauggauuauaauucucugacagaagaucugguacuggguucuggugacuucaggcacucccuucccugguuguagugaucaguuugcaagacuucaucaagccuuuuuuuagggaugaagcccaacuucagacaagacuuucucucacuaucuaucagaaaacagacugacaguagcucugugagaaaccucaaguacuagggagaauauacagagcaguaucucuuauuucuuccaccucugacucuuuaaagagcacucuuagauugcuuaagauauauuucccuucaugaaaucugaggauuuuguuuccauagauaugacgugaauggaaaacuauauuuaaugcaggagacaacaauccuaugaaaauuaucuuccacuuccugauauuuucuuucucucuccagagaguagggggguuugaggcucacuugaucuaguuuuaaauguuagccaucagcuccuauauuuguuuccccuuuucuaaagaaaugaaaaaaaaaaccaaaaaacaaaacaaaacaaaucaagacaaaaaaaacccuuaauaguugagcaucuuuaccuugucaucuaauucuggauuucugaaaauuuacaguguaacaaaaucucccaaccugaagcagacaugguuucauuucaucaugguuucauucauucauucuacuaggggaagaauuuugggacuuucagugauuucacacauucaaaguuuuuaaaacauagaucuuguucccaauccagcccuucuacugaggcuaagaacaugagcaucuuucccuccaucuaccuucccagugucuccuuuaggaucugcugauuu

SEQ ID NO: 4470 - RNA, 1141 nt, Mus musculus
auuucuuuuauuaaauuaagugugcagaaucccaguuuucucuugagagacuguuuucuuuaaucaccacaauaugacuguguuugucucuucuaaugaauucuccuuagaagccuuucaucagaccgugucugcuuucucaggagugucuccaguguccuuuaagcccuucuucuguaugcugaugauuguaucaguuaugccugugguuucagaggugugguuuuguuuguuuguuuuugagacagugucucaccauacaacccugacugucuggauauugcuauguagaccauagaacucagaaauauguagaccauagccucaaacucagaaaaaugccugccccugccaccagaaugcugggauuaaacgugugugacaccaagccuggcuuguguaauuacuucuuagcuauugcuugccuuuuugcuacuguuuccugcaagcucucuuuccaccccuugguuucucuauucagugaagaauuaauguagugacaacuucagaauuuugguuucuuuaaaaacacagaaauauuauaagaauguguuuucauuuuaaaccaaggaguggagauaugggacacuucagacuguccaaagcagcugacuacgauuugccucaugcucuagcagagguaugguauugccagccgcagauaguuucugcgauauugugugauacugugaugucucugugacauucggaauucugagaacuuuucggaggguacaugaaugcuagcuccccaggagcuggagcaggugcucguuggccauuuagggagguugguuuguaauugcuguggucaaagaagaaacaaaaggaaagacauuagauuuaggaauucauucucucucucucucucucucucucucucucucucucucucucucucucucucucccucccucccucccucccucccucuuuccuauuuagugauggggugaaaugggguggggugcggggguaaagggugggaaaagaagaauccacaaaguagcaaagaccagcuacaaauuacagaaugaaaaguuugcagucuacaugcagaagauuauuauuauuaagauuauuauugcuccagauugcccaaagcuauuuagggagacccuguuuaaaaaacaaaaaagca

SEQ ID NO: 4471 - RNA, 13194 nt, Mus musculus
cggggcgacaccacugggucggcagaggcaggaaaucgggcuggucccgggcggcgcgcagcccugucccuuucucagcauugccgcgcguuccccaccccacccccugcccccgggcaucgccauggacucagcggagacagguacgggguggggaccgaagggggggggccucccaccaccgcuccucaguuccuaaaccagaaaacccaacuuaccccugagcuaucugacagccgggaaaggaguacugacaggggaaggaacgaggggauccccgagcaccuuggagaccccugaagcgcacagugcucacgacgccagccuucagcccucggauugcccgccagagcgggcaccccggaugccugggggaaggggcccaggaaggggaaguggccgcuucugcuucugaucguaggauggaugggggcagggugucauggccaauauuccugcagguagccccgaggcaucaggcuagggggcggcggcagaauuguggcuagaacuggguuauguuuccggcugucuuuguguaucgagugucauucaguccugucccucgugguuucagcgguacucgcguguguuuauaccgcaggcuaagugccugugugucccacgugcuuuuccaucugucuggccugggguccauguggcuccauugucaagccagcccucuacuccagcauucauauggcagcugcaucuguuuccuuccuuugcuuauggguccucccaugcauggugucccuguggcugugagcaaacgcuucucugagauuuuaccuggauccaucuguggaaucagaaaugaccccaccgaagcgcucucucucucucucucucucucucucucucucucucucucucucucucucucucucucucucucucucucucucucucucucucucucucucucucucucugucccccucccuccccccuccuucucuccccucuccgcccgccccccuucccaccucugcuugagagugguuguugagguacauucggauugcuuugccacuacuaauggguggagagagacacugguuggcucauguuuucuuacacuucccucccccagagcuaaccccagcuccugagggcaggaagagauacagugacaucuuccagagccuggacaaccucgagauaucauuggggaacgugugagucugagccugugucaccacauugggcagagcucccuaauuauuuggguaucaugcugccccacauccagacacccugacuuccaaccuccugagccuaagacaggagccccccccuccaaacaacugggcccucugguauucuagauacauagguauuugggggucuaucuuaaagacagaugauccugagacacacacaugcaacuucaugauuccuuuaaaaaugguagaagcagcuaugagugucaauuccguaagccccuaaauugccuauggcccuuccaacccuuucucaagucuuacuuuuaggaaagaaccucaccuggggauguagcaggugcauaacauucacaaggcccaggauuuaauccugccugugccacauuagggaaggggcaggggggugagguucaauugauaggaugcggcuccgacauacacaaaggccuggauuccauccauaguacugcauaaaccaaccaggguguugcugcaugaauguaauuccagcacuuaggaagcagaggcugagaaucaagccaacacugaguugacggccugccaggagacaagagccucugcuucaaaacaaacugcagccuggcuccccuuacauucucagaucacaccuucuaaaucccagauaacagcaaagauuaccucuuccuucucccucaacuguccuagugccccaggacuuuuccccaacaaaggagaguuuggacagaaauggcuuccugacaccaguaucuuucccacccucagaacuuuugauccccuggcuggagacccuguacgcagagaagaccuggagccugacaaagcugacacagccacaguggugacugaggagguagggacaggaucagggugcuccaugcccacuugcuugcuguuuugcucccuccugaugcugucucucauccucuuacccuagaacagugaagccaguaguuggcgggaucucuccccagaagguccugcaccccucacagguaggggagggugucagacaagagugggggaguaagauuguuucuucauugagacaucucagaucuuguucugugccagaugcaggggacagggcagagcccacaguggauccacgcccuauccuaaaggauuccccagucuuaguagagaauuuguaaaucaucaucaugauuccaaagggagcuuuagggagccaugaaguauggaacagaagccauggguccggucuuggguuucagggaaggcuuccacgggggagggggaagcugggcucaaggauuucccuauuuaucccagaggaagaacuggauuugcgacucauucggaccaagggugguguagaugcugcccuggaguaugcuaaagcauggagccgcuaugccaaggaacugcuggccuggacagacaagagagccaacuacggugaggcuuccuucugcccggccccugauggcagcaggacccaaaccccagcugcuuguagaccacugucucuccuccuccuagagcucgaguuugcuaagaguaucaugaagcucgcugaggcuggcaagguguccauucuccagcagguagguaccagcccucuccagccugaccccccacuccccagauccuccaccccccccccaauccggucaguuccugagcuagccccgcauuccgccccagagccaaaugccacuccaguacaucuacaccuuguuucuggagcaugaccucagccugggagcccuggcccuggagacaguggcccaacagaagagagacuacuaccagguaagcccucccgugucgcccgggagguagccccucuguagucugacuugggaggaagcuggagcccagagaugcucaggaucuuauccaauguuccuucacugagauucaacccgcauucugugaggcugcaacacacacagaauagugcuuucauuugagagggcaucagggaggauugguuucagggagagcagauaacucagaagguaaaagaucuuauggccggucuuugcgguuuuguggguucuucuuuuucccacccuuuacucccagcacccucacgccccacccccauuuguucccccuaacacaaguuaggaagaaagaaggagagaggggaaagagagaucccuaagucuaauuucuuuccuuuuguuucuucuuugagcacaacuccuaacaaaccacaaccccccaccacagaaugaccaauagccacagaccccaccuuuuggggugcuagcaucuaaauaccaucugaaaaguuuccagaauuccaaacauccgacagccacugaaacuaucugcagcuggcaagaccaugccucugcuugagcacgaggcaaaucacagucagcugcuggggacagccugaagcagccccguccucucacaccuggggugaaaaggaaaacacauucuuguaaugguucuguguuuuuuaaagaaaccaggacuccagaauucucacucuaggugcuugcugcacgagucugaagacccgaguucaaucccugaaacccacauaaagauagaaggagagcugggaugcccucuuuggauguaucugaagacagcuacaguguaccuacauauaauaaauaaaucuuuaaaaaagaagaagaagaaguagaaggagagcuccaacuucaaaaugccauccucugcccuucacaugcaaaucacggcaugcugccucuguacacacaucguauuaacaaauaaauaaauagaucucuuuaaaggaaggcuggaaauagcgcacaguaguagaauacuuagcuagcaaggccagggauucaaauccccaguaacaaaaaagaaagaaagaaagaaagaaagaaagaaagaaagaaagaaagaaagaaagaaagaaagaaagaaagaaagaaagaaagaaagaaagaaagaaagaaagaaagaaagaaagaaaaaaagaagaacccaucaagguagcucacccggugaaggugcuuguccccaagcuuggugaccuaaguuugauccuuggaccccacauggaggaaggcgauaacugacucccacaugucuucuguccuccacaaacaugccacacauacacaaacacaaaagagagaaauaaaaacaggaagcuagugagacucagugguaagagcacacacuacucuugcagaggaccuggguuuggguccuaccacccaugacuggcaguccacaaccaccuguaacuccagcucaugaugcuucuauagguacccacacucaugugcauagacacaauuuaagauaauaaaacauuuuuuuuucuuuuuucuuuucuuucuuuuuuuuccaagacaggguuucucugcguagcccuggcuguccuggaacucacucuguagaccaggcuggccucgaacucaaaaauccgccugccucugccucccaagugcugggauuaaaggugugugccaccacugcccagcgauaauaaaaauuuuuaauugaaaaaguacaccaauagaaucgucaggauggguguuucucaagaauaaaaccucaggaugucuggguuccugaagaaaagaugggaugaucgaucgaucacguaacuuucugcucauguacuuggaccuaggguaaaaaaggccugguuagaaaaaagaaaaaaacaaaccucaacagauugagacaaggguucgggucuaagggggucaggcaggaaacagcagauggggcuccugaagcugcuuucccuccccguccaugacaauccuccacuccacagccucuggcggccaaaaggauggaaauugagaaguggaggaaggaauucaaggaacaguggcugaaggagcagaagcgcaugguaaggccaggcgugggugggcccugcccggaagaacagaguccucugcaggccaacggcuuaugguccucuugcugccuccaagaaugaggcagugcaggcacugcggcgcuccgagcuccaguacauucaacgcagagaggaccugagggcacgcucccagggguccccugaggacccuccuucccaggcaucuccuggauccaacaagcaacaggagcgcagacggcgcucccgagaggaggcacaggccaaggucggaaacacaguaccgagauucccuaacgucuagucgcucaccucucucuaacucccaaccacuuaagccuugguuuccccaggcgcaugaggcggaggcucuguaccaggccuguguccgggaggccaauucucgccagcaggaucuggagaccaccaagcggcggauagugucacaugugcgcaagcuggugcugcaaggagacgaagugcuuaggcggguaaggcccuccuccacagucacccuuguuucauuguccuuaggcaccagcccugagcccccaggacaccaucuuuacuguaggccccauacccugaugacaacccaaaccuaguccuacagccuaccagugacaggccccgcccucagacauuggcuuugcucuguaaggguuaggccacagcccccuggaaucuaggucaaauauucauccuugcaggugacgcugggucuguuugagcugcgaggggcgcaggcagagcgaggaccccgcuccuucucugcucuggcugagugcugugugcccuuugaaccuggccagcgcuaccaggaguuuguucggacacugcagccuggggccccaccgccgccaucuccggccuucugcuuccaggaguucacagcuguggugcacaggugugcccuagggcugggcuuggaguuuuaguacauacuguaccucaccuccguuacccucucuuguccugcucccaccccagaugagccccuuacuuuucuaacuagucuccauugacuucaauguuuuggagauguuugcuuauucguuuaugagacaggguuucucuggguagcccuggcugaccuggaacucgaucuguagaccaggcuggccucaagcucagagagauccuccugccucugccucccaagugggaucaaaggagugcaccuugacugccugacccugggauacauuugaaacaggguaucucuagguaacccuggcuguccuagaacucacuuagugucuuuuuauuuaaagaauuauuuuuauugacaagugugugugugugugugugugugugugugugugugugugugugugugugugugugugcagguacucucagaggccagaagagggcgucagaugcugugggauaagcaguugugaaccaccgauguggauccugggaacugaauguggguccuggaagagcagccaagagcucauaaccacugagucaccucuccagucccucauguguuuguuuguuuguuugcuuuuaaauggcucaauggcuuucauuagggguacuuacaggaucaugguagacuuuucaugaguuauccccaguccuaggaucuggggcuaggacacuuaagggaccaagaugguccuggacuccagagcuuucaguccuguauccuuagagucggaacccagacgccaugcacacuugcugucguccaggccaguuucuggggaucaagcccucaauccucucuucucccaguuucccucaggacacaaaaaagaaguuuucggggccucuaccuccaaggcuggaggaggaggguuccccugagccuggcccuugggagguugccagcuuaggcagccaggguaaguucucugaggccuguggguaaagggccugggcuugggccagccugauugaccuguccucacgcaggaaucccaggcagugauguggacaguguaggugguggcagugagucccggucuuuggauucucccacuuccagcccaggugagggcaggaccugacccgcccacccacauacacaccugugcccuuucaccucccacucucuguccuccugcuuguagccaagcacugaccuuuaaucuccaaccuacuucuuggccugaucuaccacacacccugauccucaaguguagauguacucacugucuuggugggaauuuccucuaaaccaccagacaaaggccugacccauuccuaaacucuuaaccucugguccccgacccuuucucccaaggauaucucugggaguuuuugaaagcccugaaaaccaaaucugccuccuuagaccuagccugucccaugaccgccauaauccuaccuuugugcuccucugaccgcaggugcuggggcccgccgacuuguaaaggcuucguccacaggcacggaguccuccgaugacuuugaggagcgagacccugguaaggcuggacaugggugggcaggugggcuuacagggacaagauggugacccugacagccuugaccucucuccuugcagaucugggggaugggauagagaauggaguaggcagcccguucaggaaguggacacuguccacagcugcucaaacccaccgacugcggcggcugcggggcccagccaagugcagagaaugugaagccuucauggucagcgggacagaaugugaagagguguggccuagacuggggaccuaaugaccuuggcugacucucucccucccucccucccucccucccuuccucccucccucccucagucucaguguucauuugugugugucuguggcagaggcagggugugcauuagugucaugcugugagugaguguuagaggagaguuuaaaggagccauuucucuucuuccuccaugugagcccugggagucaaacccaggucaucagguuuggcagcaagcaccuuuaccugccgaaccaucucuuuggucucuuaagcauccucuauucccuggcuuucuugcugaccuccugauaaccuuccugucuccagcugaccuccuaacccugugaccuccccccuccuccagugcuuuuugaccugucacaagcgcugccuggagacccuccucauccuuuguggacaccggcggcuuccggcccggaugucccucuuugggguugacuuccuacagcuccccagagauuucccugaggagguucccuuugugauuaccagaugcacagcugagauagagcaccgugcccugggcuugcagguaggugacauccucaucaguccccacaaguccccacugauggccaggucacaagccagguaucccuuacccugcaggguaucuaucgggucagcgggucucggguacguguggagcggcugugccaggccuuugagaauggccgagcacuggucgagcuguccgggaacucuccucacgauaucaccagcguucucaagcgauuucuucaggagguaggugguuccaggccagagguggugggcagggccauaccaccucugguugaggacccucagcagcccacccacacuccuguccccaccagcucacugaucccgugguccccuuccacuuguacgacgccuucaucucucuggcaaagacccugcaugcagacccuggggacgacccugggacccccaaccccagcccugagauuauucgcucgcugaagacccucuuggugcagcugccugacucuaacuacaguacccugcgacaccugguggcccaucuguucaggugugcaugggucccuaagcuuggaacuguggcccucuuucccugaacauguaacugcuuaccugugugguucauauuaaccuuugaccuuucauauuucuucugaacucugaacuguggaugcccacaccuaacuuuaacacuguccauguaacuagcugguuucaagccgugaccagagacuuuuuuugcuguggccuggcuaagucaccagccuagcuuacagguccuccacuuguccuccacugaugccuccgauuccaugccugacucuucucccuacacauccucaggguggcugcucgguuugaagaaaacaagaugucugccaacaaucugggaauuguauuugggccuacacugcugcggccaccagauggacccagggccaccggugccagcccuguggccugucugcuggacuccggucaccaggcucagcugguugaguuccucauugugcacuaugagcagaucuuuggaauggaugagcucccucuggccucggagccucugacccaagacccuggcuuggcuccugcaugccuugaauccaguccccagcacccagccucacuucuugcccaagacacacagccccugaccauagccuuggauuccagcccagaccccaaacaccacagugccuuggagaagugccccgaggucacaccuccugagguaggaaucagcuugcccugcagauguggggagggcccugucuguguuuaauucuccuucuuuugcacaacuggauauugacuccagggcuuggugugcauuaggcaugugcucagcucuauguuacacccccagcgcucucuuuaaguuucuuuuggauuuuuaagaaacauucauuuagagaguaugcaggcacacgcaugucccguugugagugugaaggccagauggcaaccuguccuuuuacccccuggauccuagggaccgaauucagguccuuagacuuaguaccucuagccccugagccagacuagauuucuuuuauugcaucuuaauuuauuuauuuauugugcaugggaggggaguaucaugugauggucagagacaacuugugagaguaguuuuccuucugcccuguaggcccugggaaugauuugccaagcuuggugggagaugccuuuaccuauccagccuuuuuuuuuuuguaauguauauugguguuuugucucauguaucucugaggguaucagauccccuggaacuggaguuauaguuuuugagcugccaugugggagcuggguaucgaacccgggucuucugaaagagcagccaguguucuuagccauugaccauuucuacagccccaacuuacugccuuacuugacuguuuauucuguuuuguuuuuguuuuuuaguuuugguuuuucgagacaggguuucucuguguagcccuggcuguccuggaacucacucuguagaccaggcuggccucgaacucaaaaaucugccugccucugccucccgagugcugggauuaaaggccugcgccaccaccgcccagcuguucuguuguuuuaucugacuuugagauauggucuuucucugugaucuuccugccuuagugcuuugaaugcuaggauugcaguuaggugugcaccuccuuucugaucgucucccuuucucuucaacauuucuuuguuaggcuacgcauggugaugacuuuaaucccagcacuugggagacagaggcagguagaucucugggaguguaaagccugccuggucuacagagugaguuccagggugcagagaaacccugucuugaaaaaccaacgagagagagagagagagagagagagagagagagagagagagagagagagaaagagagagagcgagagauguauuuucuuagugugugggaauacaugggugcuaugacauuauagaggucagaggacagucugcugagucuccugagggcuucccaucuugccauagaagagcugacauuauggguauuuaccccccaaacucuagggcuuuuuaacuuauuuauuuagugggaggaggcacacaggcauagguguggaggucagaagacaacuugcaggaaucaguucucucagucccccguacagucuggagaucaaauugauauugccaaguucaguggcaguuacuuuuacccacuuagccauuuaaaugaguuuauaauaaacagcugggccagcucagcacccauuguuagaaguaucaaguaccaggccuugcagguacaugagugagcuagauagauguucaaagaccccucccucuuuuggugucugaauccaagagaaagaagaccaaaaaucaucaugaaauugggcacaugcaacauucugagguccugugaagaaaggaagauggaguaagggcugcccauggugaggaccagagggguuugcagcagaaaauauaauaugggcaagucuuuugggacaggugaauuugagcaaagaguggcaugacaugggggcaaaaugaggcauggucaaaucugggaaaagcuguaccaggcaguagaacagcccagugcaaagccccuggggugggagccaucuccaguccuauguuauacugccuggguaagagaagcaggaaggaaucagagccagucugcaaaugagucucuguggcaacgugcucaucagucuaugagaggcucuggguuugcuucucagcaccaggaaagaagggauggcucugcuaguccccgugagcacaaggggagcagcaaaugaccacuggcuauaugcagacagugcauugagauaggaucacucauugaacuugaagcugaacuggcaugccaaagagcucccaggaccccuguccccaccccacaauacagaaguuacaagcacccagccaugcuuggcauuuaaacuuggguucucaugcuuccacagugaauccucuuaauuuaccgaucuuuucuccagaaaucccuaaacagggacuuugcuauugggagucacguucuggguuucuuccugcagcuugcaacucugcagagggaccagagggaggaggagguggaagacaccagagauggggcaggggauggugagugucuagagagcccucacuucgccccaggguugcuuggcugggaguacauccaaagaacuuggagaugcugagcacuuaaccgcuccacaggguccagccacugcccugaggacuuggcccugggagcacaaucccggggccacuucagccgccagccagugaaguauucccggggaggugugaggccaguuacucaucaacucuccagccuggcucugguggccuccaagcugugugaggagacuccugucacugucucagcagugcaccgagguaguuugaggguacgagguuugggcccugcugcugccugcccugaaggcagcccccugcgccggaacccucugcccaagcacuuugagaucacccaggagacagcccgacuucucuccaagcugaacagugaugcuguguccaggaccaccuguugugcugacccagagccugaggagucugaagagcaccucugaccaccuaccauccugagggacccagaacugaauugauggucccugacccaaccuggugaccaaaccaauucagugggguguggggagagacgggguuaccagugaguuccgguaaugaagauuaccuaccugugggagucccaagacacuugguugaagugucccaucaucucccugccagaggagauuuaaacagcuaggcaacacaggugcagguguuucggggucaagacucaauggucaauacagaucaguagauccuuggggacuacccgagucucugaccucugagacgggugucuugacuauuucagucauaauggcuccuggcccuacuacacuugcagcaguaacagacucccaaguuagcagguggcugcagcccagcccugucuccuuuuaauuuguuuguuuguuuguuuguuuuaagcuaagucucacuguguagcucuggcuggucuggagcucccuuugugagccacaaauccucugccucccaagugcuggcuaaaucuguguucuuacaaccuccaaauaaaaccauauccugcugccggcaggagggcugaccgcaguggugcuugcuguaaagccucacauuuguuggaccucccagagccacuuaguggaaggagagagcccaucccuacaaauugucugaccugugcacaugcacaaauaaaagaaaauuuuaauuuaaaaaaaaaaauccgcugggcgguagugccacacaccucuacuugauccuagcacucaggagauagaggcaggaggaucucugaguuuuaugccagccagguguacagagaaaguuccaggacagccagggcuacacagagaaacccuguuucagaaaaacaaaauaaaauaagauaaaucuugucuguucuugcac

SEQ ID NO: 4472 - RNA, 13194 nt, Mus musculus
gugcaagaacagacaagauuuaucuuauuuuauuuuguuuuucugaaacaggguuucucuguguagcccuggcuguccuggaacuuucucuguacaccuggcuggcauaaaacucagagauccuccugccucuaucuccugagugcuaggaucaaguagagguguguggcacuaccgcccagcggauuuuuuuuuuuaaauuaaaauuuucuuuuauuugugcaugugcacaggucagacaauuuguagggaugggcucucuccuuccacuaaguggcucugggagguccaacaaaugugaggcuuuacagcaagcaccacugcggucagcccuccugccggcagcaggauaugguuuuauuuggagguuguaagaacacagauuuagccagcacuugggaggcagaggauuuguggcucacaaagggagcuccagaccagccagagcuacacagugagacuuagcuuaaaacaaacaaacaaacaaacaaauuaaaaggagacagggcugggcugcagccaccugcuaacuugggagucuguuacugcugcaaguguaguagggccaggagccauuaugacugaaauagucaagacacccgucucagaggucagagacucggguaguccccaaggaucuacugaucuguauugaccauugagucuugaccccgaaacaccugcaccuguguugccuagcuguuuaaaucuccucuggcagggagaugaugggacacuucaaccaagugucuugggacucccacagguagguaaucuucauuaccggaacucacugguaaccccgucucuccccacaccccacugaauugguuuggucaccagguugggucagggaccaucaauucaguucugggucccucaggaugguagguggucagaggugcucuucagacuccucaggcucugggucagcacaacaggugguccuggacacagcaucacuguucagcuuggagagaagucgggcugucuccugggugaucucaaagugcuugggcagaggguuccggcgcagggggcugccuucagggcaggcagcagcagggcccaaaccucguacccucaaacuaccucggugcacugcugagacagugacaggagucuccucacacagcuuggaggccaccagagccaggcuggagaguugaugaguaacuggccucacaccuccccgggaauacuucacuggcuggcggcugaaguggccccgggauugugcucccagggccaaguccucagggcaguggcuggacccuguggagcgguuaagugcucagcaucuccaaguucuuuggauguacucccagccaagcaacccuggggcgaagugagggcucucuagacacucaccauccccugccccaucucuggugucuuccaccuccuccucccucuggucccucugcagaguugcaagcugcaggaagaaacccagaacgugacucccaauagcaaagucccuguuuagggauuucuggagaaaagaucgguaaauuaagaggauucacuguggaagcaugagaacccaaguuuaaaugccaagcauggcugggugcuuguaacuucuguauugugggguggggacagggguccugggagcucuuuggcaugccaguucagcuucaaguucaaugagugauccuaucucaaugcacugucugcauauagccaguggucauuugcugcuccccuugugcucacggggacuagcagagccaucccuucuuuccuggugcugagaagcaaacccagagccucucauagacugaugagcacguugccacagagacucauuugcagacuggcucugauuccuuccugcuucucuuacccaggcaguauaacauaggacuggagauggcucccaccccaggggcuuugcacugggcuguucuacugccugguacagcuuuucccagauuugaccaugccucauuuugcccccaugucaugccacucuuugcucaaauucaccugucccaaaagacuugcccauauuauauuuucugcugcaaaccccucugguccucaccaugggcagcccuuacuccaucuuccuuucuucacaggaccucagaauguugcaugugcccaauuucaugaugauuuuuggucuucuuucucuuggauucagacaccaaaagagggaggggucuuugaacaucuaucuagcucacucauguaccugcaaggccugguacuugauacuucuaacaaugggugcugagcuggcccagcuguuuauuauaaacucauuuaaauggcuaaguggguaaaaguaacugccacugaacuuggcaauaucaauuugaucuccagacuguacgggggacugagagaacugauuccugcaaguugucuucugaccuccacaccuaugccugugugccuccucccacuaaauaaauaaguuaaaaagcccuagaguuugggggguaaauacccauaaugucagcucuucuauggcaagaugggaagcccucaggagacucagcagacuguccucugaccucuauaaugucauagcacccauguauucccacacacuaagaaaauacaucucucgcucucucucuuucucucucucucucucucucucucucucucucucucucucucucucucucguugguuuuucaagacaggguuucucugcacccuggaacucacucuguagaccaggcaggcuuuacacucccagagaucuaccugccucugucucccaagugcugggauuaaagucaucaccaugcguagccuaacaaagaaauguugaagagaaagggagacgaucagaaaggaggugcacaccuaacugcaauccuagcauucaaagcacuaaggcaggaagaucacagagaaagaccauaucucaaagucagauaaaacaacagaacagcugggcggugguggcgcaggccuuuaaucccagcacucgggaggcagaggcaggcagauuuuugaguucgaggccagccuggucuacagagugaguuccaggacagccagggcuacacagagaaacccugucucgaaaaaccaaaacuaaaaaacaaaaacaaaacagaauaaacagucaaguaaggcaguaaguuggggcuguagaaauggucaauggcuaagaacacuggcugcucuuucagaagacccggguucgauacccagcucccacauggcagcucaaaaacuauaacuccaguuccaggggaucugauacccucagagauacaugagacaaaacaccaauauacauuacaaaaaaaaaaaggcuggauagguaaaggcaucucccaccaagcuuggcaaaucauucccagggccuacagggcagaaggaaaacuacucucacaaguugucucugaccaucacaugauacuccccucccaugcacaauaaauaaauaaauuaagaugcaauaaaagaaaucuagucuggcucaggggcuagagguacuaagucuaaggaccugaauucggucccuaggauccaggggguaaaaggacagguugccaucuggccuucacacucacaacgggacaugcgugugccugcauacucucuaaaugaauguuucuuaaaaauccaaaagaaacuuaaagagagcgcuggggguguaacauagagcugagcacaugccuaaugcacaccaagcccuggagucaauauccaguugugcaaaagaaggagaauuaaacacagacagggcccuccccacaucugcagggcaagcugauuccuaccucaggaggugugaccucggggcacuucuccaaggcacugugguguuuggggucugggcuggaauccaaggcuauggucaggggcugugugucuugggcaagaagugaggcugggugcuggggacuggauucaaggcaugcaggagccaagccagggucuugggucagaggcuccgaggccagagggagcucauccauuccaaagaucugcucauagugcacaaugaggaacucaaccagcugagccuggugaccggaguccagcagacaggccacagggcuggcaccgguggcccuggguccaucugguggccgcagcaguguaggcccaaauacaauucccagauuguuggcagacaucuuguuuucuucaaaccgagcagccacccugaggauguguagggagaagagucaggcauggaaucggaggcaucaguggaggacaaguggaggaccuguaagcuaggcuggugacuuagccaggccacagcaaaaaaagucucuggucacggcuugaaaccagcuaguuacauggacaguguuaaaguuaggugugggcauccacaguucagaguucagaagaaauaugaaaggucaaagguuaauaugaaccacacagguaagcaguuacauguucagggaaagagggccacaguuccaagcuuagggacccaugcacaccugaacagaugggccaccaggugucgcaggguacuguaguuagagucaggcagcugcaccaagagggucuucagcgagcgaauaaucucagggcugggguugggggucccagggucguccccagggucugcaugcagggucuuugccagagagaugaaggcgucguacaaguggaaggggaccacgggaucagugagcugguggggacaggagugugggugggcugcugaggguccucaaccagaggugguauggcccugcccaccaccucuggccuggaaccaccuaccuccugaagaaaucgcuugagaacgcuggugauaucgugaggagaguucccggacagcucgaccagugcucggccauucucaaaggccuggcacagccgcuccacacguacccgagacccgcugacccgauagauacccugcaggguaagggauaccuggcuugugaccuggccaucaguggggacuuguggggacugaugaggaugucaccuaccugcaagcccagggcacggugcucuaucucagcugugcaucugguaaucacaaagggaaccuccucagggaaaucucuggggagcuguaggaagucaaccccaaagagggacauccgggccggaagccgccgguguccacaaaggaugaggagggucuccaggcagcgcuugugacaggucaaaaagcacuggaggaggggggaggucacaggguuaggaggucagcuggagacaggaagguuaucaggaggucagcaagaaagccagggaauagaggaugcuuaagagaccaaagagaugguucggcagguaaaggugcuugcugccaaaccugaugaccuggguuugacucccagggcucacauggaggaagaagagaaauggcuccuuuaaacucuccucuaacacucacucacagcaugacacuaaugcacacccugccucugccacagacacacacaaaugaacacugagacugagggagggagggaggaagggagggagggagggagggagggagagagucagccaaggucauuagguccccagucuaggccacaccucuucacauucugucccgcugaccaugaaggcuucacauucucugcacuuggcugggccccgcagccgccgcagucgguggguuugagcagcuguggacaguguccacuuccugaacgggcugccuacuccauucucuaucccaucccccagaucugcaaggagagaggucaaggcugucagggucaccaucuugucccuguaagcccaccugcccacccauguccagccuuaccagggucucgcuccucaaagucaucggaggacuccgugccuguggacgaagccuuuacaagucggcgggccccagcaccugcggucagaggagcacaaagguaggauuauggcggucaugggacaggcuaggucuaaggaggcagauuugguuuucagggcuuucaaaaacucccagagauauccuugggagaaagggucggggaccagagguuaagaguuuaggaaugggucaggccuuugucuggugguuuagaggaaauucccaccaagacagugaguacaucuacacuugaggaucagggugugugguagaucaggccaagaaguagguuggagauuaaaggucagugcuuggcuacaagcaggaggacagagagugggaggugaaagggcacagguguguaugugggugggcgggucagguccugcccucaccugggcuggaagugggagaauccaaagaccgggacucacugccaccaccuacacuguccacaucacugccugggauuccugcgugaggacaggucaaucaggcuggcccaagcccaggcccuuuacccacaggccucagagaacuuacccuggcugccuaagcuggcaaccucccaagggccaggcucaggggaacccuccuccuccagccuuggagguagaggccccgaaaacuucuuuuuuguguccugagggaaacugggagaagagaggauugagggcuugauccccagaaacuggccuggacgacagcaagugugcauggcgucuggguuccgacucuaaggauacaggacugaaagcucuggaguccaggaccaucuuggucccuuaaguguccuagccccagauccuaggacuggggauaacucaugaaaagucuaccaugauccuguaaguaccccuaaugaaagccauugagccauuuaaaagcaaacaaacaaacaaacacaugagggacuggagaggugacucagugguuaugagcucuuggcugcucuuccaggacccacauucaguucccaggauccacaucggugguucacaacugcuuaucccacagcaucugacgcccucuucuggccucugagaguaccugcacacacacacacacacacacacacacacacacacacacacacacacacacacacacuugucaauaaaaauaauucuuuaaauaaaaagacacuaagugaguucuaggacagccaggguuaccuagagauacccuguuucaaauguaucccagggucaggcagucaaggugcacuccuuugaucccacuugggaggcagaggcaggaggaucucucugagcuugaggccagccuggucuacagaucgaguuccaggucagccagggcuacccagagaaacccugucucauaaacgaauaagcaaacaucuccaaaacauugaagucaauggagacuaguuagaaaaguaaggggcucaucuggggugggagcaggacaagagaggguaacggaggugagguacaguauguacuaaaacuccaagcccagcccuagggcacaccugugcaccacagcugugaacuccuggaagcagaaggccggagauggcggcgguggggccccaggcugcaguguccgaacaaacuccugguagcgcuggccagguucaaagggcacacagcacucagccagagcagagaaggagcgggguccucgcucugccugcgccccucgcagcucaaacagacccagcgucaccugcaaggaugaauauuugaccuagauuccagggggcuguggccuaacccuuacagagcaaagccaaugucugagggcggggccugucacugguaggcuguaggacuagguuuggguugucaucaggguauggggccuacaguaaagaugguguccugggggcucagggcuggugccuaaggacaaugaaacaagggugacuguggaggagggccuuacccgccuaagcacuucgucuccuugcagcaccagcuugcgcacaugugacacuauccgccgcuugguggucuccagauccugcuggcgagaauuggccucccggacacaggccugguacagagccuccgccucaugcgccuggggaaaccaaggcuuaagugguugggaguuagagagaggugagcgacuagacguuagggaaucucgguacuguguuuccgaccuuggccugugccuccucucgggagcgccgucugcgcuccuguugcuuguuggauccaggagaugccugggaaggaggguccucaggggaccccugggagcgugcccucagguccucucugcguugaauguacuggagcucggagcgccgcagugccugcacugccucauucuuggaggcagcaagaggaccauaagccguuggccugcagaggacucuguucuuccgggcagggcccacccacgccuggccuuaccaugcgcuucugcuccuucagccacuguuccuugaauuccuuccuccacuucucaauuuccauccuuuuggccgccagaggcuguggaguggaggauugucauggacggggagggaaagcagcuucaggagccccaucugcuguuuccugccugacccccuuagacccgaacccuugucucaaucuguugagguuuguuuuuuucuuuuuucuaaccaggccuuuuuuacccuagguccaaguacaugagcagaaaguuacgugaucgaucgaucaucccaucuuuucuucaggaacccagacauccugagguuuuauucuugagaaacacccauccugacgauucuauugguguacuuuuucaauuaaaaauuuuuauuaucgcugggcagugguggcacacaccuuuaaucccagcacuugggaggcagaggcaggcggauuuuugaguucgaggccagccuggucuacagagugaguuccaggacagccagggcuacgcagagaaacccugucuuggaaaaaaaagaaagaaaagaaaaaagaaaaaaaaauguuuuauuaucuuaaauugugucuaugcacaugaguguggguaccuauagaagcaucaugagcuggaguuacaggugguuguggacugccagucaugggugguaggacccaaacccagguccucugcaagaguagugugugcucuuaccacugagucucacuagcuuccuguuuuuauuucucucuuuuguguuuguguauguguggcauguuuguggaggacagaagacaugugggagucaguuaucgccuuccuccaugugggguccaaggaucaaacuuaggucaccaagcuuggggacaagcaccuucaccgggugagcuaccuugauggguucuucuuuuuuucuuucuuucuuucuuucuuucuuucuuucuuucuuucuuucuuucuuucuuucuuucuuucuuucuuucuuucuuucuuucuuucuuucuuucuuucuuucuuucuuucuuuuuuguuacuggggauuugaaucccuggccuugcuagcuaaguauucuacuacugugcgcuauuuccagccuuccuuuaaagagaucuauuuauuuauuuguuaauacgauguguguacagaggcagcaugccgugauuugcaugugaagggcagaggauggcauuuugaaguuggagcucuccuucuacuucuucuucuucuuuuuuaaagauuuauuuauuauauguagguacacuguagcugucuucagauacauccaaagagggcaucccagcucuccuucuaucuuuauguggguuucagggauugaacucgggucuucagacucgugcagcaagcaccuagagugagaauucuggaguccugguuucuuuaaaaaacacagaaccauuacaagaauguguuuuccuuuucaccccaggugugagaggacggggcugcuucaggcuguccccagcagcugacugugauuugccucgugcucaagcagaggcauggucuugccagcugcagauaguuucaguggcugucggauguuuggaauucuggaaacuuuucagaugguauuuagaugcuagcaccccaaaagguggggucuguggcuauuggucauucuguggugggggguugugguuuguuaggaguugugcucaaagaagaaacaaaaggaaagaaauuagacuuagggaucucucuuuccccucucuccuucuuucuuccuaacuuguguuagggggaacaaauggggguggggcgugagggugcugggaguaaagggugggaaaaagaagaacccacaaaaccgcaaagaccggccauaagaucuuuuaccuucugaguuaucugcucucccugaaaccaauccucccugaugcccucucaaaugaaagcacuauucuguguguguugcagccucacagaaugcggguugaaucucagugaaggaacauuggauaagauccugagcaucucugggcuccagcuuccucccaagucagacuacagaggggcuaccucccgggcgacacgggagggcuuaccugguaguagucucucuucuguugggccacugucuccagggccagggcucccaggcugaggucaugcuccagaaacaagguguagauguacuggaguggcauuuggcucuggggcggaaugcggggcuagcucaggaacugaccggauugggggggggguggaggaucuggggaguggggggucaggcuggagagggcugguaccuaccugcuggagaauggacaccuugccagccucagcgagcuucaugauacucuuagcaaacucgagcucuaggaggaggagagacaguggucuacaagcagcugggguuuggguccugcugccaucaggggccgggcagaaggaagccucaccguaguuggcucucuugucuguccaggccagcaguuccuuggcauagcggcuccaugcuuuagcauacuccagggcagcaucuacaccacccuugguccgaaugagucgcaaauccaguucuuccucugggauaaauagggaaauccuugagcccagcuucccccucccccguggaagccuucccugaaacccaagaccggacccauggcuucuguuccauacuucauggcucccuaaagcucccuuuggaaucaugaugaugauuuacaaauucucuacuaagacuggggaauccuuuaggauagggcguggauccacugugggcucugcccuguccccugcaucuggcacagaacaagaucugagaugucucaaugaagaaacaaucuuacucccccacucuugucugacacccuccccuaccugugaggggugcaggaccuucuggggagagaucccgccaacuacuggcuucacuguucuaggguaagaggaugagagacagcaucaggagggagcaaaacagcaagcaagugggcauggagcacccugauccugucccuaccuccucagucaccacuguggcugugucagcuuugucaggcuccaggucuucucugcguacagggucuccagccaggggaucaaaaguucugagggugggaaagauacuggugucaggaagccauuucuguccaaacucuccuuuguuggggaaaaguccuggggcacuaggacaguugagggagaaggaagagguaaucuuugcuguuaucugggauuuagaaggugugaucugagaauguaaggggagccaggcugcaguuuguuuugaagcagaggcucuugucuccuggcaggccgucaacucaguguuggcuugauucucagccucugcuuccuaagugcuggaauuacauucaugcagcaacacccugguugguuuaugcaguacuauggauggaauccaggccuuuguguaugucggagccgcauccuaucaauugaaccucaccccccugccccuucccuaauguggcacaggcaggauuaaauccugggccuugugaauguuaugcaccugcuacauccccaggugagguucuuuccuaaaaguaagacuugagaaaggguuggaagggccauaggcaauuuaggggcuuacggaauugacacucauagcugcuucuaccauuuuuaaaggaaucaugaaguugcaugugugugucucaggaucaucugucuuuaagauagacccccaaauaccuauguaucuagaauaccagagggcccaguuguuuggaggggggggcuccugucuuaggcucaggagguuggaagucagggugucuggauguggggcagcaugauacccaaauaauuagggagcucugcccaauguggugacacaggcucagacucacacguuccccaaugauaucucgagguuguccaggcucuggaagaugucacuguaucucuuccugcccucaggagcugggguuagcucugggggagggaaguguaagaaaacaugagccaaccagugucucucuccacccauuaguaguggcaaagcaauccgaauguaccucaacaaccacucucaagcagaggugggaaggggggcgggcggagaggggagagaaggaggggggagggagggggacagagagagagagagagagagagagagagagagagagagagagagagagagagagagagagagagagagagagagagagagagagagagagagagagagagagcgcuucgguggggucauuucugauuccacagauggauccagguaaaaucucagagaagcguuugcucacagccacagggacaccaugcaugggaggacccauaagcaaaggaaggaaacagaugcagcugccauaugaaugcuggaguagagggcuggcuugacaauggagccacauggaccccaggccagacagauggaaaagcacgugggacacacaggcacuuagccugcgguauaaacacacgcgaguaccgcugaaaccacgagggacaggacugaaugacacucgauacacaaagacagccggaaacauaacccaguucuagccacaauucugccgccgcccccuagccugaugccucggggcuaccugcaggaauauuggccaugacacccugcccccauccauccuacgaucagaagcagaagcggccacuuccccuuccugggccccuucccccaggcauccggggugcccgcucuggcgggcaauccgagggcugaaggcuggcgucgugagcacugugcgcuucaggggucuccaaggugcucggggauccccucguuccuuccccugucaguacuccuuucccggcugucagauagcucagggguaaguuggguuuucugguuuaggaacugaggagcgguggugggaggcccccccccuucgguccccaccccguaccugucuccgcugaguccauggcgaugcccgggggcagggggugggguggggaacgcgcggcaaugcugagaaagggacagggcugcgcgccgcccgggaccagcccgauuuccugccucugccgacccaguggugucgccccg

SEQ ID NO: 4473 - RNA, 1440 nt, Mus musculus
uagguuuugaaaaaacuaagccuacacaguguucuguguggucuggcuguccugaaaccagacuggccuggaacucagaaauccaccugcuuuugccucuucagccaugggauuaaagguauauggcaacaaguuuaaaaagaaaaaggaaaucuugaaggacauggaaaucuugaaggacaugcgaagggaaaggaaccuguuacucuggaaucugauugaacccuuuuccuaguagacaagcaagaauuccaguccaauuacuaugagcuuaccccuuccuuccuucccaguuacaaucuggaauuuccccagaaucucauuuacagggaaugggcauguauauguacuguuuuauacucccauucaacguuucugcagagccaccucacuaucucgagaaggagccuguaagagcuugguggaucaaaguacuuacaacaccaccccccugaauucagucccucugacccacaaggugcaggaaggagacugauuccugcaauguguuaccugaccucugugcacuguguggcaggcacacaucaaaauaauaaugaagcugggcgugguggcgcacgccuuuaaucccagcacucuggaggcggaggcagaggcaggcagauuucugaguucgaggccagccuggucuacagaguuccaggacagccagggcuacacagagaaacccugucuccaaacaccaaaauaaaauaaaugaauagauaauaaauaaagaggguuuuuguuuguuuuuucuuuuucuucaaacagccuuaccauguaacccuggcuggccugaaacucacaaaauuucccugccuguguuuccucaauagugguguuuaaggugugugccaccaugcccagcauuaaagaucuauuuuuauuuauauguauauuugugugugugcaagcaaugccccagaaagccagaagaggcuauuaaauucccuggagauaugggcaguuguaagccaaaaaucaaguccccuggaaaggcaguaugugcccuuaacuguugaacagucucuucagcccaguacauguaacuguuuuuaagagggggguuggggggaaaauuucuuuagcaaccuuagagauguaacuugagagcugacagguaugugucaauauaugucuagugcuccacaugacccuaugcccucuucuggccucaagaggugacugcauacacauguacauacccacauagaugugcauacauauaagaauaauaauaaacuuuaaaagauuuauuuauuaccacauggucuauguagcccuagcuggcuugaacuugcucaguaugacaggcuaaccuuaacuucauaaagucccucugcuuucugccucuugaguccggggauuaaugguguaagccacuaugcccagcuuaaagauacauaucuuuaauaaaaucuacaacugugauucaua

SEQ ID NO: 4474 - RNA, 26633 nt, Mus musculus
auuuuuuuuucuuuuuaauuauuuguaaaugcucuaaguguucagguauguguagaugccagaagaggguugucagacccccagagcuggaguuacagaugggcuguuagcugccugacaagggugcugggaacugaacuugggccucuauaaacugcugacccauuucuccagcuccuguuuuauuuuuucaaaaacaagguccuguagcccaggcuagcaugaggaugacccuuaacuccugaucuuuaccucuucauugcugggaucacagauacaugccaccuugccuggcuguggggcguuuuugcuauuugggaugguagaccacucucaugagaagcuuugugugcccagccagcuuagcacaggcugacgacagacucaacuuuccagaugggacaccugcugucauaggagguaacaaccagcaaagccccaggacucaucuaccucacuugcuccaaaccccaccauccaggguuggugagguaggaccaggcuuguucugacgauagagccuucaaguugacaaaggaaggaguggacucuaccugaaaucuagcuuaagcagacucuggaaggcagagaugcccaggugugggggaugagacacauagcuggacucugaauccuuucggaaaggucagugcuuaggcacacaauggcauaccgaaggcaguggaugcuccucccuugagucuugagcacuggggucuugaauuuaggaacaccugcaguauaguucaguuugagagguguguuugcugugcacaagagcuugguuccacccccaacaaaguacaaaacuacaaacaaguggcugaagagauggcaugguggagugcuaccuacggucucagaaacuugggguugaaauguaagaauuuccuauguaagccaguggagauccagaaaccaagccacaaaaagcaaaacaaacaaacaaacccagucuaauccuacagugguagcucacacuauauaaccuugggugagauuuggggaacagcagcuacaauacaagaucagccagggauagacaguuaaagucugucaaauuuaagucaaccaccuaucaguaaaaccugucuaauuauuuuuuuuuuuguuuuuugagacaggguuucucuguauagcccuggcuguccuggaacucacucuguagaccaggcuggccuugaacucagaaauucaccugccucugccucccaagugcugggauuaaaggcgugcgccaccacgcccggcuuuuuuguuuuguuuuuuuuuuaaaccugucuaauuuuauauggauuucaccugcagucaagagucaacuaacccauggaaaagcaaagagccuucccuacccaggagcacaagggcuggaccaggcucuccuuuacuggguuauucauauuucacuguguaacccuuacuggcauguaacuugggaguguucuuagccuuccaggugugacaggugugagccaccauguccagcugguuucugcguugcaccuggguacaggagcaagcgugucuaggggcuuguaugcugaaacugcaggguauaacacccuucacagaagguccaaaccaaauauugcaucaagauaggaucacaggauaaagcuauggcucagcuggcagaaugcuaggcuagcagcaccagguaaagccagcacuauggcacaugcccaucaucccaggacuagggugguggaggcaggagaaucaagagcucaaggucauccaugaacaagagauacuaucuuaagaaacaaaagcucuaaacacugccccuuccaaucaaaaccccacagccaaaaucuaagagccaggugcuuggaggcugaggcguggcaccagugucuucaaaagaagcaaaaaacaacaaacaagcaaucaauauccagcuaaaaucaaacagaaaaaggggcuguggaccagcuuccuaccaggcugaguugaugaaggggcuaugccucugccucagggcuucagucuauaguagaggggcugcuggcaaggcuggagggagggaaaugaaaagacugggggaauagugguccuaaagggagagaccagcaaacagacuucucacagaucucagcuuacaguucccgauuaaaaggcugcuaaaaccaggcaaagccacccauguuuaugaaaacaaaccaacccucucaauagaugacaugccuuccuucacucagagugucaccuguggcuuaagggcucauauagggcuacaguuagccuggcucagggcuggcucuuaguaacuccuggguuauaauaccucuuugugcuagcccaucugggauuuccccucaaucuuuagcuguuggacacugugguggggucauguagguggaaacucaacauagacuauggaguuugucgugacccugugcuuaguuuucacaugccugagauauggacacuaaaagcacucuaacaucaggacagauggcaagucgagagguccuuguuugaauugcuguauguacaaaaugcccuagaagcaaaaaaaaaaaaaaaaagcuuaaauaaauaagcagggcugugaugcagguauugaggguaggucccugggacccaagggcuagaggaagacagaaggguugggagcaccuggccaugggcagucucugccacauggcucagaaaggauguccaugaaggucuuggagcuucgucccuucagucauggcuuccaaagcucugagaaguggucuucacauugcuuggugagcaccugccuagauaccaugagcuggcaggaaccacugugccccguacccccccauuauugucacccuuagggcagcuaucaagccaagaggagcugagcuggucccauaacuguccuccaugggaaagcuaaauagcugccaggaaggaacccucucauucagguccaaugggacuucugccugaugcuuaggcugggccaagacgugcugcugaauaugagcaaggagcuucuuaagggcacacgaagucucagccucaucaacugcguauguacaccucuucccaaacuccuccccugcacugggucaccuuggaggaccacucagauuaagagucugacuuccagguccucagaagucccugagugcagggacacuggaagaacagcagaccgaggaaagugagagccauuacucuccccucagcuugcccuggguuggaggccacuuugugcagcugcacuuagguucgguugagcacucagaugaugccccuacacacauugucacccuguucuucucaggugacacccagacacagauuaggccaucagucccuucaauagauggcacugaguccuggaacaggugcaauuggcugucacccucagaggcagaugauggcuucagcacucuuaggacuuagcucuggacaauggugagggacuggugggcacccuggugguuuuguucccagagagcuccaguguuggguccaaguugcggacacaggccucacagaaggcuggccaggcugguguuggguccauucugagcuuggaacugcacagggggugggccaucuguccacuguggggagaacacacaugaguaaaccccucccagcugaagauccagagcccguaucccuaugucuguuuccccacccuuuauaccguaaugagguugugcucugggaggcuacaggccucgaugugguccugcagcagcugcugugagaaguucuggugcaucugugcggcuucaugggcauccauggcguucccacaugccuuguuuaggucugaggauggggcaggugucacuguucaucccuggguggccaaacucauaccaacccaggggagacagaguuacccucagacauccaaacccaucuugagaugcaggaggaucauccacaaagcccugagcaggaacccagucuccaccugccagaguucuuaaaaauccccuugaaagcaagcuguggugacuuggcagacaaaggaauguaaauuugugacuucaagaucagccuuguugccaggcagugguggcacaugccuuuaaucccagcacuugggaggcagaggcaggcagauuucugaguucgaggccagccuggucuacagagugagguccaggacagccaaagcuauucagggaaacccugucucgaaaaaccaaaaaaaaaagaccagccuugucuacccagaguuccgggccagcuagacccuguuuccaauaaauaaacaaacaaaaauaaaaaaaaacccuggagauacaccgcugcuuguaugaugucagggcccuacaagcaugccuggcagcuuuguucacucucaccucucaggagggcagaugaccacagcugcacagacaugucugggaucuugcuggccagcugcauggcagguaccaccauguuguuacucuccugccaaucaaaagcuaagaauuaacagugaggccacagacuccaucucccauuuuauguucugcugcuccuggacagacucuuauugcacccucagagacuaccuaaacugguccucuaaaguacucuuguccaccuugggaaaaacaaacugagcacucuugccuuccucugcacgugaggcaaugaaugggccauacaugccucuugccagguagagaaaaagacagcucugguccaacaacuagaaugauuaaaacuauacauucaugcaaugucccaaggcuccugaaguagcaaccugucuaagggcauggacugcguguggaggauuugcuccuuugagcuggcuuuuguaggcuacuguggggauguggggucuuuagaccugugacucccucuuaguaaguuuagauucugugugugcugagcugcugaccuaggugcccagcguucucacgaugaggcuaggggaguccuggagagcagcuuccuguuucugaccucacacugagaaacccaagggaguucugaagugcaaaccaugcucagcugaccugcucuaccuccccagccugugggucuggguacuuucugugacagagguugagagcacucacuguccuugcagaguccucagguucaguuuuuaguacccacauggcagcucacaauugucuaauuccugaaccagggaaucugaccccugcuuuugaccucuguggacaccaggcccacacaugguacauaugcauacauucagguaaaacauucacacauaaaauaaguaaauugggaaauacccaaauaacaaauauugaacgaauaacaaaaauuuaaaagccucaaaccagauuucaguucuagguacagguuaauggaaaacaaccuaaccaaaugcagcucaguuggguuauucaggccuuaaccuccaccagccacaaccaaacagagagcaacccucccugcucucugucccugcugcucaccaccaggcucacucugacugcccugaccucacaggcccugcuagcucccuaguucggcuaacacaggcaaagggaguauuuuacagaaagccauugagugggaaacacugcuggacaagcaggcuucuggcccacauugcuacucuaagugcuccuccaaagcacaccacaccagaguuccacagaguaaccaaccagucuugcccaaucagcaggccacagcacuaggaacaugaaggccacucccugcucuccauggccaaguuacccucacuacauuuuauaguaauuucaaguaaaaaagucuuguaaagucacgugcuugauggugccacagacacaggaggguuugacauugccagucucaucuaaguuucugagacagucccacagggccauggauucccaagggaugguaugcagagaagccuacaaggaacauggcaggaugcagcugucucuuaguuccaaggcuugugagcccgacacauauauccuggaagggaaucccaggacccaggacccaggaccccaugccuuccacacccuggguuccaggacaggaaauaccaugcuccacggugcugcuccucaggucucgagcuagauaggugcacaggcuagguagggacucacccugugauuucccaacacauagaagaugugacccagcagcacaagggagcaggcugugaggcgguucagguccucugcauuugacaucuucagaguuucucgaagaaaccgccuguaagaggagacagaugcuggcacccugcagguaucagucauagaggagcagauguagucugaggaaggagaggcuaggauacaugcuguuuugauccaaacuuacuuggcuucguuguagcggcccuggaagaaggagaagagcccucgcacguagaaggcugcugcucggaggcagugugagcugcaggaaagcagggucacaguuggguacagaaaaaaaguuuccaaaaggcagccccugcacacugucuaaagggugggcugcaagcaauauuaaguauguauggagaucuggagcccacaggagcauauaccaccccagagcaaugggggaguggaaugucuauguuggacacagcuggcucaccugaccgggaagcugugguccggguuuauccucucaagcaaacuguacagcugguggagaaacgucagucagaacuccaccuaaaggaggccaggcccugaacaugcuacaggggauagggcuucuuccacucuguggaaagacuaucacaaacaugcagcaugccugccuugcacagccucaagauggaguguucaucugagggaagcauguaggagacaggggcagaguggggacacugggacacacaguauccuugugacccaagagucccugucagccagggugguggagguugggcuuccugcuucucccagcccagaccuggaaaguuggccacaguuuguguagacaaaagaugauggugaccaggggcuagaaugaaggcuguagaggucagagaaaaugggccacucuggagggacucuagggugggacauccuagggucagagaagaagcuaaguuuguggcucugccuaggaagcccagauaaaaacacuuggcuuaugaggacagcccuuugaggguggccaaucuacccaucugguuuggggcugacguguggcucuguggcagaaugcuaggcaacaagcaagagccccagguuggaugcaaacuccaaauuuuuuuuuuuguccuuuuguuuugcuuuuuugagauagauguagcccucaccauuuuggaauuugcucuauggaccaggcuguccuugaacccagagacccaccugccucugccuccugagugccuggauuaaaggcaugcacugugaccacccaacgaugucuuuuuaaguacaaugugggaucaauaaagaugaauggcuuaggaugaaacagaggccacauggcugcaggagugcuaucccaguucugacccucacagaacacuaaacaugugggcuuuucuaaggucuauggaugccuaggacacccuuagcccccacacgagagauggagaaggauaccgaacaugaagcaugucaccuacuaccucuuggugucuauuuccuucucguauauacacacucgcaagguuggucacgaugaaggcccacaacuccuggugguuggugagcuggaaugaaagauagggcuuuuaagaggcuagccucacugucacacccuguuggggcccgacuagacacagagcugcacaauggcuccuuucagacucaaucagcucacuccaaacccaagcacgaaguguaauuagcuccuccuccaccggcagcggcaggguggagcuagcuauucugauccugccaaugaccaacaguggauaaugacaagacuuggucuauacauaguccaggcuggcuugaaguucucuauucuuccggcucaggguccuaacagcuaggaccacaggccuggaacugcccuggcuugcuuuugcuuuguagucuaacagauguacagggaggcacguugggcauggucucuccacugaaccacugauuauguaaagugagaugaucaagauccaggugugguggugauggcuggucauuccagcacuugggaaggaagcugaggcaagauaaaaaaacaaaacaaaauaaaaauccccuuuuuccccaagucaguguugggcuggagagauggcucagcagugacuucucuuccagagguccugaguucaauucccagcaaccacaugguggcucacaaccaucugaugcccucuacucaucugaugcccucuucuggugugucugaagacagcaacagcauacucauauacauaaaauaaaucaaucaaucuuuaaaaaaaaaaaaggccauguuugucucugaacuccauauguagaccaggcuagcuucaaauuuacagagauccacaggucucucccucccaagugcugggauuuguuauaccaccacaccuggucaggcaagaucagaauuuaaggcaaguugacugccugugcaacugagauauacugucaugaaaaacauaggaaggggcugcaguuuggcaauacaauacuugccuggcaugugugaaauuuuggguucaaucuccuuagaaaagcccagauguuugggagaaggaggaaaggaugugagagucuaagcagccugggcccucugacuccaauuuccuacaguuguggucuagcacacaaaagcccaggguugucuuuccugaccugaacugcagcagcauugguguguugguugugaacaacaggagucugaguuugaggacaagguugguguuugucuuagcgccucuccuuccauguauuguccagaagacucccuucagcacaugacuuaagcauugugcugcugaggcaaagccacauacagaagguaagacaaccucuaagaacaagagguuccuggcacauugcagaagggcucuggcauugcagcaggagggccuggggucuagggagacaaggguggagccaaaggagugggcagccaauugacucuucacauagcauucagacauauagcaaccaaagaggggaacuucuaucccacggucagaagaaugcuccagcccccuugcucauaaaacauaacaugcucuauaaaaucucuacugggggcucccuggggaauaggucaauagccucccuuuccugcaaggacacugaggccaagguagggacauccuucccuaguccugggccaggugagcacagugggaguugaguugucccuagaggcaauugugccacucugggagaaauggaccagcuucuuagggacuaguaggucaguugucuaagugugggugccuuguuggggacccagccucccugagguaaaaccuguccucuguuccugagcaccuaucacaggacuuaggauaagggcacaucucagucacuguacauccacauacuaugacucuaccaaaucccagaugacuccaagagcaccacaaacugaccuagucugagaauguccuagaacuuaacaggugucaaaauggcuacccagugucccuguacuccugauacauauauccuuuccucauaucuuuccaggguagccaagaacucuuuacccuagccacuucccaccccaagaggaacugugucacgguuguggccacugucaggcuaacuauaguagaugugggcucaaaguuuauagcucuugcagcagaccuaaucuggucuccaugcuuuuuuguguggcagccaaccuuacaccauauuguuacucaggaagccagccuuacccgaagggcugugguaaauugggcuucagcauuauccaugcaguucacggagacacaauacaggcccugaaaggacaggcauacauguagggcucaggucagaaccagggcagcugacccagugaccauaggcaagcauaauuguacugggcccuaggaugagcuucaggcuauuauaaaggaccccuccccacaacagaacagagcucauguuuggacgcugccuggguaguaucacaggguuauuuacuggaaugcccagauccuuucaggguggaucacauccuuugcuagguaugugcuugauuuuggcaagagugggguccagugccuggggcauacucaccaacagugugugcaacugggcagcaugguuggagaagagccuaggggacugcuggcauagcuggcagaccugggagaucugaggagagaaccaagguuccuguucugggaccuggcacuggggugcagccccaaggcuggaagacaugcucccaucuacuugccaaacugggggucaaaguccuggcaggaggagccaccacauggagaggaugacccugcucuccuuucuccuugcacaugcugaccuucgucccaguuucagguuauaaaaugccucuccaauguucucaggaaggugugcauuuuggugacaugggucccagucauaucucaauguuccccgagcauacaaguuuuagggaaccagacuauuggcuuuacacuggauucuacaacccaggcuagagcagugacagugaaaucacuguacccuccccucuugacaccuguguccacauccagaccagcucccacaucccgcucucugugcuuccuaccuccuguagugcaguggccuuguggccugugacaagccggcacaugaugauaugcuccagcaggaucacuuggaaagacgacaggauagggcugcaguccagcacuggggacaggaggcaggggugaacaugcaagcaugguaccacccggccccacccacaucauccccgauguagccucuccccaucuagauaaggacguaagcucaaaccaaugccauugugaagcauccuaaagcuaagaagugcccaguggauaaggcucagguaaagcaggagcuuaucaagcacaggucagguccuggcuugaaugccaagcaccaaaagccacaggaaacucugggcugagcacugcauuacauacaggccauaucuacagaggcugccugcuacuacugcuaagagcucaagaaccuucuggguggguucuccaagaugucuucaacugugcaugugagugggacagagcucaagccauggggagcucaggcacuuccuggcaacccugcauagaucucuugggugaggaaaaaguuguugccuacacagcuuaaggaaaagaaaagcacaguuccacaggcucaaagagauuaagaggaaggcuaaggccacaugcacccaggaugcaugaaauagucaaguguguggcuagaacccuagacucuggaggauucacacauaguagguagguaggugagagcuagguucugacccuggccucccugaacauggcaauguccuaaugucaaggaaacuugggacugcucgaguccccgcccagguagcacuuacucuuaagcuucuccaacugcaugagcgccuugucuguguacuucugugccuucuccagguaaccagccugcaucgaaugcaucacugugaccugcaaggagacaggugguggucacaaggcucucuccccgcccgggcccaggguggcaggacucaccagguagacgagcacacacaugugcuccuugggcagccaguggaagaggucagcaggguugcugggcaggauuucaucaucauguaguguggagauggucugaaugcacugcugcagcugcuucaggcacggcuugacgcucuucaccuguggugugcaggccucaacaucacaccccaggaggccuggcaaccuugcccagcuccuggauggggacucuuucuccuacugcaggagcucuucuccucaggucuuggccucccagaagccaggcuucacggaggcaagaaguaguuaccucccacaaauagaaacccuguuagcacuguggcuucuguuaacccuccugacauccuaagccucucagggacagcuaugguucucagcauucagggacagcuaaaggcugccauguuuuuauaugcugaaugaggagcugggcccaaagggaccacaaggaaggcccuuacuaacaacagguucacugagcauuucuuggguccccacaacacuggccuagcaccucacagggacuuacaucauaggaacaggaaaggguaaaggcaggaaagguagcucccaugacauaggcugaggccaucacauaaacacgggugucaggucuucaacacagccacacagccauaccagggucccuaccgacccccacaaagcugcuguaagcugggaaagggaaguguguagcauguuacccuguuuugucuucauggcuuccacaaacuuccuucagaggccucccaaccgugugugcacucaaugaaugugaggccauaaauucucccucaaaugaggauaggcccaccaggacaaaacugcucuguaggcaccucuauacuuggggcuaugucauauaauaugaaggagcuaccaacuaugcuagagcaggaccuaugcauguauguuuguguacucacaaacaugcaacaagaucauaucaugaguaaacccucuccacagacccugagcgacaacauaccugcccagcauccagguagugggucaccugcagcaccaggaagaagacacguagugacuccuucuggaugggguugcccugccaguucucuacaaucugcccacacagugugagcagugggugcaccucuugcaguuugcgcuccaucaacagcagcuagaggggggaaagagggguggcgcaucacuguuaccaguccaacagcugagaaccccacccccacccccagagagcaaagcugggugcaaugaggucagguguggcagcacuugccuuuaaucccagcacuugggaggcagaggcaggcagaucucugaguuugaggccagccuggucuacauaaagaguuucaggacagccaggacuacauugagagaccuuaccucaaacaaaucaaacaaagcuggaaacaacaaagaaacuaggguacagguggcuccacagcaggcuuucucaauagcacaucuaccaccugaaaccucagagccccaaaugaagcccauuagggcacagccccugcuuuuguguagaaaagccugugcagguggccucaugcccgcaacucggcugcacaccagccugaacuuaccauccccuugcugagcaggaauaaugcccuggaaaagacacaagauaucagguuuguaaggcaccaggaucaauacgguugcuccucagggagaugugcuuuauuuauagacacuuuagagugcugcauuuuguucugaucuaugucuacaucuuuaggggggcagaugcuggaacugaucuuagggucuuacacaugcaagacaguacucugcacugcacuauacuuccaucuuaacuuugaacuuuagccuggucuauauaugaaguucuaggucagucagagcuacauaauagagacuuugucuaaaaaaaaaaaaaaaaaaaaaagacaauacacgugugugccuacaugucaagugcaccacuggcauccagguaccaccaaggaggccagaggggagcaucagauguugaggaacuggaguuacaggaaauuaugacuccugagguaggugcugagaaguaaaucugaguucuaaugugugugagagaagggagugcuccuaaccauugacccacccuuucaaucuugaacuugggauccuccaucaucuaccaggugugcccaauggagcuuccguagcguagcuccuguuuuacaugaugcagacacacuucugagcaucgcaaaagaauagagcagaagauggcacccuuaagucacccuaauguuucaacucagcggaagucggucuggcagaggauagaggaagcagggauuggcuugggcugucaccaccucacccgugcucuuggcugugcccaccucacgucucucucaggauuaaggacaugaacuuauaaaugggcagucagugcccuccccucucugucagcaggguuucuguggccucucucaaaccccacuccauggacuuucccaaggagaucuauguacacccugaaaacaaggacagaagcucccacugcaggggagggugguugcucauaccaaugccagcccacugcacgcauauaaacagugauaaacagugaaucacacuuaguuguuggggaggcaccugugcaauaaagccugugguuggacaaacccuaccaaugcuuuccauuucaagagauuuggaaguguguggaagugcaaaccugucacccagcucuuaggaggcugaggcaagaggauuaaaccaaguagcuggggucauucuggcuauaguagugacagccugucuaaaaauaaauacuagagagagaaacugccaguaccagcucuaccaaugagacacugcccuagccuucccagcuaggguucacaugacaugaacugguggucacucgcuaggauugacucuguaugggucaugacaacacaggcuacaaucacacacuaaggugccauguuuaggaucaguagcaggacagccaagcucuuuauaaguuagagagcaggaggaaaggggugggcaaagccuaccuuguauauucagaucccaccacucgggcauacucagcccccacgccuaggaggucacaggcggauaccagguccuucuccagugugugcaguugcuaaaguagagaaaaagcaaugacccuggcugccaaugccaguccuuagaacuugccucagugugucuacaucucugauaucagcacaauuauugcagugauggcuuggaguuuaagcaccaaguaagccaacagcacuaacugcucuggguauaaacuaagucaugccuuguacucugucacuuuuguaugcagagccagcagucugagcucugaggcagacccagugcauaccagguaagguacuagaaagggcucccacagagcaguaguauaaggaugcuucuaacccagaaaccuggaaaacugaaagagcccacaucugauucugguccuuagaagggacccuuccaugcagacacucccuuacacacagagcaucaucagcucugaaagcuggggagggcagggagcugcccaguccucuuucucagcugcacaugggaggcagcaaggagacaaagugaacacaagagcauuagggaggggccugagggaaagggugagucagggagacaggggacaugacagauggccaggucaggggcagguaaacaucagccaaagucauucaggugcccaaggaagaggugcagauaggauguaggaaagaagaggugacugacagaguagaaugaccugucccucuauggcagccuggaggcccccaagaagagccuggcacucgaguuuaugucccaagguuucucucacuccuguacuuacagcgagcuggaagagcaggcgacagugccaguauggcgucuguugugagaucuggauggcuuuccgcagcagugguuuugcugcauccacggaguucugaaaggaaaugguuucaagcucgaggaggaggaggaggaagaggaggaggaggaggcagaggaggaaaagcuagcaaucaaacugaaccccugauacagcagccacagugccuugccagcaggccaagccccaucuuggucacuuuccagggugagacggggaaugcuauuacaguguauuugcuuuuugggaacaguuuauggcuucugaaauuucuucuugcuagugugguggcacaccugacuuuccaauguuugguugugugaggcaggacagccugugacuuuaaggccagucuaagcuacaggguggcauucucucccucccccugagucaggguuucucuguguagcccucgcuguccuggagcucacucuguagaccaggcuggccuccaacucagaaaucugccugccucugccucucccgagugcugggauuaaaggcgugugccaccacgcccggcuauauauauauauauauauauauauuuuuuuuuuuccagaguggcauucuuaaaaagaaaaaaaauuuuuuuuuguuuuaguuuuuuaauguagaagaauaaaaaccagguguagugaugcaugccuuuuauucagcugucaggaagcagagcagaucucuaagaaguuugaggccagccuggucuacagagucccggacuuccaagacuaccuagaaaaagccugucucacaaaaaaaaaaaaaaaguuauaauauacacuacaauagucucuccuucagacaggcaugauaggcaacauuaucuggaaucucagcacugaggacaaugaggauggcucugugguuaagaguacuugcugcucuuuagagaagaccuggguuuaguucuuccuagcacccacauggcagcucacaaccucucacuccaguaccauggaaucucaugcccucuacugaacucuguggacaacuggcaaggauauaguauauuuauacacauaaaacacuuauauccagggcuggagagauggcucagcgguuaagagcauuggcuacucucccagagguccugaguucaauucccagcaaccacaugguggcucacaaccaucucuaaugggaucugaugccuucuucuggugucucugaagagagcaaugguguacucgacucgucauauauauaaaaauaaauaaauaaaaucuaaaaaaaaaccaaacacuuauauccauagaauaaaaauaaauaacacaaacuuaaaggguugaagugcaguuuggugcuggagagugucuacuuaguacacauaaguaccuggcacuacccuaggacuguaagaaagacacaaggaaaaguuacaccuuaaagaauauuagacaauggugcugagucacuucuauuauaguagguaguauacuucaggaggggacaaggacagggacacacagagcucaguggcauuaucugucuagcccaaguaaggcccuggcuucuauccccaguccugaaugaauaaauacagaaguaagggagugugagcaagccauguacaugggucucugagggcugaacacaaugggaaugacuaccgugcugggauccaugcucuccugcuagacccugcuuucagagcuagcaacacguccucaccucuugacaauacagcucugacaacaggcuugcugccucaaauuuaacaucuucaaacugugggaucuggagaaguucaguuaaggaaguacaacgccaagacaucucuuuaaaaagggucacagcuccagguaaauccuccccuccaugcugcagggcaagcagaggaggccgauuugggggaaagggacagaaugaggaccuugaugcccagagacugguggcuggcuugcagggcagcuaggguacauaguaugccagagaaagggaccuuuccagcuuuuaccaugggcuuuucauucaagcagaacauuccucaagaacacaggauaggacauguauggcucagcggcagaacauuugcuuagcaugccccagaggcuggguuccacccccaguaugaguaccccucaaaguacaagaaaaggauacuugcugugauaucaaccacugaaagagaaagaaaaaugauuaauuaauuuugggcggaaagaggagggucaagaaagaguuucuuugugcaggcuguccuggaacauacuuugcagaccagaauugccucacucacagagaucuuccuacuucugucuccugaauacugggauuaaagacaugagucaccacacccaucuaggauuaauucugaggcaaaugcuuggugccugguuauacugggcuuauacuagugcuggcauagcaugccuacuaccaagggcaguguggggagaaacagcauugcaucuccugcaauuugguucugggauggaagcugcauggcacuugggggaugccuaauaaagggggaaccucucuuccuaacaucagaaaggagcuaggacucccaucuacucgagggagggaaucccagggguaucuuggcuauauacucuacauuucagcagggcugaugauggucuggcagaaagacugggcauucagcaaagcuuugccugaggaauggguuaccucagaagugccugaggaaguagaauaccaaagaggcuugaaaugggcagagcuagccucagaaggggacugcuaguguggucauacaauuggccaaucugagggauguacacuaagagauucugucucaaaacaaaaccuggagaacacaaaccuggaaagaugauucaguuguuguguuuacuguucuggcaaaggacccauauuuguuucccagcaccuaccauguugggguagcucacaaccauucauaacuccaacugcucaacacuuuuauccucccaacaccugcaugaaagcuguacauacaaacacaagcacacacauaauuaaaaauaacuaccuuuaauuccagcacucgggaggcagaggcaggcagauuucugaguucgaggccagccuggucuacaaagugaguuccaggacagccagggcuacacagagaaacccugucucucgaaaaaacaaaaacaaaccaaaaccaaaaccaaaaccaaaacccuaggugggcaugguggugcacacuuuuaauccuagcacuggggaagcagaggcaggugaaucuuuaugaccuugaggccagacugguuuauauagcuagccuaggcuaaaaaagugaaacccugucuccaaauaaauaaauaaauggaugauucagagggucaucuuugacuuagggaaccacugugucucaagcuacauguuucaagaaaacuccagggcuggagagauagcucagcauuuaagagcacugacugcucucccagagguccugaguuuaauuuccaacaacuacaugguggcuuacauccaucucuaaugggaucugaugcccucuuuugguguguccgaagagagcaaugcauaaacauaaaauaaacaaaucuuuacauaaacauaaaauacauauacauaaaauaaaucuuaaaaaaaaaaacccgaacuccuugguagugugccaugcaguguucaguuauuggauauucaaggauaacacugaccugacaagcaagggugaaacaaacaguuaccaaagaacugaccucugagaggaguucuaacagguguagagagguagguagucugggccaucacccaccccacugugucaaagggcuacacaggauggggcuuuuuuucccucuuuuuaaaaaagauauauuuauuuaauuuauguauaugaauauaugugaguccacuguugcucucuucagacacaccaguagaaggcaucagaucccauuacagaugguugugagccaccaugugguugcugggaauugaacucaggaccucuggaagagcagucagugcucuuaaccacugagccaucucuccagcccagguugggggcucuugaugcugagcuuugaaggcuagaguaggauuaacucuucuguguuuugugcaggaggugcuccaaauacagaagagcuagcaagaaaagaaccaagaccuaggaaauaccuggggcugcaaggcugguggcuuaggccacucauagcagugguggcuacgagugcaccccuggguguggagccugacccaguggggaagaaucaaaauccugcagauuuauuuuuauuuuuuauuuuuuguuuuuucgagacaggguuucucuguauagaucuggcuguccuggaaaucacucuguagaccaggcagaguguuuuuuaaaaaaacaaacaaacaauuuuuaaacacuuauuuauuuguguauuuauuuacacguaugcugaugcauucaauaggcuauggugugagggugguggucagaggguaccuuaugggagucaguucuuucuuucuacugcauuggucaggcugucauguuuggcagcuagcaccuuuaccugcuuauccaucuugccguuccuacaacauauuuuuaggauuggcuuaggacaaguauuugucauccagcauuugagaaguggagacagaaaaucagaaguucaaggccaaucuuagguacacaaaagacuggggaugugacucaguuggcagcauggcugcuuaguacguauaagacccuggguuucaugcccugucccucacacacuggacaugcacaccuguaacaccaguacucaagaggagcuucaaggucauccucagcuacauagugaguuuaaggaaauuagccuagauugcccaagaucuucucucaacagaaagcugucuuagagcagggacuagcacagaggaggaaaaaaaaaaaaaaaaaaaagaggugcuagugugaccagaaacaccuagguugccucuaggaccagcaauaaagacaaagggagucacaaugagaagcagggugcuguuggccaguaaaaggcagaaaacaggaggagacuucucuggucagcucuggaggccuucucagagcaucaguagcuucccaggaccacagacucacuguguucuuucaaauaggcagcugcaggaugaauccagaaaucauagccagcugccagggaguggggacccauugcuucaauuucuuccaugucugggccaucuccucacagaaaggccucuguccuucccacuuagguuuccuuguggcugucaucugccuauuuagucauaccuuucuuucugagccaaaggugucugcugauagacauccacuccugugcccuccucucuggacauuuauugccuuuccagaaucuuccaccacccuauggaccuccacagucuucucaggacaucucaauccccucuuggaacucuuccucucauaccuccuucugucaccuucuguguacagacauccucaggcauugcugaacugauagggacacauucuaagaaauaguugcuaggugauuucacaguaaugcaaacaccagcauguacuuuaacaaauuaagucagccacauuacuaggugacauaaugucacaggaaguuugccauugacagcaugucuuuauacaacccauaacuucauacacaauggaggauguuagguaaggcccauguauagccucugucaagguugugucuccagaggcugcuucagggugauacuccacuuguacuugggaaacauuugucucaugagcaacaacugcacucacucacguacauuccuugaagaaacuggacucagaguuaugccuggacaucuucaucugaagaugcccuggcgcuauuucucccccuugagguagggucucucuacauggcccaagcuagcccugaacuccugccccucuuuacuucaccugcacaguauugagguaacaggugaugaaauccaggacuucuugaaugcuaagcaggcauucuacuuagugaacuacaucuucaucccguuuuuccuuaaauuucuugagacaggaucuuaugcaguauauauagcuuguccucaaaguauagagcugagccuugagcuccuacuucuucugcaggcccacaauacuauguccagcuacauuuauuuauuuuuaugugcuaagugcuuugcuugcauguaugucuguguaccagguaaauguagaggccaaaagagggacucaaaucuccuggaacuagaguuauagacugcaccacuagaugcugggaauugaaccuaggcccucuggaagagcaccaaguguucuucucaacuacauuuuaaaucccauggacaugugaggaguuuugaguaguuuaccauuuggacuacagcaaugaaaacgugugugaaacaaaacuuagcaggcuggcaaguuggcucagugguuaagagcacugacugcucuuccagagguccugaauucaauucccagcaaccacaugguggcccacaaccaucuguaaugagaucugaugcccucuuauuaaaucaaucaaucaaucuuacaaaaagaacaaacaaacaaacaaacaaaccaaaaacaacccaaaacuuagcaaaauguacucuauaaacggugaucaugguaugacauuuacaucuccaugaaucuaugucuaaacuuuugcaaggcuagcaagaugacucaguaaaggcacauguuaccaacccuaaacaccagacucugauaacuggaacugacaugguggaaagagauaaccaacucucuccuaaguuguucucugaccucuauacacaugcugugaauugcccuacuucugggcuggggauauagcucagaugguagagugcuugccuaguacaguucugccuuccauccuuggcauccaccuaaaacccaugcauauaccuauagccucagcacugagggagaagcuggaacauaagaauuccaaggccacaccuacauaacucauuuugaagccagccuaagaugaauaaugagucccucaaagaaacaaacaaaaguaaaaauuacacaauguauccuaacucagcuguugugcuguauaaggcucaagaauuguaucucuuccuugugauauuuuuguuuuuuuuuaaaaagcagucaagauaagaacucuuuaguucacaggguacaaggugauuguuagcucuccagaauccagugggauugcuugagguuuccuuuuggacuuguuguuuugugagguggggugcagugucaggugcuaccuguuauuucuguugacuugguuuuuuguuguugucacuguuguugcugucuuuacuuuuucccuuugagauagggacuuacuauauagcaacgcccagccuagagcugauuucaggaccaggcuucauccaagucucagauccaccugcuucugucccuaggauauuaaaaauaugugucgggcuggagagauggcucagugguuaagagcaccgacugcucuuccaaagguccugaguucaaaucccagccaccacaugguggcucacaaccauccguaaugagaucugauguccucuucuggugcaucugaagauagcuacaguguacuuagguauaauaauaaauaaaucuuaaaaaaaaaagugucaccaucuaucuuuugcuuuuuaaacaaauaugugugugcacgcauguguguguguauauauauauauauguacacacacacacacacacacacacacacacacacacacacacacacauguauaugaucuuauccaaucugacaauuugcuuugugugaguaggugugugugcauaugcaccggaauguggagguuaagcaucaggcucuauauuucccuuacucccuugagaggaggcaagcuacuagacagcaaggcuuagugcuccacuugucucugcuccucagcagccacuacacugggguucccaauggggucauguguaggcauacuggccaugucagauccuucccauggacacugggaucugcacuuggacccucauuuuuuuuuuuuuuuugagacaggguuucucuguauagcccuggcuguccuggaacucacuuuguagaccaggcuagccucgaacucagaaauccgccugccucugccucccgagugcugggauuaaaggcguacacuaccaccgcccagcuuugcacaagauaguggcuuauggacaagguccuagggccacuccaaggacaauaaugucauuuaaaauaaaacucaggguacaugaauggaggagcaacugugacuaauagaguuuuagagguauugagcuggggugacugauggagggcacaaugugaugcugugggagaucuuucaggagucagcuuucuguuacaccaagggaaaguacuucacaagggucaggguuuuaauuacugguucaaagccaagugcuaaaagagagcaacugcaggcaugauugcacggggcucuguggaugaaauacgaggacacacugacacccaaagaaacaaaggggaaaggaagguagugggauuaacugcccugaacaaauaagaaaagaacauuucagaaccagccaggcccuggcagccuccggcuugcaccuacacugaagccuggcacuuggcagggucaaccucacucacuacugcccuggaugcuccaauccacuucuggccccaggcacaccuuguuauugaccugaaaccuugaaugggcucacuagcucacaccauucaaaugucauucaugcaaauaagaggcucccucaucccuauuaucaacucuaucccuuccucugguccaguguccauagcucuuauacuaauagccuuauugaaugcuagucucacuaaagaaaaagcuaccaugcgcaggacuuuucagucugcucauacccagacaguccaggacaggcuugacacuuggugggaggggaacaaauaacuccuugaugaaugaauaagacaacaacagcaaaaagcacuaacacaauaaugacaucuuauucuaguacagaaacuagugaucauuaaacugaggugacuagagagagauggguaguuaacaacacauauuacucugcacuggacccaaguuugguucccagaaacuccaucaggcagcucacauauaacucuaacuccagcuccaggguacucagaacuuugauucagugggcacaacauuuaagagcauauauccacacauauaauuaaaaauaauuguaucuuuuuuuuuaacucacaaauuugauuagcccagguuuuuggucuuuuugagguaggguuucucuauguagcucuggcuguccuggaacuccucugugaaccaggauggcuucaaacucagagaacugccuacccugccacugcccagcucagguuucaccucuuuuuuaaauguaugugagcacacuguaagcugucuucagacacacuagaagagggcaucagaucccaguacagaugguucugggaauugaacucaggaucucugaaagaagaguuagugcucagaacugcugagccaucucuccagucccaucccugguugguucuguugagacaaggucuucuauguagcccugacucuuuggcaacacucacagagauccaugugccugucuucugagugccaggauuaaaggcaucugccacccuacccagcucuuuuugauuauaauuuuuuaaaauuaaugguauuauuuguuguguaugauauguaugagugcaggcaaauuuggagaucagaaggcaauuuuugagaguguucaccuuccacucaaacucaaguuaucaggcuugugcugcaaaagccuuuacccacaaagucaucuaagcagaccugcuuucuuugagauauucuuccuguguagccgaggcuagccucuugccucucccuugaacauguacaucacagguaugugcaacuaugccuguaaucucaguacuuggguggccaggaaggaugacagcugggaauugagaccaauucuuugcuacaucguguaagaccacgacaaccccccccaacacaaaaacaaacaaaaaacccaaacuucacacaguguggucuuugcuaaaucacuuuacuuagcuaagccuauacgguuucacucuugaaauaaggaaguuuauugguucagugaggauuagaagcucuaacuaugcacagugugggaaacaagaauuuugauccccuccugaaggcaauuuacuagacugucugcaggucagaacauuaaacaucugaauagucaaggaaacaaagauaggaaaauggcaaaaaagaggcggagguguggaagagacacaguugccaugagaagaaacaagucuuacugagaagcugaaugacagcuaccucuugaaauucugugaagcaccaagacgucacaaaucaaguuggaggcggaguggggacucuuucaaagauggaccauuucguggugggagaagaagccaccaacagugagacugaccuccagacccccgaggugcaagugacucuagaagcuacuuucugcacuucagguccucacaaggcaacaacguucaacaagaggcugaaggccucaccuuccccaauauccaugccacaaggaucugggacuccagaccuagacaccugacugucagaaguccuggacuuucagauuuccugcgaccucgcuuucacacgucagggagcucgcaucucuuccuuagguaggugcuucuaggcugacgcucuggguccuguucccgcggccacccgacuaggaggguccccgaugcaagcaccaaguagcugaagagggacaacuuucccgguucccgggugagagggcguggcggagccgcgucugucaccgcaggugagggcgaggccuucggaagucccaagcccgacgaggcggagaggaucgaguccccgguacccgcggcccgcccgccuggcccgcacacucaccgccuucuccagguggcugcgcgccugcucgcuguucuucguguggugguaaagcaccgagccgagcugcaggugcguccgggccucgauccgcugaggcggcuugaaggggaacacggccugcaggcaaugaacgcacaagcggaucuugggcgggcuagauguucggaagugcucggcgaaacccaggagagccagauaccacgacucggcugccucggccugugcggccugugcggcggcagccugagcugcagccgccgccugcgccgcagccgccgccugugccgccaucuuggcccgcacaacaacaagccgccuccacagagaggcggaagcaccuugagg

SEQ ID NO: 4475 - RNA, 7410 nt, Mus musculus
cagugguggcuuacaccuuuaaucucagcacuuggggcaggcagaucacugagcucaaggccaagccuggucuauguagcaaguuccaugacagccaaggcuaaacagugagacccugucucaaaaaaaacaaaauaaauaagcaaauaaauaaaaauacagauuggcuaccucauuucuacagccagcuccuacuuaacguuuuuuagaugacauguuacuaugauucauguguaugcacacaugccccagggcacaugaggaggucagagaggaucccacaggauccuggagcagugaaaaaagggagaggagccacuuuugaaccgagaagcccacugcacugacagggacuggcagccuuguuucacauucaccagaaaaaacaaagguuuauugaacuugggcugcaggcugcugcuggggaccucagaacaauccuagcccagagaagagucuggauaaguguuuggcugcacacuuuagaacaaaaggugugacuggagcccacagccccuuagcuuccagacucagggguggaauuagccgagauagauggggcaggcaggaaagugugugggcaaggguacuugcugguuccagcagcaucugagaccuggaggcuccugcauuugggcuggucuugacccuugagcacacauggguccucagaaauggguugaaauugaugguuucagggagaaucugcccuccuugauuuccaagaaggaaaggucggccuuugugcgguaccacagccucaguuuccuagucugcagggugaacauuuaaaaugcuggaggggguugcagugguggcuccugcucagcugcuggguggaguaaaguuagcaugcaaauggauggugcagauagcuguuccagaagcagaguccugcauaggcccaucugaagaagggacauuugucaggcgccugaggaacacagcaggcagcuccagucagagggacccauagcaagaaguuccugagugcugcaggucaguugucauggagacaccgacguucucuauggcaacaguuggacaggaugggacccuggaggggaaagccuugaagggacagguauucuguuaccuuggacaccagagguuuggacuccauggcaacagucuggguguuucaaacugucuaggagcggggcuugggcaacugagagaaacagaagaugcucuuugggaaaggggcagcuguuuccauggagaggccuggagaacugaauguuggguuacccugaggauacucaguggggaagauugucuccacagcaguccaccagggcagggacagacaaaaaugaagugguagguguuaggcuuuaggccaguaagaaaggaaaagugugguaaccaugguuacagaggaaggcagaaugugccauuucuguggguguagcgggugagccugguaaggcugcauugguggccuaugugaccuuaagaagccgagcagcuugucucugcaagucagauuuuuagggguuucuugucugagggaaucucuuuggugacaucccccaaggagcccggggacgggacauucaagcgagucuacucucuggucagaggaaaaccugagggauaggcauggccgcuguuccaggagccagcugaggagacucuccugugacaccagagguguugggucuguccuccauauugacccagggacaaaguaugcuaccuugaaaacguaaagagacucucugaaagagugggaaucugggucacuugcucguacagggcacgaucaucuugugaccugugguuuucuguuucuucaccaggugauggagucaguguacagcugacgauccaagaccaguuuuccagcucccgggaaauacagaagguuugggggcaggucuccaguuaauccuggggguccagccuccaggugacugagggggguguccaccuguuuuucagaaggccauagaagguucaucuuuuggaaaccguagaguccugcuggucuacuggggucccggggauuagggagaguaugacucuucugggcaaagucuaaaagaugaaauauccacuauccaaaggggauccucagagggcaacauagucagcgaccaagaaccacaacaagugggucagccugcagcucaccgcagggguaggucgcuuauccaggagaccuuagguauggucaauguccaaagaccacagguagcuagaucagucugcagugcaccgcaggggugugucauauguccaaggaaucucugagacucugagacgugaucgguauccagggggugcaugaggccacuggaucagccacuaacacccccaaacacgcauccuuccagaucuauacacgcagcgggguccaggcagccggaucccucgacccuccagcccaaccuccuccgccggcccagccccagccccagccgccuggagccggaucuggggcaccuggagcgcgguagcaguagacaccgaagagacgucgggaggcgucagggaaacccaggcugcgcacgccgggccgaggaccuccacagcgaguucgcggauucacgaugggauagcgcgcgcugccauccgccagccagccugcagugcagcgguccaacagcugcagcuuccacgcagcgaacagcugcccgaccuuggccacuguggcaccccgcgcagcgcacgcgcgcacugccccggccaaggccacaggucgcagcgguuucaggaaaaacacgcggccugugggacccgagaguguguuagaccccggccagggauaggcccgccaggcucuagcguccuagggcuuccugagccuaguccaucccauucacugcaaccugggaccgccagugcgaugcugguaccauguggcauuucacugccccccuguggcagccuggaaagcggaggcaaggcggaggagcggggccugcucacuuuggugggggacaauggucuuggagggagggucuaugcacuucagggagauuucuguccauugggcagggcucuuauuuggggcgcgaccuauguuugggaaagguuuucucuaguguccuuaugccuuagcguagugucuguguccuuaggcauaggauuuguguucuuguguucuugugggcagaguccacacucuugaaauggaccuucaaccacgguguaggcucuaugucuuucggacaggucuuccucagggaggcggggaugggggcuuugggcuuaauuugugccuaucucuuuggggcggagcccauggaggaagucuuuccucaagagagaaaaagccuauacccugagggauggagucuauguuucugagacagacuucccuccaccugccaggcccuaggguuaggcgguuagggcugucuuccucaaaggguuggagacuaggcacuuggggcggguuucucccuaaggggcggggcauaugcgccuggggcggaccucauucuaggggacugggacuaugcaaucagcggccaggcuccaugggucagagccugugcauguggggcaggugucccuccagggagagagcuuuugaacuggaggagagggccuccuuuccugggagaggacauaaugauuaagaggaaggagagagggaagaaggguccccuucagggagaagccuauguauuuagggggccuagguccuugggacaggucucuuucaagaaggcgggaaauaagugcuggagacccgcuucuuuggaaaagacuuaucucacccgggagguuggacgugaagcagaaggcaucguagcguuccucagcguuaugacgauauccauaguugcgcacgcccccguuggugccgccaccagcuccagugcucccagucccgccacagggcucccgggcauggcucacuggguacugcaccgagccaucgcguaaccaucccgcguugcaccaguccaggccaucgcgccaggccgcgugcagcugcuccgcggacgccaaaaugccauccuguucggcacaagcacgcugcgcuuccacgaaagucaucuuguagcgaccuccgcgcgggugauaggggaagaccaccccuggguggacgaagacaaauaggagucugucaggguuacacacacacacacacacacacacacacacacacacacacacacacacgcacuggauucuacuacaccuuacacgaaacagaaccuuccaguucacuuuucucucagcccucggacccggccgcaccucuagcccccucacgcccauuauguguccuuggauucaagcguggaaugugcuccucugccuuaauacauuuuaaucauggcuacucuuccauggccacagaccuucaugcauguucuuucuauccuucuccagcugccuaauucauccaucaaaacucaacucuuaauguccucugucccaguguucugacaacucacuacugaaguggaaagaccugucccuagggcaguacuccuacacccugggcccugaaacaguugggcaggugucaagcccucugauuugccaguauuauuuaaaguguuucccuuccaacugccugggacugugacucuaaacuuauuucucacuaaacucagucaacccaacucuggaguguuucugugcugaaggacaggguuuaggcagaaucucaugcuggccccuauuccaggauaggaugcaaacaccagcuauggugaagcccuagaguuuugauggacaggaugucgaaucuuggccacgccccucaccuacagaugcccagggcaacgccauagccuucuugaggcagagcucaucucuagguuaauagcugucgaccuuggggauuugaggaaauuaaaugagaagcuccagagagccguucagcuaaguggcuggcaaacagaaagcaucuaaugaagacagcuacaauuuuccauuguuaaaauguucagaagugucaauugaauggcucugaagguaauggcauuugccaccaacccugacaaauugaguucuauuccaggagagaauccauucggcaaauuguuugugaucuccauucaagaaccguggcaugugugcacucguaaacacacacacagaagugcacacaccaaaauucaauaacuuuuuucuugaaagcucaagaguucaaagccaaccugggguccauuaaaccuugucuuagucauagagcuagugcugaagagauggcucagcgguuuaaaaaaacacuuucuucaguccagggauggcccucaccauugaucccuucacuugagaggcaugcugaucgcugcaaaugcaaggcuuguugagauuuuauuaaauuaaucagaaggugccuuaggcaggccuucacacagugcaccaaaagauuaucccaacaaaaguuagcgugaucuauguaguggguuccaaggcagccagggcuacauggugagaccuugucuagaagggaagaaaaaaaaggggggggaccucuuucuuccuuguuucucuuccagccaaaaagaguucuguuccccacacugacaccaggcagcucucaaccaccuguaacuccaacuccaggggaagggaggccucuucuggcccuaaccacaggcauauauuaguauacacauacauuaaauaagagcuguaauuuuuaaaugagcuauuccccugccugacaaaaucucuaccgaaacaaccucauucaguuugccccccacuguaccccuuuuucucugcccaugcuguggucaccuuccagauccagcuugaccaugccgacgucauccuccagcucauuggugaccucgcacucguagcgcccguaguccugaagggugacauuucggaggaccagggaggcauccccagguccgucauucugcaguucggcccgcccucgguagggaccgaaggcucgaugcuggggacccagagccacgaagacaucggcgaaagccaaagggucuaccacuuucguccacuugaggcggacgccgucgugaccgugggcggccgccucguagugguaacggcaggguaagacaaugguaccaccgcgguggcucaccaccugccccggcgccgucugcaccaccacggaaccggacucgcccucugcggggcgaccaaucaggggucaaaggugcgguagggucccucagggagaggaugugggucuaggaugggaaaggagcucagagauugaauguaggggaccauggcaauccgccaccccaucccacucccaucguucacucuaggccaccgcugugugugugugugugugcgcgcgcgcgcgcgcgcacgcguguauuggggauugcaggggaugaccagagcuucccacaaaacucacccagcacgugcacgacuuucuuccugccacgcugcgccccugcgagcacggggaccagcagcaggaguccccaggccacggcccagagugcgcggugaccgagggcuccuggagcacacgccugcggguacaggagcugcuuccagcuguacugccccaacagccccuagcucugccagcccuccccaaaagggucucaggcgcgaaucaaccguggaacugacggagggucaggagauuuccuuucgucuucccuaagucccugcccccguuacgggagcgcacgggagggggagcagcagcgcggaccggggccgcaagguuaucagcgcgccaggagacugcagcaagcccggcagcacgagcggggguuggggauagagggacaggauuggagagguggggggcaacgggcuacugagccaggccaggagagauagagggagcgagacccagaguugagacacagagacagagacagagacacaggaacucagaggaagagauucagagauagagacucagagacagacacccggagacagcggcaaagacagagagagacccagagacucggagacagagacgcaaagaugcacucagagacacagagaugcagagacacagagauagagacgcagagauagaaacucauaaauagagacgcagagacagugacccagagacucagagacagugacccagagacgcaaaaauagagguguaggaucagagaugcagagacucagagguagaggaaggagauacuagugggagagacacggaaaaagaauaagugagcgcucuucuccaccaccacccccaaacaugggggagacauugaagaggcagagaaagggaaagugccaaagaaagagaaagaggaggcaagaggaaaagagagggcggagagaggcagagagaagagagacagagacaaaugugagauucgaaaaccagugcagcguggcacucaccauccuggucguggcccuugcugagcggccagugcgcuuccccaacugcgcacgcgcacagcggucuggccagcugguccugccggucgcgcaauccgggcgucugcc

SEQ ID NO: 4476 - RNA, 2428 nt, Mus musculus
agugucuguguagcacugcgcgugcgcuauccgcacgcgguuccggguucguagaucugcagagccgcuggggcucgguugguuuagaaagcugcuuuuaguguuccuccgguucccagaucgcccaccuugucauauagagguggccggggguagggaguguggccgcuagaucaaguugggaguggcagcgccgggcuucgaacucgcguuccgcgagucauccuagaacugugaugacucagucuuugguuuguccggacacugugagcaggugagacucaguguagaucugggcgcgggggcggaagaacugggagcugaguuguggagacgaggcccagauggcagcuagcugggguccagaaucaggaaccuggagcagccugggggcggagccaggugguagagucccgugguuuaagugguguguugccuggugcaucuguucccuggcugggggugcggucugguaguuaaguuccuggcuguugguagcagaguucuuggguguggggccggccggccugguggguggcucacagcaaggauguccaaguguugaggccccuaaccugguccuguccugcagggucaguucugugcucaaucgcaacagccggcaauuuggaaagaaacaucuuuuugaccaggaugaagagacgugcuggaacucugaccaggugaggugcuucuauaccccuucauuccaaguguagggguguagaagaugcaagguuacagggugccuugagaucucuggggagacuagaaagcacagugugcuuguacccuuccugugcuggccguggcagugacacuugaaagaugaacagacaaaaaacaaacaaacaaaaaaggcgggcagugguggcacacgccuuuaaucccagcacuugggaggcagaggcagguggaucucugaguucgaggccagccuggucuacaaagugaguuccaggacagccagagcuacacagagaaacccugucuuggggaaaaaaaaaagaaagaaagaugaacagaacaucauagggcccuaaccuugcaguuaccaagugccucaguuuaucccucugcuuccagggccccucccagugggugucacucgaguuuccccaguguguucagaucacacagcugcaggugcaguuccaggguggcuucuccagucgccacagcugccuggaagguacaagaaagcugagaggugggguguccacaggguucccuggauucuuagcccauuucuccauugcagguucacgggguggggaggcacucagcaagauuguagauuucuacccugaggacaccaaugcccuucagauauccugccugucuuguggugggagggaucugguuuucuacaagcuucaggucuuuggguguggugguaauggcacuggggaggcuggggcaggaggauccagaaugccaggccagcuuggaccagacccugucucaaaagaaucaaagcuuugaccuccuccgcaggaguaggaacugcuucucugugcuuuagugcccuggaggggcagcaggaagaucaggaguucaaggucagccucaacuacaguuugaggccagccuggguuaccugagacccccauauuuaaaagaaaaagaaaaaaaggugcuauugauuucuugcuggguaugagaaucaagagccuuuagucaguggcccaucggguggucucuggacugggaagguggggccugaugggucagagauaaaaccaccauuuccuugacugcaagaagucacaccuucuccauccccacaauggagguggaccgacugaaguugacuuuugaggacaccaccgacuuuuuuggccguguagucaucuaccaccugcgggugcugggugagaaggcagggugagaagcggcuauucuuccaggaagccccccugggaggcacccugaagaccuucaaguucugcacagauuuauugguuccuguugcggagggcucuucccaccacuguccaggagcugccuuucaagccaguugugggcugacugucccugagugccuggguucccagcaggcugucuucacucgggguccacaggccccagggugcucuggaacaaucugaggauguggcucuccaucaccuguugcacugugggaggaggugggaggaggggugagcugggggagccgggaagaagggacugaagaagaugcucagccucugauguaaacaggaggccgugagcaggaaacuguccagccaagugcuuuucugcuuuucuguucuugcugggcugggcucacuaccuugagaauagguugcuuuaaggcaagguuugccugucucccuucacuccuguaucccacccacccuccgaauuguagcucucucugccuccagaaccaugaguccaaauaaaauguuaaaaaaaaccaaac

SEQ ID NO: 4477 - RNA, 11325 nt, Mus musculus
cauucugucucuaauuggccaagauaccucagcgcuuccccgccuccagccucguaccgcugugcgcccagggagcggacauggugagcaggcccucugggauccccgggguggagaacggccuaacugagcugagaggguuccccaaaccgcgcgggcuauuuggaagugucguguagucaguggugcuggacgcguugggaggugaagcuagggcucuggacuggagugagggagcugggauugcagcuaucuuugcuuucugacagggucccauguagcccaaguuguacuagaacuuauucguagccuauggggaccucggacuucugauucuccuggcucuggagugcugagaugucaaacuugugccacuauucacggcuuucuguuugucuuuuaaaaucuuuuuuuauuuuucauuauuuuauuuauuuaaguaugaauguuuuguauguaugucugucuaccgugugugugugugugugugugugugugugugugugugugugugugugugugugugugugugugugugugcuguucuuagaggccagagaagacauguaggauucccugagaguggaguuagaaagggcugugagcugccaaauggaugcugggaauugaaccugugaccucuggaagagcaaucaguacucuuaagcccugagcuaucucucuagcgucccaguccuuuuauuuuuuucuauuuacccauuaaaaauuauuuacaaagggucuuacuuguugguguugaugggcagugauggcaaaugccuuuaaucuuagcacuugggaggcagaggcaggugaaucucugugaguucgaagcccgccuggucuacagagugaguucuaggacagccagggcuacacagagaaacccugucucaaaaaaauccaagcaaaauuguacaccaguacaccuggcugacagauuuuuauauugaucuguauuucauguuaauuggguaugaaagcagaaugcaggcaggcagcucuaguggcacacaguguauauaauuagauaauuacagaaaugagugcugugucggcgggagccugacuuagcuuccuucugaaagauuuguggagcugugcucugaacucuuccugggauggagagcuggcgucuaucauuugguagagugcuuaccuagcauggacggggcuccaccccugcacugcacaaacuggguguggguacacgcuaucacccuagcacucaggaaguggggacaggaggaccagcaguucagggucaccuucagcuguguucugagauccagaccagccugggcuauaggaaaucaaccuaucucuggccuucccuucuuuccuugguuucuuucuucuuucuuucugucuuguguuuguuuguuuguuuguuuguuuuguuuuguuuuauuuuguuuguuuuuuuuuucagauauuguuucuuuguguagcccuggcuguccuagaacucauucuauagacuaggcuggccucgaacuuggccaucuguuugcaccuguuucccaaaugugaggauuaaacccaagauuacacacccugccuggcaagaaacauccuuuagacaaauaguugggugugcugacucuggccuuuaaucccaacauuggugaaccagaggcagguagauuucuguaggucggaggccagccugaucuacccacauaggcacauccagagcucacaaagcaaacagaaguauucaggaaagggguucagggcucugcugguggaagcaggggucaggaccaggugagcugcuggggaugccuagggcgcugaagacagacucuggcucauacccacugacuucugagagauaccaccagagcccaaggcuggcccucuccacccacccaccugcucuauaaauaaccuguguuacgucagagcacuugagauuuucugacuagagcugccccuuuaggcgguccuuggagugcagcugguggugacucuguucaccgccacccucaugcacaggcuagcgccacacuguuccuucgcacgcuggcugcucugcaauggcagguaagggaauguucugcugccuguccugcugcaguggucccauggugcaugcuguuuguuccuuuuaaaaaucuccuccuucuccuccuccuccuccuccauuauguguagggguugucuccacgagugggguugugcacucauacacuggggcuggcguuacaguaguuaugagcugccugaugcggggauggagaacccagcccaggucaccuggaggugcucuuaaccccugagccauugcuucagccccgguuuugugguuuuuagacagagucucauacuguaguuccagcugcuugugaaaguguggcagucccucugccucagccucccauccgcauuucaaaacauuucuuuucaacuguguaugucacauugucacauguguaucugugugugguuugugccuuuccuaagugaaaguugccaguuauggaugguugugggcugcccagcaugguggguuggggguggggucauuugcaagaacagcaagcacuuuuaaccaacacugagccaucucucuagccgucuacacuuuuuuuuucccccaagauaggguuucucuguguagcccuggcuguccuggaacucacucuguagaccaggcuggccucgaacucagaaauccgccugucucugucucccaaguacugggauuaaaggugugugccgccaccgcccgucccaucuacacuuuuuaaacuuugauuuauucuuccuguuguguguguaauguuuaggugccugucuggcacuuguguggagucagguuguaagguuaguuuucacuuuccaccuuuaguagguugucuuagucaggguuucuuucuuucuuucuuuuuuuuuuuaaagaaguuuguuuguuuguuuguuuguuuuaaagauuuauuuauuuauuauauguaaguacacuguagcugucuucagacacuccagaagagggagucagaucucauuauggaugguugugagccaccaugugguugcugggauuugaacuccggaccuucggaagagcagucagugcucuuacccacugagccaucucaccagcccuuagucaggguuucuauuccugcacaaacaucaugacuaagaagcaguuggggaggaaaggguuuauucagcuuacacuuccacauugcuguucaucaccaaggaagucaggacuggaacucaagcaggucaggaagcaggagcugaugcagaggccacggagggauguuccuuacuggcuugcuuccccuggcuugcucagccugcucucuuauagaacccaagacuaccagcccagagauggcaccaaacuagccaguacaguaggccucagacaucgaacuccggccacagguuuuuaggcacggucuuggaacucacuuuguaaaccaggcucgccugaauucacagagcuccauccaucugccucggccuucugagagcagguaucuaaaguaugccccacuauugauguuuuguaauguggcggccuggugugcaggagagggugccuuagcgggcccaugagguaccagcuauaccaccaguuaguauaaaaugaggcacgggaaaggcguaagaagggauuggaggcagagaaagaaugggacagagaaggaaaaagagagaagagagaaagaagggaagaggagaauguggggagggggacagagagggagugggggagacacacacacacacacacacacacacacacacacacacacacacacacacacaugccuauaccuggcuguuggcuguugggcagagccuagaagaaaugccaacaacuaugccugaugucuugguucuuuuuuguuuuuuguuuuuaauuuauaugaauacacuguagcuaucugucucugacacaccagaagagggcaucagaugugagcuaccauguggcugcugggaauuaaacucaggaccucagccaucucuccagccccauccuuuggugucuuuaaaguacaccuuggaucugucuugacaacagagcucacccccaacuccccuccuccuggccuuuuguaauccagcuuucuccuauuuuuccuguuuuggugucuggccccuucugagaauacuguugagugguuucucuucagaaaaauggcuggggcaccagagagucagaccauagguuguccuugauucucgaggucccuguggcuugaucaguucccuucaucccauguucccagaauuaugcuagcucuggguacacccauguacccuggcucaucuuucuauagggcugcucccaccucagcucuaaccccccagcgcuggcccugcccccuccccuccagcucugcccccugcccuaacucugccaauguccagugaucuauuuucaaaaccagauucagguucuuugcaucauaccccuaggccaaucuuuccugaccucugccccacucaacccccagucuguuccgguacauacacccgucagaggaggaacuucgggcgcugucagggaaacugaggccccgggucaggaaggagcgguaagugguccccacuuugacuccauggggccccggcagggcuaugcccuccuguccagggaaaggccuuaucuugcccaagggcuccuggcuggggaacacggccuacccucgcccucacagcacugcugggcaugguggcagcaguuggcaucuuguuguacuccuggccauuugcuuggggccggcccugugucuaguuugcccucacaccugauguagcuaaagcucuuucccaagccaucaccgcccaagcuuucuaggagguccagagaugguugucgaccucagcucucacuuucccugugugcucaggugggcaaauggucuucaugacgagaagccauugucagugccucgagaugcccauuuccagcugcagaccuguccccucacugcuguggaugcccuagguaacacccagcccaguccccaguccccuccccagcugcuggggucauucugcccagggggaacucugaguggaaagagccuggaguaggugcugaggcuccugucccugcaguccugcgcuucuuucuggaauaccagugguucgucgacuucgcaguguacuccguugguguguaccucuucacagaggccuacuauuuugugcugggcccaguccaggagaccaacaucgcuguguucuggugccugcucacucuggccuucucucuguauccuucucuggcacuuagcaugugggugagugggacucaggcuccagcuucccugucccucuaacuugcugucuaugggaucacccacugugccauaaaccugucccagagucagaggaugcaggccauccugauuuugaacuccuggcucacccuccagcucucggugacaggugcucaucacuacacugcuacuguacacacagucugguuuucuuguacuggaaaaccaggaacaguuuccugggauuugguucaucuuuuuuuuuuuuuuuuuuuuuuuuuuugguuuguuuuuucuuuuuuugaguuuucgagagaggguuucucucugcaguccuggcuguccuggaacucacucuguagaccaggcuggccucgaacucagaaauccgccugccucugccucccgagugcugggauuaaaggcgugcaccaccacugcccggcgguuuguuuuuucaagacaggcuuucucugugucgcuguccuggaacucacucuguagaccaggcugacccuaaacucagacauccuccugccucugccugcugggguuagaguugcacaccaccacaucuuuuugcccaaaccuucugguauauacauugcaucaaaaagcaugucacaaggcuagcuuggcguuuggaaagcagaggcccagguaugguggggacccuaaucugagaaagcacagacccuuuaggggaucaucuggccgccaaguguucugaguauuagucuggggaaacaucucauaguugaaccuuaaccagggacugcaucuuaguagaguuuugagguuaacugauggaggcacugugugucuuuggcucuuaaauaguaaagccacacacagagcucugugcaagugaacuuggcugagaaaugguggugugccugagcaugcaggaggaggccccuggauuuacacacaagagguugggguucuaccucaagcacuguccccuaagggggaaagaaaaccugucucccaacuuuuccauagcuuucaaaugucacaucuacuugggcuuuucacugccccuccuucccuaagugcugcugccauagugauuucugauuggccagaggucauuaggccaccuccaaccaaacacuaguacccccagauccacaucccagguuuaaacugcaggcacucaaggccaguucgugcaggguugucugugcccuggagagggggucugaagagggcccagccuguccuuggcuuucuuaaccucaucccuaggaagguguuccucauggugacccggcuguacuucaguaccaaggagggcggugagcgcuccguaugucucuccuuugccuuccucuuccuccucuuggccaugcugguacagguggugcgggaggagacccuggagcugggccuggagccggguagguaugcuucucuguugagucccaggucacuuucuguuucuuuuucuuucucuuuuuuucccacucacucuguggcucuggcuggucucagacucacagagauccucauacuccugccucccaaguacuggggcuaagauuuaucuguuauuacuguuuucaaagauuugauuuuauucuauauguaugguguucugccaucaugugugucuguguaccuggauuguacaguaucuauaaaggccagaagagggcacuggaguugcaguggcuuaugagccauagugugggugggaaugugggccccaugaaagagcagcaagggcuccuuaccucugagccuucucaguagccuguguuuuuguuuguuuguuguuuuuaagauuuaguuuuuugggcucgcgagauggcucagcugguaagagcacugacugcucuuccgaaggucccgaguucaaaucccagcaaacacaugguggcucacaaccaccuguaaugagaucugacacccucuucuggugugccugaagacagcuacaguguacuuacauauaauaaauaaaucuugaaaaaaaaaagacuuaguuauuuuaugaaugugagugcuauaucuucaugcauaccagacgaggacacuggauccugcagaugguugugagccaccguguagguggguucuaggaacuggacucaaaaccucuggaaaagcaacuaguguucuuaaucguugagcuaucucucaagcaccccuguauuuuuucaagauuuauuuaaaauguuuaguguguguguguguguguguguguguacaugagugcaagugcuauuggagacuaaaagagaguauuggggggcuggugagauggcucaguggguuagagcacccgacugcucuuccgaagguccagaguucaaaucccagcaaccacaugguggcucacaaccauccauaacgagaucugacucccucuucuggagugucugaagacagcuacaauguacuuacauauaauaaauaaauuaauuaauuaaaagagagagagaauuggauaccccagagcuagaguuacauauaguugugaacaacccuacacagggauugggaaccaaacucagguccucuggaagagcguccagggccuucucugagcugucuccucagcccuaggcucuguuucuugaacaauccugcagagucuaguccuagcagggcucugugugcuucagagacaggcaccugcgcagcacauguggaagcccuggguuguaucccagcacaggagaauacagguaccauuagaacagguugucuggccuggggcuugggccagugugacagccucugcaagcaugaggacuucaguuugcacucauguaaaaaguagaaauugccugcccgugccuguaaacccuggcacuggggaggcagagacagguggaucugcaagcgggaaggccagucggccuagcuuuggaaaccauagcaauggacgccacuugauccucuccuuucccaggccuagccagcaugacccagcaccuggagccuauucugaagaagcaggauugggacuggacguaaguccuggggacuggaccuugggggugggugcagguagggggaauaucuaaaggcuaaauucugaccaguuguggguuuccugagaccaucucuucucuccagacucccugugaucaaguuggccauccgccuugggcuggcggugcuaggcucccugcugggcgccuuccucauuuucccuggccugaggcuggcccagacccaccaggacgcgcugacccugucugcggaccgaccacugcuacaguuaggcgggucucccaggguaggauuggaguugggcuagaggcugggggugaggagccugaucccacugagaugcuuguccccaggcugcuccuacacaccagcuuccugucaccccugugcaccuuguggcucuggacaaagccugucgcccgggacuuccuguaccaggcacccacaaggaacaugacuuucucugugugcguuuugggggcacugaggggccuggggugccugaggccauggccugggaaaggagggcucacccagacuuccugccugcuucacucuuguugcagaccgucagaaggggcuuucgacucucugcgccucuggguguugguggcgcugugccuguugcgccuggcaguaacccggccacaccugcaggccuaccugugccuggccaaggcucgaguggagcagcugcgcaaggaggcuggccgcauugaggcccgugaaauccagcagcggguaugcacccugggugggauggucccggugcugagggggccuagucgcagggucucugcccugggaagaccaccccuucuacaacccccacugucucccccguuaggugguccgggucuacugcuacgugacuguggugagccugcaguaccugaccccgcucauccucacucugcacugcacacugcugcucaagacccugggugaggggcuggugggaaagagcauggggccaggggguggggacagauuugauaaggguaggaucuucagauaaaaguggaggugggggguuuucuguucgagggcaaaguuggcaaguagagguggggacauggccggguaaggguggggcuagcagauaaaagugagggcaggguuugggaaaagcuacaguuaagacccauaggcagggagguuggaggcagggccaacagacaggggaggauggaggcccccuaaggccugcgggguguaaccuaggugugggcggggugugagagccucuagauucccaccauuaugucuccaccuauaauucucuucuucacuccugcaggaggcuacucuugggcccugagcucuacuccucccccacuggccccaucccagcccucagaggcuuugaucccuguagacccugcaggagaugaggcccagcagacugcagcccagguugcagggauccuggguggccugcucacgccccucuuccucagaggcaugcuggcuuacaucaucugguggacagcugccugccagcugcucuccagccucuucggccucuauuuccaccagcaccuggcagccucuuagcaggaaggcacuaggcucuagugucugauuccugcccaccaggauugggacuguucccugugugugugccuuggugccccuagaugacauaaggguugguguggggacucccuaccaucucucucacuucagugccuagaucauaaaccccuugaagcaaucuccccugggccaugauccccaaguguguguguguggagggggcacguuuuacagaaauaucccagagacugggggaugagcaggggagaccuggauagugagaggggccugggagagaguggaaaccucaagaucagagguggcuaggagagcuaggggugggacucuggcccagcauccauauagccccggcaucugucaguauccccaggagggagagacaguagucuccaugccugucuccccagcacacuuggggaagcugagguaagaggguuagccuagacuaguaacaagacuauguaaaacaagaagaaaaagggggccgggggaagcuugaaagggaagagagggaagagguugucaccauccuccaaagcugugaggaugacugcuguguuuugaggucuuggugacuaagggucaccuccaacuccaaaguuauuuuuuugcuaugacuuaguguguuuacguguguauuuaugagauaugugugaccuuccuacauauguaaaauguguauugagaauaaaaaaggagggcuucugcaaugcugccuuaccauggugccaguguggucuggcccagucauguucaagagccagugcucagucagagccuugagccucugggucucuguccaagaggacuuaggagugugacugccuaugugcugugaacacaggugcugugaacacaggugcuguguaugauacaauagguccaugugugagagcagggaucagaggacaacuuagcauguagauccuagccuucuacuaugagacagggucucuuguuuaccugagucccucaggucagcuguccaacaggcuccagggagucucugguuucugcuucccaccuugcuuguaggagugcuaggauuauagacuagugcugcugucccacuuuaugugggcucuggggacuugaacucaggucuucaugacugcagcaaauauggcugacguguguguuaugaaucaacaggauguccuugaagggcuaucuggagucccugccucccaaacugacccugacaagggcugcaggaccuuguggaagucucaugggaaucagggaugcccaugcucugcuguggauuucagaguguaggggcacacgacguacagggccccaccuccuucagcuacauggcucagggcugacugggccugagcuguguuucagagcaagguccuuaggcuucuggccgaugcccauuugcugagcaugauggaguauagcugaugacuccagagguaguugggccagccagugcuaugcaagaacuagaagccagcauggauuauauuucucagauauuaaauaaauccgagccauguuguuggcagauuuagcuacaugguuacuguau

SEQ ID NO: 4478 - RNA, 11325 nt, Mus musculus
auacaguaaccauguagcuaaaucugccaacaacauggcucggauuuauuuaauaucugagaaauauaauccaugcuggcuucuaguucuugcauagcacuggcuggcccaacuaccucuggagucaucagcuauacuccaucaugcucagcaaaugggcaucggccagaagccuaaggaccuugcucugaaacacagcucaggcccagucagcccugagccauguagcugaaggagguggggcccuguacgucgugugccccuacacucugaaauccacagcagagcaugggcaucccugauucccaugagacuuccacaagguccugcagcccuugucagggucaguuugggaggcagggacuccagauagcccuucaaggacauccuguugauucauaacacacacgucagccauauuugcugcagucaugaagaccugaguucaaguccccagagcccacauaaagugggacagcagcacuagucuauaauccuagcacuccuacaagcaaggugggaagcagaaaccagagacucccuggagccuguuggacagcugaccugagggacucagguaaacaagagacccugucucauaguagaaggcuaggaucuacaugcuaaguuguccucugaucccugcucucacacauggaccuauuguaucauacacagcaccuguguucacagcaccuguguucacagcacauaggcagucacacuccuaaguccucuuggacagagacccagaggcucaaggcucugacugagcacuggcucuugaacaugacugggccagaccacacuggcaccaugguaaggcagcauugcagaagcccuccuuuuuuauucucaauacacauuuuacauauguaggaaggucacacauaucucauaaauacacacguaaacacacuaagucauagcaaaaaaauaacuuuggaguuggaggugacccuuagucaccaagaccucaaaacacagcagucauccucacagcuuuggaggauggugacaaccucuucccucucuucccuuucaagcuucccccggcccccuuuuucuucuuguuuuacauagucuuguuacuagucuaggcuaacccucuuaccucagcuuccccaagugugcuggggagacaggcauggagacuacugucucucccuccuggggauacugacagaugccggggcuauauggaugcugggccagagucccaccccuagcucuccuagccaccucugaucuugagguuuccacucucucccaggccccucucacuauccaggucuccccugcucaucccccagucucugggauauuucuguaaaacgugcccccuccacacacacacacuuggggaucauggcccaggggagauugcuucaagggguuuaugaucuaggcacugaagugagagagaugguagggaguccccacaccaacccuuaugucaucuaggggcaccaaggcacacacacagggaacagucccaauccuggugggcaggaaucagacacuagagccuagugccuuccugcuaagaggcugccaggugcugguggaaauagaggccgaagaggcuggagagcagcuggcaggcagcuguccaccagaugauguaagccagcaugccucugaggaagaggggcgugagcaggccacccaggaucccugcaaccugggcugcagucugcugggccucaucuccugcagggucuacagggaucaaagccucugagggcugggauggggccagugggggaggaguagagcucagggcccaagaguagccuccugcaggagugaagaagagaauuauagguggagacauaauggugggaaucuagaggcucucacaccccgcccacaccuagguuacaccccgcaggccuuagggggccuccauccuccccugucuguuggcccugccuccaaccucccugccuaugggucuuaacuguagcuuuucccaaacccugcccucacuuuuaucugcuagccccacccuuacccggccauguccccaccucuacuugccaacuuugcccucgaacagaaaaccccccaccuccacuuuuaucugaagauccuacccuuaucaaaucuguccccacccccuggccccaugcucuuucccaccagccccucacccagggucuugagcagcagugugcagugcagagugaggaugagcggggucagguacugcaggcucaccacagucacguagcaguagacccggaccaccuaacgggggagacaguggggguuguagaagggguggucuucccagggcagagacccugcgacuaggcccccucagcaccgggaccaucccacccagggugcauacccgcugcuggauuucacgggccucaaugcggccagccuccuugcgcagcugcuccacucgagccuuggccaggcacagguaggccugcagguguggccggguuacugccaggcgcaacaggcacagcgccaccaacacccagaggcgcagagagucgaaagccccuucugacggucugcaacaagagugaagcaggcaggaagucugggugagcccuccuuucccaggccauggccucaggcaccccaggccccucagugcccccaaaacgcacacagagaaagucauguuccuugugggugccugguacaggaagucccgggcgacaggcuuuguccagagccacaaggugcacaggggugacaggaagcugguguguaggagcagccuggggacaagcaucucagugggaucaggcuccucacccccagccucuagcccaacuccaauccuacccugggagacccgccuaacuguagcaguggucgguccgcagacagggucagcgcguccuggugggucugggccagccucaggccagggaaaaugaggaaggcgcccagcagggagccuagcaccgccagcccaaggcggauggccaacuugaucacagggagucuggagagaagagauggucucaggaaacccacaacuggucagaauuuagccuuuagauauucccccuaccugcacccacccccaagguccaguccccaggacuuacguccagucccaauccugcuucuucagaauaggcuccaggugcugggucaugcuggcuaggccugggaaaggagaggaucaaguggcguccauugcuaugguuuccaaagcuaggccgacuggccuucccgcuugcagauccaccugucucugccuccccagugccaggguuuacaggcacgggcaggcaauuucuacuuuuuacaugagugcaaacugaaguccucaugcuugcagaggcugucacacuggcccaagccccaggccagacaaccuguucuaaugguaccuguauucuccugugcugggauacaacccagggcuuccacaugugcugcgcaggugccugucucugaagcacacagagcccugcuaggacuagacucugcaggauuguucaagaaacagagccuagggcugaggagacagcucagagaaggcccuggacgcucuuccagaggaccugaguuugguucccaaucccuguguaggguuguucacaacuauauguaacucuagcucugggguauccaauucucucucucuuuuaauuaauuaauuuauuuauuauauguaaguacauuguagcugucuucagacacuccagaagagggagucagaucucguuauggaugguugugagccaccaugugguugcugggauuugaacucuggaccuucggaagagcagucgggugcucuaacccacugagccaucucaccagccccccaauacucucuuuuagucuccaauagcacuugcacucauguacacacacacacacacacacacacacuaaacauuuuaaauaaaucuugaaaaaauacaggggugcuugagagauagcucaacgauuaagaacacuaguugcuuuuccagagguuuugaguccaguuccuagaacccaccuacacgguggcucacaaccaucugcaggauccaguguccucgucugguaugcaugaagauauagcacucacauucauaaaauaacuaagucuuuuuuuuuucaagauuuauuuauuauauguaaguacacuguagcugucuucaggcacaccagaagagggugucagaucucauuacaggugguugugagccaccauguguuugcugggauuugaacucgggaccuucggaagagcagucagugcucuuaccagcugagccaucucgcgagcccaaaaaacuaaaucuuaaaaacaacaaacaaacaaaaacacaggcuacugagaaggcucagagguaaggagcccuugcugcucuuucauggggcccacauucccacccacacuauggcucauaagccacugcaacuccagugcccucuucuggccuuuauagauacuguacaauccagguacacagacacacaugauggcagaacaccauacauauagaauaaaaucaaaucuuugaaaacaguaauaacagauaaaucuuagccccaguacuugggaggcaggaguaugaggaucucugugagucugagaccagccagagccacagagugagugggaaaaaaagagaaagaaaaagaaacagaaagugaccugggacucaacagagaagcauaccuacccggcuccaggcccagcuccagggucuccucccgcaccaccuguaccagcauggccaagaggaggaagaggaaggcaaaggagagacauacggagcgcucaccgcccuccuugguacugaaguacagccgggucaccaugaggaacaccuuccuagggaugagguuaagaaagccaaggacaggcugggcccucuucagacccccucuccagggcacagacaacccugcacgaacuggccuugagugccugcaguuuaaaccugggauguggaucuggggguacuaguguuugguuggagguggccuaaugaccucuggccaaucagaaaucacuauggcagcagcacuuagggaaggaggggcagugaaaagcccaaguagaugugacauuugaaagcuauggaaaaguugggagacagguuuucuuucccccuuaggggacagugcuugagguagaaccccaaccucuuguguguaaauccaggggccuccuccugcaugcucaggcacaccaccauuucucagccaaguucacuugcacagagcucuguguguggcuuuacuauuuaagagccaaagacacacagugccuccaucaguuaaccucaaaacucuacuaagaugcagucccugguuaagguucaacuaugagauguuuccccagacuaauacucagaacacuuggcggccagaugauccccuaaagggucugugcuuucucagauuaggguccccaccauaccugggccucugcuuuccaaacgccaagcuagccuugugacaugcuuuuugaugcaauguauauaccagaagguuugggcaaaaagaugugguggugugcaacucuaaccccagcaggcagaggcaggaggaugucugaguuuagggucagccuggucuacagagugaguuccaggacagcgacacagagaaagccugucuugaaaaaacaaaccgccgggcagugguggugcacgccuuuaaucccagcacucgggaggcagaggcaggcggauuucugaguucgaggccagccuggucuacagagugaguuccaggacagccaggacugcagagagaaacccucucucgaaaacucaaaaaaagaaaaaacaaaccaaaaaaaaaaaaaaaaaaaaaaaaaaagaugaaccaaaucccaggaaacuguuccugguuuuccaguacaagaaaaccagacuguguguacaguagcaguguagugaugagcaccugucaccgagagcuggagggugagccaggaguucaaaaucaggauggccugcauccucugacucugggacagguuuauggcacagugggugaucccauagacagcaaguuagagggacagggaagcuggagccugagucccacucacccacaugcuaagugccagagaaggauacagagagaaggccagagugagcaggcaccagaacacagcgauguuggucuccuggacugggcccagcacaaaauaguaggccucugugaagagguacacaccaacggaguacacugcgaagucgacgaaccacugguauuccagaaagaagcgcaggacugcagggacaggagccucagcaccuacuccaggcucuuuccacucagaguucccccugggcagaaugaccccagcagcuggggaggggacuggggacugggcuggguguuaccuagggcauccacagcagugaggggacaggucugcagcuggaaaugggcaucucgaggcacugacaauggcuucucgucaugaagaccauuugcccaccugagcacacagggaaagugagagcugaggucgacaaccaucucuggaccuccuagaaagcuugggcggugauggcuugggaaagagcuuuagcuacaucaggugugagggcaaacuagacacagggccggccccaagcaaauggccaggaguacaacaagaugccaacugcugccaccaugcccagcagugcugugagggcgaggguaggccguguuccccagccaggagcccuugggcaagauaaggccuuucccuggacaggagggcauagcccugccggggccccauggagucaaaguggggaccacuuaccgcuccuuccugacccggggccucaguuucccugacagcgcccgaaguuccuccucugacggguguauguaccggaacagacuggggguugaguggggcagaggucaggaaagauuggccuagggguaugaugcaaagaaccugaaucugguuuugaaaauagaucacuggacauuggcagaguuagggcagggggcagagcuggaggggagggggcagggccagcgcugggggguuagagcugaggugggagcagcccuauagaaagaugagccaggguacauggguguacccagagcuagcauaauucugggaacaugggaugaagggaacugaucaagccacagggaccucgagaaucaaggacaaccuauggucugacucucuggugccccagccauuuuucugaagagaaaccacucaacaguauucucagaaggggccagacaccaaaacaggaaaaauaggagaaagcuggauuacaaaaggccaggaggaggggaguugggggugagcucuguugucaagacagauccaagguguacuuuaaagacaccaaaggauggggcuggagagauggcugagguccugaguuuaauucccagcagccacaugguagcucacaucugaugcccucuucuggugugucagagacagauagcuacaguguauucauauaaauuaaaaacaaaaaacaaaaaagaaccaagacaucaggcauaguuguuggcauuucuucuaggcucugcccaacagccaacagccagguauaggcaugugugugugugugugugugugugugugugugugugugugugugugugugugucucccccacucccucucugucccccuccccacauucuccucuucccuucuuucucucuucucucuuuuuccuucucugucccauucuuucucugccuccaaucccuucuuacgccuuucccgugccucauuuuauacuaacuggugguauagcugguaccucaugggcccgcuaaggcacccucuccugcacaccaggccgccacauuacaaaacaucaauaguggggcauacuuuagauaccugcucucagaaggccgaggcagauggauggagcucugugaauucaggcgagccugguuuacaaagugaguuccaagaccgugccuaaaaaccuguggccggaguucgaugucugaggccuacuguacuggcuaguuuggugccaucucugggcugguagucuuggguucuauaagagagcaggcugagcaagccaggggaagcaagccaguaaggaacaucccuccguggccucugcaucagcuccugcuuccugaccugcuugaguuccaguccugacuuccuuggugaugaacagcaauguggaaguguaagcugaauaaacccuuuccuccccaacugcuucuuagucaugauguuugugcaggaauagaaacccugacuaagggcuggugagauggcucaguggguaagagcacugacugcucuuccgaagguccggaguucaaaucccagcaaccacaugguggcucacaaccauccauaaugagaucugacucccucuucuggagugucugaagacagcuacaguguacuuacauauaauaaauaaauaaaucuuuaaaacaaacaaacaaacaaacaaacuucuuuaaaaaaaaaaagaaagaaagaaagaaacccugacuaagacaaccuacuaaagguggaaagugaaaacuaaccuuacaaccugacuccacacaagugccagacaggcaccuaaacauuacacacacaacaggaagaauaaaucaaaguuuaaaaaguguagaugggacgggcgguggcggcacacaccuuuaaucccaguacuugggagacagagacaggcggauuucugaguucgaggccagccuggucuacagagugaguuccaggacagccagggcuacacagagaaacccuaucuugggggaaaaaaaaaguguagacggcuagagagauggcucaguguugguuaaaagugcuugcuguucuugcaaaugaccccacccccaacccaccaugcugggcagcccacaaccauccauaacuggcaacuuucacuuaggaaaggcacaaaccacacacagauacacaugugacaaugugacauacacaguugaaaagaaauguuuugaaaugcggaugggaggcugaggcagagggacugccacacuuucacaagcagcuggaacuacaguaugagacucugucuaaaaaccacaaaaccggggcugaagcaauggcucagggguuaagagcaccuccaggugaccugggcuggguucuccauccccgcaucaggcagcucauaacuacuguaacgccagccccaguguaugagugcacaaccccacucguggagacaaccccuacacauaauggaggaggaggaggaggagaaggaggagauuuuuaaaaggaacaaacagcaugcaccaugggaccacugcagcaggacaggcagcagaacauucccuuaccugccauugcagagcagccagcgugcgaaggaacaguguggcgcuagccugugcaugaggguggcggugaacagagucaccaccagcugcacuccaaggaccgccuaaaggggcagcucuagucagaaaaucucaagugcucugacguaacacagguuauuuauagagcagguggguggguggagagggccagccuugggcucuggugguaucucucagaagucaguggguaugagccagagucugucuucagcgcccuaggcauccccagcagcucaccugguccugaccccugcuuccaccagcagagcccugaaccccuuuccugaauacuucuguuugcuuugugagcucuggaugugccuauguggguagaucaggcuggccuccgaccuacagaaaucuaccugccucugguucaccaauguugggauuaaaggccagagucagcacacccaacuauuugucuaaaggauguuucuugccaggcaggguguguaaucuuggguuuaauccucacauuugggaaacaggugcaaacagauggccaaguucgaggccagccuagucuauagaaugaguucuaggacagccagggcuacacaaagaaacaauaucugaaaaaaaaaacaaacaaaauaaaacaaaacaaaacaaacaaacaaacaaacaaacacaagacagaaagaaagaagaaagaaaccaaggaaagaagggaaggccagagauagguugauuuccuauagcccaggcuggucuggaucucagaacacagcugaaggugacccugaacugcugguccuccuguccccacuuccugagugcuagggugauagcguguacccacacccaguuugugcagugcagggguggagccccguccaugcuagguaagcacucuaccaaaugauagacgccagcucuccaucccaggaagaguucagagcacagcuccacaaaucuuucagaaggaagcuaagucaggcucccgccgacacagcacucauuucuguaauuaucuaauuauauacacugugugccacuagagcugccugccugcauucugcuuucauacccaauuaacaugaaauacagaucaauauaaaaaucugucagccagguguacugguguacaauuuugcuuggauuuuuuugagacaggguuucucuguguagcccuggcuguccuagaacucacucuguagaccaggcgggcuucgaacucacagagauucaccugccucugccucccaagugcuaagauuaaaggcauuugccaucacugcccaucaacaccaacaaguaagacccuuuguaaauaauuuuuaauggguaaauagaaaaaaauaaaaggacugggacgcuagagagauagcucagggcuuaagaguacugauugcucuuccagaggucacagguucaauucccagcauccauuuggcagcucacagcccuuucuaacuccacucucagggaauccuacaugucuucucuggccucuaagaacagcacacacacacacacacacacacacacacacacacacacacacacacacacacacacacacacacacacgguagacagacauacauacaaaacauucauacuuaaauaaauaaaauaaugaaaaauaaaaaaagauuuuaaaagacaaacagaaagccgugaauaguggcacaaguuugacaucucagcacuccagagccaggagaaucagaaguccgagguccccauaggcuacgaauaaguucuaguacaacuugggcuacaugggacccugucagaaagcaaagauagcugcaaucccagcucccucacuccaguccagagcccuagcuucaccucccaacgcguccagcaccacugacuacacgacacuuccaaauagcccgcgcgguuuggggaacccucucagcucaguuaggccguucuccaccccggggaucccagagggccugcucaccauguccgcucccugggcgcacagcgguacgaggcuggaggcggggaagcgcugagguaucuuggccaauuagagacagaaug

SEQ ID NO: 4479 - RNA, 11940 nt, Mus musculus
acagggaggcaggggcaagccaucacacuggugacgcaguaugauauccaccuguugcaugccaucgaggagcagaucaguaaguggguaggguccaggguggguccuguccaagccugggagaugaauuccucucccuagcuuaccuuacccugggauaucuauuccaguacucacccugaaaaugcacccugcacacaggacgccaacccugaaggucccugugugguuuggagguugacaaggacaugaguucucaggcaggcccuacaaccuacguuaaacagccaccaaggcgggccaucuggagcuccuuguagaagcucuuucaguuuaacucacaguggccugaagaccugugcucacaaugcagagccugucucagccucucagggagccagaucucacuucauuuacuuguucauuuguuuauucagucauuaauuugagacagauucuugcucuacagagcuggccuggaacucagcuggaacgagugaucccccugccuccaaccucccagugcugugaugacaagcaugugcugccaagcuuggcagcauuuugcuuuuucuaaauaucaucaguccacauuugguuggauccagacauccagagcugggggugcagagggcugguugcacucccagcccaacucaguguuuccugucccugcagagcagcagcuggcagagcuggugguggaggaggcugagguucuacaaauccucacgcaggucaacguagugcgaagggagugcgaaauaguaaguguggccagccugucaggguaggguggaguggggugaggugggcggggcuuccugccccaggccugacugaccuguuccccuccccaccccuagaaacuggaggcuucgcauuuugaugaaaagaaagagaucaacaagcggaaacagaugauccuggaggggaagguaguauagggaggcauggguaugcagggacaggcauaagaguguggccaguaagggugggugggaccuggggucggguaggggugggggagccagucccugggaagcugcccaguuacauucucagcucccuuccgcaggacccagaccuggaggccaaacgcaaagcugagcuggccaagaucaagcaacaaaaccgacgcuucaaggagaaaguggggcagacacuucggcggcagaaagcagggagcacuguccgacggucgcguccucccagaucucggccccaagagccagcccaggcugaggcucaggacugagcuguaaaccuggugcugguggccccugacuucaguaaacacucuuugaaguugucagucugacuugagaauggggugggaugaguacagggccuucaggucucaggaucccaaagccucuguugccccauggggaugacuagugcagccuucccucgcagugucccuggggcgcagggcagcagcagccagggacagcaacgccacacguagaaauguaaccuggguagaagcacugcccaaggauucuagaaaacucuacacagugcaaagcucagagacagcugggguccccuggccccugccagggcgccuugaggccgcagacacuccauggcagacuagggugcugccucugccaggcgugccaggccuucacgcagcucgcugagcucaaacagccgaacauccagcagcugcgcagcccggcccaccuccgcccgugcgcgcucccgcucggcccgcgccuccuccagguugcacuccaucgaccgcagcugcugcuccagcucugcauuccgggucuccagguccuacacggggaagacggggugggguggaagcucugguugccaguuauggcugauguggcccauggcucucaccgggucaguaaagugccauuaaagugugaaguacugaguuuggaauccaauagcuacauacaaagcauggcuggcaagcauuuguaaucccacugcugggaagacaggcaggauuccuagagcauacuggacaaccuaagcauccccaggccaguaagagacacuguuucuuccuauucuuuuauuuuuuuuuugauuuuuuuuuuuuggagauaggguuucuuuguguagcccuggaacucacucuguagaccaggcuggcuucaaacucagaaauccugccucugccaccuaagugcagggauuaagggcaugcacugccacugccuggcuagagacccuguuucuaaaaacaagauggacuguagagaugggucaguggguaagaguaugaacuucuccagaagaccugaguucacuuccaagcacugguguacaauaccacacauguaacuaaaucuuaaagcuacaugcacugcaugucucacaggccuuuaacccagcacucgggaagcugcugcuagagacacagucaguaugaaaaacaaaaaccccaagaugaagguuuaauccccaguacccacaugauagaaggagggaagaaugcuuaauagcaugcucuggagccaagcacuuuuaaugaagugggcaguggaacuaaagagaugguuaccugagggcccugaauuucaguugccuuucacccacacauaaucuaaugcccacagccacugccagcagcuguaaccucagggugggagagcagggucccacuguugauugacucagcacccagccauucugguaguaagauagucucaaaggauggugugcaaagaaacugaggaagacagcagcuccagcuuccauacacaugcaugcgcaucuguacccacaugggauguauguaugcacauacacuauacacaaaaacccaugauaggugguaccugggugacauauaaaugcauagaacaggcuuccuguagauucucucccugggaauacaguccugugaccaggagggccaaugauucugggguccugggccuuugcacaaucugcucccgcccucgaagacaacagggucaucuccccaggacauuccuggagaugcuccagauacucuuggcugaggucucuggaaguuucccugggaccuuagacugcucagaugugggaagacuaaguaugagguugcuuagcaacuuuaaguagacagcccuauuccacucgcaggcagaugggaccuguucuaccccagggggucacucuuacagcugagguccugcagccaaccugaacuugcugcugugucucuucgcgcucggcagugucuggagccucucgggugccagugcucugauucuucaaagucuggaucuccuggagaagaaggugucccagguguccucagaggcccuggauucccgaggagaguacgacacgaucccuaagcuugccccuggcucaccugguccuuggucugcacccgagccuccagcugcuccaccgacuggcugguugcuucuuucucuccugcccggacuggcucuacagccaccugggccuccagcucugcuaccugcacacaugcaacccagugguccuaccauccucugggacaugaagggccugaugaccccuaugaagcucucacaguuucaaaucauuuuacagcaagaaauggccugcuggggacugauggguagaagggauguggggugagggguccucacccgcugccucaagaguucagccucugcacguuggaccuccaguuguugccuccacugaguggccgcugcguuggccucccgaagggcucccgccaaccucugguugcuguccugaagcgcgaagaacucugccucccacuggaccuccccuacagagcuggagggaagacaccgggcugggggugugcauggucaggacaguggcaucuggaggaggcuauccuggacuaagcagggccaaagcaacacuaagccagggagugggaccaugaaaccacauguggaguuguggcucaucagaggccgagacaggagaauccccuuaggaacaaugucagccuaggcuauguauaaugaguucugggauauauaacaggacccuaccuccaaaaauauuuggaagccuaucccugcccuccagauugccaugaaagcaaugggggguggggagaggggucaggcccauggucaaaagagauggggguaugaaugaugaggaaagugcagccuccuuuccagaagaggcaggaaccucucccaggucuguaguuuccuacaucccccacaggucucaccucgaugaccacgcccauccuacugcccacgucccuuaccucuugcaggacccugaccccagaaaaaccauccuaauggucuauccuggggauguccuacccuaucacacuccuuuagugacaaucaagacccugacacuugcugggcagugguggcgcaugccuuuaaucccagcacuugggaggcagaggcaggcgaauuucugaguucgaggccagccugggcuacagagugaguuccaggacagccagagcuacacagagaaacccugucucgaaaaaacaaaaaacaaaacaaaacaaaagacccugacacuagaaaccacccgaaaguucagucugaacacaagacaccccuuaggccccugccaugcccaucuggcuucaugcaggcuccaccaacuacaccacucacccuucugacagcaucuucuucaaccguucccgcucgguggggccagggguguccgcacucuggcuacggaacagcuuuuccucgccuggaccauuggugcugaccaaggggcuuggaggaaccugugcaugggagccaggacugggucacggugggcauuugcuucagucaaggucaugguaggaaguaaaguugauugaagccacugggguauugaggucagggagucugaacugacccccgaugaccagugugucucuuuccucacuggugcuccauaucuccccagaaccucuggauagggaauccugucccccaccugccuggugucccucagggccaaaucagaacagccuacagaaacagggaucugaacacuuggaacugcucucccucagguaaaauugaggcaugggccagcggaagggcuagucaccaagccugaugccccgcugaaagaagagaacugacgcccacaaguuauccucagagcuccacaugugcacccaggcacacgcacaugugugcacacgugcauaaaugugguuaggccaccagccauccuuagacacuaauacagugcauggccccugauaucagaagcauauauggcugccucaggggugugguagucaugggguacuguaagacauggggugcaggaacaccuaccugaugggaggcaagggccaggccaguacuagugaauucuccaccaucuugagauuucucucgagccagccuggcagcuucuuucaccuccugaaacuucucagcaaacugggggugaggcagggggauagucagaaagcauuuuccaugucucacaucacacucccaaccugcaccuguccugucauccugagaagagucaacccugugggcaucucaggugucaggaugacacauagagggggguuuagcaaauuacagaggugacauuaaaaaguucugagcugcugggcggugguggugcacgccuuuaaucccagcacuugggaggcagaggcgggcagauuucugaguucgaggccagccuggucuacagagugaguuccaggacagccagggcuacacagagaaacccugucucaaaccucccccccccggcaccccccaaaaaaguucugagccacacuuucugggacuuucuguucuguugggcugaguggccagccugaggcuaguugcccaucuguccuucacaccugccaguauguccuaacacaggaaagacauccacaggcagcgagaggcugcgucuucuggcaucccuuucucccaaggcugucagcugacagcuaaugcugguuccgaguuuaugauaaugcgggguuuuuuuuucucacuuuaacauaauuuuuguuucuuauaaagaccgugagaugucuggagccgcacuccacaguuaggagagcagacugcugucauugaggagcuacauaaggucacacaacaccucaggcaacuaacacacaacugccugugaccagcuccagggauccaauggccucugcagggcaucugcacgcacauacacacaggcacgacauguauauacauaaauuuuuuuuaaaaaagcaaaaaaagcugggcauggugauguaugccuuuaaucccagcacuugggaggcagaggcaggcgaauuucugaguucgaggccagccuggucuacagaaugcguuccaggacagccagggcuacacagagaaacccugucucaaaaaaacaaaaauaaauaaauaaauaaauaaauaaauaaauaaauaaagccaggcaucaguggugcacaccuuuaaucccagcacugaggaggcagaggcaggaggaucucugaguuuggugccagccugaucuacacagcaaauuccaggacagcaaaaacuacacagugaacccuggcuugaaaaaccaaaacaaaaaaacaaaaaccaggaggcuagugagcuggcuccauaccauaugcuugauaugagccugaggacauaaauuugguccuuggaaccuacagacucccacugcacauggggaccuacacaggcacagcccagaaacaagaaaucaauagaauagaaacuuuaaaagaaaacuuguuuauaaauuuauuuuuauuacuguuaauuguguauauaagugcccccagaaaccagaggcaucgaauccccuccaugggguuacagaagguagugggcccgccaugugggggcuggaaacugaacucacugccugcaagagcagcacuugcucuuagccccugauccaucucccacccccacaguguuuaagcugcacccuucggugugcugcugccccguaagccccugaggcucagacaggcagauuagaaauucaagguuagccucaguuauaaugugagucugagaccagccuugucuacauagcaaguucuagaccagccagggcuauagaguaagacccccacuacccacaaaaaugaaaaauagaaaaagaaaauaauuuuuaaaaaacuucuuuuauuugacauguagccauguuuuuccugcaugucucccugggcaccacguuugugccugguacccuugggagccagaggugucaaauguccuggaauugaagacacagauggcugugagucaccaugggaauugaaccugggucuucugcaagagcagccagugcucuuaaucacaaagccagcucuccaggcccggaaaguauuacuuuuuaaccaggcaagggcuaauucuagucaccaggaagucugacauaggauugcuagaggccagagagaccuuaaauaaacaacuaaucaggggugguggcacacaccugugagcuagcacucuaguggcagaaggacuguggagagugacagugaaacccugccuaaaacuuaaaagacaaaacaaagcaaaaacaaagccaggcaggugugguggcacaggccuucaaucccaguacucaggagacagaggcagguggaucucugaguccaaagccauccuggucuacaaagcaaguuucaggacaaccagagaaacacaggaaaaacccugucuagaaacacucccucgccaccccaccccacccccggccccaaauaaaauaaaaaauaauaggggucuggagagauggcucuggcucagugauuaggagcacgggccgcucuucuagaggacccagggucuguucccagcacucacauggcgucacucaacugucuguaauuccaucucuaggggaucuggcgcccucuacuggccuccaccggcacagugcauacacaugcaaguacacauagauacauggaagcaaaagacuuacauacauaaaaaauauuaaauaacaacaacaaaaaaaucaaaagcuggccaugguggcacacagucuuaguccuagcacuuaggaggcagaagcagguggaucucugaguucgaggccagccuggucuacagagugaauuccauguauuccauuucuauguagagcuacauagaaaaccaaaacaaagcaaaacaaauuugcggcuacauuguggcccagugagagccaaggugcuccauucuuagagcccaaauaauagacagauagccagcccaguccucugucuccauaggcacacccauacacauuuacaccaaagcaaauaaaaaaggaaucuuuuuuuuuuuaauuaaaaaaauuugaggagcuagagagaugccucaguagcuaagaaugcuucuaaaagacgugaguucagcucccagcaccuaugucaggagccuuaaccauggcccguuccuccugcuccaggagaucugaugucccccucugaccucuggagguaucagcacacacauggccugugcacauacaaaugcaugcaaaugcacacaaacgcauacaaauauaucugaaaaagauaauggccucauuacuaaguagugauguuagaaguuggagagaggugcagcgggggcaggggaugugcccaguccaggcuuccacccaaagcugcugagagguuugagggguugaagcaaguuggcaaaugaccacagcacccagggcacucaagaaggccugucacccaucagcccacccugaggaacacagaugccaaccacugcccaugucucugcccaccugggucagcugcuguucagaggcaaagccuaggccguagacaguguuggcucgacugucugcccauugcccgaacuucugagagguuuuggugaaggucauguugggagugacagugcuguugaugauggccuagaggugggggaagcaagauuccaggucagaagauaaugagcgccaggagcaacuagccugacagacugcuggagaaggagcauucaaguugaagacuacacacuggaguuaaaaauuaaaaaaggaacucuaggcaucugucuuaguagcuaaucccuaccuaggaucccccagugaggagcuaucggaaggcauacagguggagccccugccuagaaucccccagugaagggcugcaguagaacucuugucccuucucggagaccccaccacugaguuauuucuggaagacguuaggucugggaaaggaucguugauucccaagucacccagccuggcugguggcugcacaccugcccccaaaccccugcucagaccuuggcacccccgaugcugaugaugcgguacacauuucggguugcaucauagaaauaggacacgguaagugcgugcuugccggcggggauccaguuccgcuuuguaguggggucgaucuggaauacgugcgcccgggugcugaagauuggcuguucccuacagcagggacagaaacucugcaggagucugaugccacccaggggcaaggccagaccagagugggugagugcucaccuggcuguggacauuggucagguugggcuggauggccucuaaggggcacccagaggggugacaggagucacuuguuuguccccuagggaaagaagaagauugugaguaaggcuccaaggauacucaggccaaguggguccuccaggugacuucacaaaaccagcgaggcaggaaaggagcagcugcuggucagacacccacuuccucagucccagcccagacuggccuugaaaucacuuugcagccaacagcaaccuugaacucuugauccucuggccuccaccuccuaaaugcugggacggcagcuugugccaucauucuugguucauguggugcugaggauggagcccagagcauccugcaucccaugcaagcucucuaucaacugagcuguaggcauaaacaaaaggcccugcuuuugggagaagcccccacaacuggacugagugaucucuagaucucuagugucaccagagaggugauacagugccaccaaacugcaaggguagguaggauauggcuuggagaauagccugguuguuggcacgcaggauuauacucacuguccagguuacccaccacugggcaaguguccucccacaggaacugaacaugaggucaagaucaaccgaguggaacaucucauucauccccucccauccaacagccccccucuccucccagagggccuugcaucaaaaugugggacaaagcuggauccguggugaggcccugugguuuuaucuaucugaaagccaaggcgguuagaucaugcaucccaggaguucaaggccucccuggucaucauggagggauaaacccaucucaaggaguaaaaguggagugcuuccagggaccuaacaggaaaaucaggaccucgcugaucccacaaauggaccacuucggggcugaagagaugguucaguggguaagagcacugacugcucuuccagagguccugaguucaauucccagcaaccacauaguggcucauagccaucuguaaugggauuggaugcccuguucugaugugucugaagacagcuacaguguacuuguauaaauaaaauaaauaacucuaggaaggaagggagggagggagggagggagggagggagagagagagagaggagagagagagagagagagagagagagagagagagagagagagagagagagagagagagagagagagagagagagagagagagagaggagagagagagaaaggaccacuuagcccagauaacucugugucugagucuccagggagcuuacuuaaaaggaaaaaaugaaagccugguaugguggcaccagcacuggggagaaugaggagacuuugaagccaaccugggcuacagagugggaccaugucucaacgcacaggcacacacacacacacaagcacgcauugcacacagcgguucauccuaguccccaccaugugaacagggaacaggaccgggagaacggagcuccccagccuccuaugaacgcuugcaccugucauucuccuaagucccccaaauuucaacuaaggagauuggaggagaaggaggguccugcgggugcgggaggucaagacccggggucugaggucagggccccuccaagcugucuugggaagcugcgaaaccuaaguucccauacagagggaggguagggggguuguccagucagagacgcuaauggaacuggcggagauugggggaaagggguccccgaacccaggcccuuccggucggaccacuccugccuggacuugccaccaucaggaaaaguuacucacugaguagucacgcgccuuggagcagaggcgcggggcggagaaccgcgaucgcgcgcggcggggacccugccaggagccccacgccggcuucccauuuggcaccgguucccacucccuccagggcagcucgugagggcaacuacgggagccgcugacccgcaacuucuaaguggcggagccucgcgaugcggcguccccaacacccggaccucggcugaggaacccggugaagacgcgccccgcgccccagccagcaccugagccggcccccuagccggcaccccaggaucccaaccccucagccugcaccccgcagcuccugggccccgccucacaguccgcaacuuuggaaaccgucugcguuuccugcgcccccgacucccugauugugccucggaagcuggggucccccugucuggcucaccccgcgucgucgucgcugcagccuccggcccgcgcccuccgcgcgccccgcgccgcccgcgccuuugucugcgccgccuccggucccaucgcggccaguccccgcgccgccccgccucugcccagcgcccccugcuggccagcuacggagggcggggaagagggaggggaccccgagagggaagaagaggagggcggacauggaggggggaguugggcggggugaaagggcagaggaaggggagggcaccaggaggucaagaggaggaacuucug

SEQ ID NO: 4480 - RNA, 9757 nt, Mus musculus
gcauucacgcgccggaagcacucauuucuagguucucugcccgggucuggagcauggcgggguucgcugagaucggguugucgucguggcugguagaacagugucgacagcugggguugaagcagcccacgccggugcagcucgggugcauuccggccauccuggaaggugaguucucgccuuucuuuuaaugccuuucuuugcccgcucuuccuuagccccacuuggguuccaggaaucaggacagcauugaguguuucggggacccugacccgcagcauugacauuuacgcugcgaccgacucguguucauuaucacacaggugauggguggcaccucuuaaguuuucguagcacccgagcauagggagagaucggugaaugacuaaaacauggcacugaaaaaaaaaaaggguagagcuggcuuugacguagaagccgucaaacuccagguaaaaaccaaugcuccguguuugugucagugcucuucgacccaguucacuuuugccauuaaagaggcguccuuggagccggacguggugacucucagucaucucaauacugagcagguggaagcaagaggaucaggaguucaaggugauccucaguuugguagcaaguugcagaccagccugggcuaccugaaaauuuguuucaaacaagcaauuauaauaauuguuggaaauuagauaauaacacguucaagggacuaguggaaaugaaacaguuuuaaauauucaauucuggagaaagggguaccagcauagagaaaaggcaaaaauagcugguguggugauuucaagcaaguuuuugaagccuuuccccaaauaugggaaauuccugaccuuuucuuccauagaccugcagggcuuuuccccuccccaaauuccccaucccauugguccauuggggccccaagucuucucuaaugaauaguuugggucuugaggcugccucucuucuauucucuuuucuuucuuuuuuuuuucccuuguuuuuuuguuuuuuugagacaggguuucucuguauagcccuggcuguccuggaacucacucuguagaacaggcuggccuugaacucagaaaucugccugccucugccucccaagugcugaaauuaaaggugugcgccacuacugccuggcugcccuuccuuucuaaucaugggcucagucacauagcagagcaccuguaacucuccgagucuuagacuaacuaggggagagaaggacccagugccuccaacucaucuguagcucuagugaacuguaagcucaccucguacuaaaagcagaccauacccaucuauuucuuacaauaaugagggaaugcccaagggaccaaucauggcccuugcuccacacugaugcugcuuugccaucugccuaggucgggacugcuugggcugugcaaaaacaggaaguggcaagacagcagccuuugugcuucccaucuugcagaagcugucugaggacccuuauggcaucuucugcuugguucugacacccaccaggugagccuccccacucagccacaugugcuuucuuuuuuuuuuuuuuugguuuuucgagacagggucucuguguagcccuggcuguccuguagaccaggcuggccuugaacucagaaauccgccugccucugccucccaagugcugggauuaaaggugugcgccaccacgcccagcuccacaugugcuuucuugaccuguccgaguugcacuuugcucuugugugaaaugggguaagaaucauuccucucuuguaggguugcagaaucaagcagggcuaauggugugugugaaacauuccuagcacucaagagggagcuaccaagucuaacagcuagggaaacaaaaugauauccuugggccaguaagauugcuuagcaggcagagccauuugccuauaagccuaaguucagcccccagggacucaccuucagggugaaaggaaagaagugacuuccacagauuggccucugaccuccauuggagcgccacaucaugcaugugcacacccauauagauaaagaaauguaauaaauguguuuaaaagauauuguagcugggcugugguggcacacgccuuuaaucccagcacuugagaggcagaggcaggcagagaucugaguuugaggccagccugcucuacagagugagguccaggacagccagggcuacacagagaaacccugucucaaaaaaccaaaaaaaaaaaaaaagcuauuguagguauauagguuccauugugcauaggagaggccagcagcagggaacagaaaggaugcugucagcaucuugaauauaggucucaaauaucacacagaggaugagauugcgauuguguuuacaugugggucaggguuaacaucaggcacccuccauuucucccgcuguguuuuauuuauuuuuauguauauuuuuuauuagguauuuuccucauuuacauuuccaaugcuaucccaaaagucccucauacccuccccccacuguguuuuauuuuuuaacuccuuucccccaccacucaucccccagagccugcuguccuggagcucccucuguggaccaggcuggcacugacucacagagauccuucugccucggccuccugagugcugggauuaaaaguggguaccaccacacccugccaaagguuugauuauuuauaugccauggacagaagaagguguugaguccugugagagacaguuguaagcugccaugugagugcuggaaauuaaacucaggaccccuggaagaggucucaguugcugagcugucucuccacccccgucuucuauuuauuuccuuuuggauuuucuaggcaggguuucuuuguguaacuguggcucuccuggaccucacucuguggaccaagcuggccuccaauucacaaagaucugccugcuguugcaggauguuugaucacacugugaacccuaagauuguguuauuuaacuugucuuuaguugugguguggcucagcuuuagcacacaucuuuaaugccucugaugucuaaucagagacaugcccuuaguacacugcuuuaaucccaaacaauguaaguaaaguuaguuuguagaaggaaguacccauguuugaaagugaugucuaauugaguggcagacagugagauuugacagaguagcacauggccaacucucaggagaagaggaaugggaagcuacgugaggggcagugcagagaggaggaggcaguucuccugggacaguugugcagaggcagguugcagggagagaacaacucuacacaggugaagacagaccgagccaaagaaucaggagccagaagauuagaacagauugccagaauuacagaauuacuaugaggccgagcggggcaauucaggagaagcgggggggggggggggggggggccucauagugugaguguguguuaguuugaaucagucagugugaagagaaguuagagcuggaaagaacuagaaagggugagcuuacucagcagugagccucagaggcugaaaacauuuuaggccuagguaagauuguacagaggcagccgggcaggcggauuucugaguucgaggccagccuagucuaaaaagugaguuccaggacagccagggcuauacagagaaacccugucucgaaaaaaaagaaaagaaaagaaaagaaaagaaaagaaaagaaaaaaagaaaagaaaagaaaagaaaagaaaagaaaaaaaaagauuguacaggacuaggccuagguuagcagacaggcaguaagccuuggagacaacaauuagagcagagaaugaacucuuauaauaaaacugccuuuuuauagccugccuuugucucccgagugcugggauuaaaggugcgccaccaacacccagccucucccauccuauuuuuugagacauggucucuuacugucucauuaauuguaggcuguguauccuccugccucagugcccuuccucauccccacugagguuauagauauggcugcugugcacugagcuuuuacagagaugcuaagcaucugaacccaggcccucaugccucggcagugagcaguuuguccugagauguuuguaugcaugugccacugugcucauguggagggcagaggaccagcugaaggaaucauguggaaccagcuuuccuuccaccauguggguccuggagagggaacuccagaugugagcuuguaucuugccugcugagacauguugccagucuccuuagaauugguuuugaggaggccaggaggagccuggaggaaagagaggggaugggagauaggcacaggcacccauucaucccgcuggcucuugucauccacagagagcuggccuaccagaucgcugagcaguuccgggugcuggggaagccucugggucugaaggacugcaucauuguugguggaauggguaugggggcugagaggcugcggugggccuuggggguuccugcucaucccucccacucagucucaccucucccuccacuucagacaugguggcucaggcgcuggagcucucucggaagccacauguagugauugccaccccugggcgccuggcugaccaccugcgcaguuccaacacuuucaacaugaagaaaauccaauuccuggugagccagcugugcuccugaggcuagagacugggcuggggggccaccuugugucaauucucucucuucuccucugcuguucuaugagacaugggaucucuauggaggagcccuggcuguccuggagcucuguauacacaugugcaugacugugcucagcugguacccguuccugacacugguaucacagaugguugagcaaagggcuagaaauaaagacaagggccagcugggugugcugacacucagaauacagagguagaaggagcuuuaggaguuugaagccagccuagucugcauaguuccaggacagucaguacuguacagcaagacucuguguuauacagaacaaaaaacccgguagagacaaggcauuaggugggcugucccagaggaccugcuggagccuugcacaguaggugacccggacuugaggcugaggacaguguucaggaacccauuucacagugucugaaaggcagguaggcuaugcuuggggcuuuuacugagcaucugcagcuccaggguugaagaucucuccugcugcucgggugcaggugauggaugaggccgacaggcugcuggagcaggguugcaccgacuucaccacagaccuggagaccauccuggcagccguuccagcacgaaggcaaacgcugcuguucagugccacgcugacugacacacucaaggagcugcagggccuggccaccaacgagcccuucuuuugggaggcacaggccacgugagucccacagcugugggugaggguuaccccaaagaguugaggcagaagaaccugagguagaaugcucugcccuuccaccuccagaguccgcacaguggagcagcuugaucagcgcuauuuguugguaccggagaaggugaaggacgccuaccugguucaccuaguccagaccuuccaggaccagcuggaggacugcuccaucaucaucuucaccaauaccugcaagugaguggcaggcucuggccuuccccuaugcuagaggcucuggcccaccuuaccacaugugaaggugaaacugggcuaggcccaguggcgcugcugugaucacaauacccaggaggcauggagagcucuucccggccagccagggcuacacagugaggcccugacucaaacaagaaaaaaauaagagcuguuggcugucucccaacaguguagagggcagaggaggggccucuguccaccauaggagaggggaucagcaacuugauagcucuacuuuggaagucagaguaccauggucagggcugcugcuuguugguucuggcuuugagaggcucacaggcagcagaccaagcaucccuaccucuccucggccggguguucauuuguucguuuguucaggugaugucuccgugcugggcacucacacccauccuuucccaccaggaccugccagauccuuuguaugaugcuucgaaaguucaacuuccccacaguggcacugcacuccaugaugaagcaggugauggaccacagccauagccucucuguggucucaaaugucacaacucagaggcugaggaugugguucagucgguagaguaauguucaauuuuagagggcugugguucauuugggagaguccuugccuagcauggaugagacccuggguuccauccccaacccuguuaacugggcauaguggucugucacucaggaggugaggcaggaagagcagaaguucaaggccagccuugacuacauaggaaguucaagaccaguuuaggcuaauagagacccugucuuugguuuuggugggguuguuugguuugguuuuuguuuguuugggggaguuuguugguuuugauuugugggguuuuuuuuguuuauucauuugguuugauuuugcuuucuuuugucuuugguacuuugagacagggccucucuauguagcccuguuugucuuggagcucccuauguagaccaggcuguccucaaaaucauagagaucuggcugacucugcuucccaaaugcugggauuaaaguguguguuagcaugccuagcacagcccugccccccccccaaaaaaaaacacaaaagaagacaucacaacacugugauaccgcuccccuccucaugucauccuguuguccccuuuggcucugggaccaccuuccucccuggucuggucucagcccuguccccaggcuuacuccaucugcucacaaaccuuuucucaccuauggcacagaaagagcgcuuugcggcccuggccaaauucaaguccagcaucuaucggauucuuauugccacugacguggccucaaggugagaccaccguggcacaagcaaugagaccaagaagcugggcguggggaagcugaguguaagccuugguuucccuacauggacuccagcugaaugcucuguaccuccaggggccuggacauccccaccgugcagguggucaucaaccacaacaccccugggcuucccaagaucuacauccaucggguuggccgcacagcccgugcaggugagcagagccagguacgggagguuccagcugcagugggaggcacuggagaacugggucuaccacucagugggaacagcuuuccaguguccuggcuuccauccccagccugaugccucacugagaugcugacccaggggccaggggaggcaucugcuuugauauucccucgugccugaauugauggggccagacuggaccugcuauccugccccuguggguuuugggaagucugagagugacccugucuuaacaaauaauaagcacugagaagcuggcugcugugggucaugagcccuaucagccgacagucuccuucagcuuggucaccacugaagaaagagcaguagaggacuaagcuggccuccagccauaaaggaaaagcagcuugcugucggcccucauaaagggcagcuuagcagaccugcucccuacugucucucagcuucccaguguccccucugccugucauaugcagagcccacccuaggggcagcccuaguccucuucacugauuucuugccucugcagaggucccuggagcugaucagcugggacaagccuguugauggggcccagguucuaugacaaauguguccccacagggaggcaggggcaagccaucacacuggugacgcaguaugauauccaccuguugcaugccaucgaggagcagaucaguaaguggguaggguccaggguggguccuguccaagccugggagaugaauuccucucccuagcuuaccuuacccugggauaucuauuccaguacucacccugaaaaugcacccugcacacaggacgccaacccugaaggucccugugugguuuggagguugacaaggacaugaguucucaggcaggcccuacaaccuacguuaaacagccaccaaggcgggccaucuggagcuccuuguagaagcucuuucaguuuaacucacaguggccugaagaccugugcucacaaugcagagccugucucagccucucagggagccagaucucacuucauuuacuuguucauuuguuuauucagucauuaauuugagacagauucuugcucuacagagcuggccuggaacucagcuggaacgagugaucccccugccuccaaccucccagugcugugaugacaagcaugugcugccaagcuuggcagcauuuugcuuuuucuaaauaucaucaguccacauuugguuggauccagacauccagagcugggggugcagagggcugguugcacucccagcccaacucaguguuuccugucccugcagagcagcagcuggcagagcuggugguggaggaggcugagguucuacaaauccucacgcaggucaacguagugcgaagggagugcgaaauaguaaguguggccagccugucaggguaggguggaguggggugaggugggcggggcuuccugccccaggccugacugaccuguuccccuccccaccccuagaaacuggaggcuucgcauuuugaugaaaagaaagagaucaacaagcggaaacagaugauccuggaggggaagguaguauagggaggcauggguaugcagggacaggcauaagaguguggccaguaagggugggugggaccuggggucggguaggggugggggagccagucccugggaagcugcccaguuacauucucagcucccuuccgcaggacccagaccuggaggccaaacgcaaagcugagcuggccaagaucaagcaacaaaaccgacgcuucaaggagaaaguggggcagacacuucggcggcagaaagcagggagcacuguccgacggucgcguccucccagaucucggccccaagagccagcccaggcugaggcucaggacugagcuguaaaccuggugcugguggccccugacuucaguaaacacucuuugaaguugucagucugacuugagaauggggugggaugaguacagggccuucaggucucaggaucccaaagccucuguugccccauggggaugacuagugcagccuucccucgcagugucccuggggcgcagggcagcagcagccagggacagcaacgccacacguagaaauguaaccuggguagaagcacugcccaaggauucuagaaaacucuacacagugcaaagcucagagacagcugggguccccuggccccugccagggcgccuugaggccgcagacacuccauggcagacuagggugcugccucugccaggcgugccaggccuucacgcagcucgcugagcucaaacagccgaacauccagcagcugcgcagcccggcccaccuccgcccgugcgcgcucccgcucggcccgcgccuccuccagguugcacuccaucgaccgcagcugcugcuccagcucugcauuccgggucuccagguccuacacggggaagacggggugggguggaagcucugguugccaguuauggcugauguggcccauggcucucaccgggucaguaaagugccauuaaagugugaaguacugaguuuggaauccaauagcuacauacaaagcauggcuggcaagcauuuguaaucccacugcugggaagacaggcaggauuccuagagcauacuggacaaccuaagcauccccaggccaguaagagacacuguuu

SEQ ID NO: 4481 - RNA, 15817 nt, Mus musculus
ccugccuggcugcggcgcgugacgcgagggcgcgcggcgacucggaccggugcaggcaacagcggagacagcggagaauuggauagcauggcugcugccgcggcgacccccaggcucgaggcgccagagcccaugccgaguuaugcgcagauguugcaacgaagcugggccucggcgcuggcggcggcucagggcugcggggacugcggcuggggacuggcgcgccgcggccuggcggagcacgcgcaccuggcugcacccgagcugcugcuggccgugcucugcgcucugggguggacagcguugcgcugggcagccaccacacacaucuuucgggucagugagaccuaggagggugggggacugagaacugcaaaaggagaaugaguggggccucaccucacguauuccuauguccaugguggccgcuggaaaguggggggcucggguuuggagaugcccaggauguuggggccucaggcuaucgcgagacccuuugcgcggguuggaugccggggggggggcugaauugaggugacgcugugauggauuugguguccaauauagugugggguguucuggguccagggaaaccagauccacacccuguccugggucauuucgauagaaucuagggcgaucagcucgguacagccucuaggcuguugcagaccggaggaccgaccuggggcccuuccuggggaucgacuuggggauccuggacgggaggccucgagauauacagaggucaccugugcccugcgucacggggagcugcugagccuacacccagucugugcagucgaggcuccgccccugucugggguccacaucaccccugagccagugauugcacaggccugcaugucaugggccaagcaagcagaggggcucaaccuuggaaaugacccugucuaugucaaggcuggauucugccgcccccauggggugauggucaaaauguucucuuucuggcaacuaagaaggccaccaaccaggucugaaggaugacccuguagugauugcacugaugacauuaguaccugagccuguucuucaucccccuccugggguuagggggucucuguggcauuuaggccaguaccaugguggauacucccccaggggacuagcuggggacaucccaccccccuguaacugaaaguggcaggggggugcggggacagagagcauugugccaacaaaggggccuuucucugcuggcgggaagaggcuguuccuuguuaggucaagacaggguguuguccagcuccagggcccacccugccugguaucacccacuggagggagcaacuucagcccccagcugcuguggggagguccaggcuagagugagaagggccaaggcaccgugcagucaugguccccaucugccuuggcccugacacucucucgguguccaucuaggaagcuggaggccuugacgaggccugaugccaccucaguuccacccucacccuuccuaagaacuggguggaggggcgucccacucuccaagcucaacuuggcagcagccugguugcuaaggguuacaggagcugggcucuggcugucuccaugacaaccgcugagugcucagugcuccucuggcccccucagccuugagaggaagggggcuggguuuggcguucagcuccggagcuccacccccagggugcuggagccuucccugacacuaguccgccuauuccaacagucuuuuguaguuuuugagacagucucacacucugaagcccagguuggugaaacucauggcaauccuccugccucaacuucccaaguauugggaugauagacauguaccuucuaauucagggcacacuauccaguggcgucuuuguguccccagagucagguugucucaccaucacaugauucccuuucacuuuuucccccccuucucccucuacaccaccccguuucucuuagcagacucuggccggcuuccccucccaggcauccuccuagacucaauuucccuuccugucuuccucucagggcaggggagcacugguguuuucaaguuuucuguuccccaaaguauuucccaucaacagucaagucauccccccuuuuucucucccugacacacccccauucccuuccagaaccugagccccccagauucccugggcuccauugccuaaagccugagugugucaccccacccugcccucuccccuucccucuccuuucuccaggccacacaggacagcugggugcuaaguuuagcccuucaugggcuaacacaugggcucugguuaccccagaugauaugggcacagaggcccagccuucucaaugccaccgagccugcugagucccugggucucacuuuguccccuggaggagccucgagcuccccagugauaaccauuaccuaccauguucccacagccccuggccaagcggugucgucugcagccuagagaugcugccagguuaccugagagcgccuggaagcuucuguucuacuuggccuguuggagcuacugcgcuuaccugcuccugggcaccaguuauccuuucuuccaugacccgcccucugucuucuaugguaagaaccccgugggaccagugcaaaggauucuauggaggcugucgagcccagccugacaaguggaaagugagaaaugacucuugagaaguuguuuucugaucugcacaugugcaccgugucaugcacauacgugugcaccaugucaugcacauucgugugcaccaugucaugcacauacaugugcacauacguauguacauacauucuccacccccucaggcgugggccuaaugagauaucucaauggaagucuugauaucaggagaucuccaagacaaggauggcuauggaccccuggaaguggaguggucagaagaggguuccuagcagagguagugcugcaagggcaugugcaaaggcccuggggugucauaggaugguuccaaugaagacccaaauuuuggcuggaguuugagcuucagagauggauaaguaugaagguuuguagauauuaaaaugugaaaagugggaagggcuccuugcuagggaccaugauauaggaauuaucagugaucuaggaggggcagagauaugcuuucuaaagggacagggauaagcugagaggacucugguggcacacagcuaggaccuauggugacucuccacauggaaagcaccauguaauuuuuucuuacauaguccagaacagcccaaaauuggggaugcaccugccuccaccaccuaacugcuaggaccccaggugugugucaccacucagaacaaaccauuuugaguuucaagaggagugguguuagcuguucccuuuuuaucucccccugagacagggcuucucuguguagcccuggcuguccugaaacucacucucuagaccaggcuggccuugaacucagaaaucugccugccucugccucucaaauguugggauuaaagguugugcacugucauggguggcugacagacccagcguugguccgugcuugggacaggcuagcguacauuuacugaauacucacagguggauauuuuucuagagauagaaccaaagagacuccugcauauugggcagugugucucaggugaccauguccucacgcaucacugagggacucucagcuaucccuuuauucuuuacuccugagccacacccacagccacuuacugggcaauucgaggcagggguuccaccccugagccacugccccuggccuaagcauggugucccaggucagccugugcuagacacaggcaggaggaggcucccaaacccuccaggggacgucuagucugcucauagcaagaagaagcaagagaaaacaggggacagguucagggagguguguguggauauguucacagggacagggacccuacugaaggugacucuggcugaagugugccaaaaugggguagugcagguagggcuaggggcuugcuagaggacgaggagaaguguguguauguguguggggaagcggguugugggaugugugugugugaaugggugugggggggugagugggggugugagagugguugugggggugugggggaugugaguggauguggggguucuucuccuuuuagaaagcauagcuguuuguauccauguggaggggacaccugugugcccccacuugcacaugugcaugaagggucgugaacaaccuuugggaguuggucucuucucaucauguggagcccuggucaucugguuugguagcaagugccuuuacccaccaauccuucccgaggaucuuuuuggaauuuuguacaggaucaaccuaggaugcucucaaaacuuuccugucuuucugccucaggcccagugcuggcuggaggucagagggcaacucugaguuacuucucucuuccaccuuacugugggcucugugggcagagcucugcucuccaguccuucagugacucuauuccuuggcugccugaauuggggacaagggugucacaaaggcccagacagauucaaaaggaccuugggaacagaacauggugacaggggagaggaggaggcacaaguggggagagguggguaguacagugcucaccagggaagggacaguugccugaguggggacgggcgagcccagagacaugggaaggcuggagcagaggucucuguaggagacccacccagcacaagugagaccacuggacuaggcacuggaacaggacgucucugucugcagagugggccuggagaacuuuagccaggcaugauguccauacuugucauuucagcacucaggagacugagacaggagcauugcuaugaguucuuaggccagccugagcuaacuaacagacucucaaacaacaacaacagcagcagcaacaacaucaacaacaaugacagaauacccuacaaaauggagcuggaaggguuggagagauggcucagcaguuaagagcacugacugcucuuccaaagguccugaguucaaaucccagcaaacacaugguggcucacaaccaucuguaaugggauccgaugcccucuucuggugugucugaagacaugacaguguacuuacauauaacaauaaauaagucuuggggcuggagugagcagagguccugaguuuaauucccagcaaccaccugauggcuuacaaccuguacagugacaguguauucauauaaguaaaauaaauaaauaaauaaauaaauaaauaaauaaauaaauaaauaaauaaauaagucuuggcuagagcugaggugguagagggcuugccuagaagcccuugguuccguccauuucagucaggcaugcugccuccacacacagcaucccagcacucaggaaguggagacaggaggauuaugaguucaaggucauccuuagcuacauagagauuuuagugagccuggccuaccugagauccugacucaaacccaggcaaaggugggugaggugguugcccugguucaggugccaagccugacgccccgagugagaagagaauccugacucccgauguguccucuaagcuccccacaggguccuaugacaggcaggugcccacacauguucacagugaauaaucuuauagauagaagagagaccuacagccaccccauguucagcaggcacaugccgauugaggcuguguggggaagucucgggggacacagagacccugcaaaugacugcucgcucaugacucuuccuagacuggaggucaggcauggcagugcccugggacaucgcgguggccuauuugcugcaggggaguuucuacugccacuccaucuaugccaccguguacauggacagcuggcguaaggacucgguggucaugcuggugcaucacguggucacccugcuccucauugccucuuccuacgccuuccggugaguucaucgggagagugggcaggugacacgugcgaaagucgaggugagagcaaggaaggacccuggcucagggguguguaaggccuggagacaggcucagagacccguccccacucugcucccucgggacuaagccuggugacacccuuuccaaaaauuccuuucauguuuauuuauuugggggugaugugggggucagcuuguguggaggucagaggacaacuuuaaggauuucugccacgugcaucuccugggaauugaacagaauagagacugagcggcuggccagccaagauaggugaggcuguguguucaaggacaacaagagcuacaacagggagaccugacucgaaauaaaaaaaggggaaccaagaauucucacagcuaagagcccuggcuguucucgaaaggacauaaguuuuggguccaugcccacaugguggcucaccugugacucuguccaucacggacacuggcaggcacaccccacacagacauagauuucacaguaguaagaaaggcuggcgccagggcucggggugcacagcgugggaacuguucuuuuggggauugcuuuuuguguguauaggaguuuugacugcguagagugagauccccuggaacuggagcuauagguggguucugggaaccaaacugagccaucuuuccagccuaaguuccuagcacgguguuccaggaaucugacacccucuccugggcacugcaggcccugcacacagauacacagucacauacacacaaucaaacaauaauaaaacccaccauguggcccugggcagauggccccggcuccacaguccugaugugaugucucugcagguaccacaacguaggccuccucguguucuuccugcaugacgucagcgaugugcagcuggaguucacaaaacucaacaucuacuuuaaggcuagggguggugccuaccaucgcuugcaugggcugguggccaaccugggcugccucagcuucuguuucugcuggugagaggggguggaccugacaggagaggguuguggcucagugggguggguagggccaggaggggugugucuuguuggacagugggcaaagcaagggcuuauuagggguaaaggcaugcaugguuggguaggagacagggcugauugggaggaugaggagggccaagcagaggaaggcuauggccuaauccagaaaggccuguccuaggcaaggaaggggcagggucuggcgagugggugagucugccaagccaaggugcugagaaagacagaagugggucagggaccuugggagugagugacaaguggcuggugaggaugguagggaggagcuggcagagucggggaggggaguugaaagagggagcaugcccuuccucaccccagucucccccacgaccccuccccgcagguucugguuccgccucuacugguucccgcucaagguucuguacgccacuugccacugcagccugcagucugugccugacauuccguacuacuucuucuucaacauucugcuguugcuccugauggucaugaacaucuauugguuccuggugagucggccccucugggucaucuccaggccugggaggggccuguguauagguggugcaaagggccuguggcagccacaggguuucauuggugcccuuuuccucccacaguacauuguggcuuucgcagccaaggugcugacuggucagaugcgugaacuggaagacuugagggaguacgacacucuggaagcucagacagccaagcccugcaaagccgagugagugagugagugagugaggccgggccucggucccuagcgcccccuucaggugugggcuccugagaaugcuggggccccucagggaaagagccugaagcaggggcuuggcuguguagccagaaguggaacaucugggaaugagcgagagagaggccugucagggcugggagcugcuugcuagcccaggaggaauguucaagagacuccagcucucugaggacagcaagggcucagcagaacggcaaaguacuguccaccuggcucugcuggcuuggagucugggguuggcucaagaggggaccucaccaacccuagucuggacaaacaggguuuaggacacacagcccccugagccaguauguguagcauugagcaggagcaagggcaggaggcugagggaaguuccagaaaaugcaagccagccaggcccugggaugcauuagugcagacaccagggggcagaaggugaagaagcagagagaugugguuuaauaauuuuuguuuugaaaggaauauaggaggaggauuuuuaaaaauuauuuauuaucguaggguugggguaugugucauaauguguguguggaggucagaggacacccuuugcgugucucuuuccacugugggucccagggaccgagcccaggucaucaggcgccuuuuccugcuaagcagucuuguugguccuauguucuuuugcuuugcuuuuauuuuuuaaauuguuuuuauuuuauguguguggcuguuuugccugcauguauaugugugcauuauguaugagcagugcccaagaaggccagagacggcauuaggauccccugaaacuagcuagagacagauguaagccuccaugugguugcugggaauugaacccaaguacucugaaggagcagcaguaaugggaccgccuuuaaucccagcacucaggaggcagaggcagguggcucucuaugacuuugaggccagccuggucuacagagugaguuccaggacagccagagcuacacaguaaaacccugucucaaaaaggagaggaagaggaggaggaggaagaagagaaggguuaggguuaggagcagucaaugcucuuaaccacugagccacccuucuucaguggcucucaaccuucccagugcuguggcccuuuaauacaguuccucauguuguggugacccccaacuauaaaguuauuuucaucucuacuucauaacuguaauuuugauacuguuaugaauuguaaauaucuaauauaugaccucugcggggguugggacccacagguugagaaccacugcucuagaccucagccuuaaguucuuuuuaaaaauuauuuguacauuuauuuugugcguauggauguuucucugcaugugugucagugcaccugacucccacagagguuccaagagagccucugauccccuggaacuggaauugcagaccguugugagccacagagcagaugcugggauuugauccuggguccucuggaagagcaguugcugcucuuaaucagugcauagcucuaaauucuggagacgggaauggaguuaggcuggauggcauccacuacuaguccuagcacucaggaggcugaggcagaaggaucuccuucaguuccacaacagcgucaaccacagagagacugcuuuucaagaaaggagccacacacguacacuguggggcuguagaggagguguguugaggccggagcuagcaccagggcagagugaguguccuagcuuacuuccuauuccugugacaaaacacugaccaaaugcagcugggcaggagggaggaguuggcuucuacauuccagucacgacugaacacggagagaagucaggacaggaaaccaaagcagagaucuuggcuggacccccacugcccacucacucuuccuuccuuccucccuuccuuccuuccuugcuuccuugcuuuucccuguguccuuccuucccucccucccucccucccucuucuuucuuucuuccuuucuuucucccuuugguuuuucaagacaggguuuuauguguagcucuggcuguccuggaauuugcucuguagaucagccuggccuccaacucacagagauccaucugucucugccuccuuagugcugggauuaaaggugugugccacaccuucgggcauccugcuuucuuauagcacacagggccaccucuccaaggguggagccacccacagugcacugagguuucucacauugaucaaucaaugaaaugcuccacagacucgacuagagguuaaucugauggaggccuauucccaguugagguuccuucuucccaaugaccucaguucguguuaacuagacaaaacacuaaccaagagcaauggaccauuugccagccagacacacaagcacaucaguauuaaaccauaaccucuccuuacuuuuucucuccaguaucucauguauuaacaaauguuaaaguuaggauuacaauauaaacacaguccaacuuuuguuuuuuggguuuuuuguuuuuguuuuuguuuuguuuguuuguuuuugagacaggguuucucuguagcccuggcuguccugaaacucacguuguagaccaggcugaccucaaacucagaaaucugccugccucuaucucccgagugcugggauuaaaggugugugccaccacgccuggcccaacuuuuuuuaaaaaaagauuuauuuuauuuauuauaugugaguacacuauagcugucuucaaacaccagaagagggaaucaggucuuguuacagaugguugugagccaccaugugguugcugggauuugaacucaguaccuccagaagaacagucagcagucuuaacugcugagccauugcuucagcccacagucuaacuuuuacaagucccaaguguuuaaauuuuauuuauuuauuuauuuuguuuguuuuguuuuguuuuguuuucaagacaggguuucucuguauagcccuggcuguccuggaacucacuuuguagaccaggcuggccucaaacucagaaaucugccugccucugcuucccaagugcugggauuaaaagugugcgccaccacagcccagcauguuuagaauuuuuaucacuugcuagacaugguggcacaugccuuuaaucccagccagaaggcagugucagguggaucucugugacuuccugaccaagcugguccacacacugagucccucgaaaagcaaacaagccagacgguggugguacaugccuuuaauuccagcaguuaggagguagaggcaggcagaucucugugaguucgaggccagcaugguauacaugaguuccagaccagccagggcuacacagaaaaacccugucuaaaaaaaauuaauuaauaaauaaauaaaaacaaaaacacuccaucauuuaaaaguucaaccacucuuuuuaaaaaagauuuauuuauuuuauguaugugaguacacuguagcuguacagauagauuguugugagccuuaaugugguuguugaaaauugaauuuuuucagaccucugcucacucuggucagcccugcucgcucuggcccagagauuuuauuuauaaguacacuguaccugucuucagauguaccagaagagggcaucagaucucauuaugggugguugcugggauuugaacucaggacuuucagaagagcagucaguguucuuacccacugagccaucucgccagcccaaguucaaccacucuuaaauuuauuugaagucucuuaauuguggacuccuauaaauuccaaaauaagacauuucuuacuucaaauuggaagaaccaggacacacacaauaagaguagagcaaaaccaaacuccagugguguaaaugaaaucugaaccucauuguggcaaaucugggugucacucaagaucuucuggacuccaaaggacuugggcagcuguagguugugggcuuugccauccacagcacacagcuccuguuggcuccuccucgcccugccaugacgaggaaucuccaacaugcugccaucuggacccccaccaauggccggccucucaggcuucaaaaaccaauagcacacgggagacucuuacgucuuuaccaggaaggugaccucuucuggaccacagcugaauuagguuaccuacguucuaauaaggcaaaacccauuaggccacugagggcaagagagcauccugacauacuuccuaugugugaucaacacaucuugugcagcugaggcaaccaaccuuguuuacugaagggaacacacacggcuuaucuuacgugagcaacagucuccaguguucccggaaaccaucugcccuuggcaaguggggcuuacagauuagaagcauuucuguuuuguagaucucuuaagcacagcaauuuaaacuuaaaacauaacuuuagcccucacaaaaccugugcugauaaaaguugcugcuauccuuuguguuuguccuuguggcgugauggcagccagccccauggaagccacagcaaaagcuggugguuuauguccugaggagcugcaagcguuuaacagaaagaacaaacuuccagucgggggaggccuaagcacaagcgcuggcuuccaggacauacuuucucuagaaaaacugcagcuuugaauucucugaagagcaaguguucaagcacacaggacgggugugcaaugcugcucauaggacggcaaguucagccagaaagugaggucugagugagccugcuacaccgccagucugccuugcucugauguaggcaaaacccucaaaaucaaagagccgcugaaagggcucacuugggaaagcauuagaccaaagcaugagugagcuuguguuuauggcucagacugcuguuugucuagaugggguucagggugaggaaggggcucauuugggguguguugacuugaagugguaucuuuuuguuuuguuuuuugagacaggguuucucuguguaucccuggcuguccuggaacucacucuguagaccagacuggccucaaacucagauucgucugucucugccucccaauugucagcuacuacugcccagcccuugaaguggaauguuuaaugugagccaugaggucuguagagagauggugaggacauauugaggaagcuucuagaacauucauucuagagguuuccacaaggcuugagaacggguuuggaagacaugugaccuaaccugaggcagaaaggcccacuugcuccagaacucauauauaaaguaaugcuuggcaauacaucaccucaugcgcugaaggccugaccucugaccuccaucccuggagccaccugcucugucucauuuaaggaagucuguggcaucccuccaagagcacaaacugcacagagaugagggucaccggggacuccugccaacuauagcucccugagucccucagaagcugacuacugcaggcuggcagggauagaggcagaaacugcuaggcuuuucccuucuuaagggaaccucagucuggccaauaacuccugcaagaauugcuuagccaucaggcugccauucucugagugacagggagaaugaaacuuccuguauuaguuggaaacucuagcgucuggcaugguagugcaugccuuuaguaccagcacagcugaaucaggggcagaggcagguggaucucugugaguccgagaucaaccugcucuacaaaagaagcuccagguuagccagguccacaaugagggaucccaucucaaaaagagaaagccuaaaauuucccauaacuggggcuaggggugcagcuccaccauagagugcagcugaggucggccuuccaccccagcacugggggaaccuuucaaacuuugccagagauuccaaguguucagaaggggaguuuguggguaggggaggcacacagggacauggcagggauggugugggugggaaccagggagcgagcgcuguuuggcagggacccuagucaguucugucuggaauggaagcggguccuuguggagguggaaguaggggaggagucgauauugaacagggagaggggagcaugggguccccagacuaaucuguuucuauuucuggcccccaaggaagccacugaggaauggccuggugaaggacaagcucuucugagucucuuguccucaacuucagccauccaggacucuaucccauccuaccugggauacugacuccgccccuggagacucgacccagucccuggaggucugcucccaccccuggaggcccggucccgccuuuggcggcauggccucgccccuaggacaauagccccgcccuaagauucaggaugcuacccuucuccagggacucuggcugccagcagcuccgccuuucagaucaauucucgaccacccaccuugggacugccgcccaguccugcccucuggaucagugggguccagacacgcccccuccaggaccucaaagcacccccgaccuaaggucaccagcccacuggccccagacgcagugggcuccgcugacucucuuggacaccuccugggaggaaaaugcucccugucugccaucguuuuugcgaccaccuccuccuccugcucuugcugcccucgacgacccuggcccccgcgccagcauccaugggccccgcugccgcccugcuccagguucuugggcuucccgaagcgccccggagcguccccacacaccgaccugugccuccugucauguggcgccuauuccgucgccgcgacccccaggaggccagagugggacgcccucugcggccaugccacguggaggaacuaggggucgccggaaacauugugcgccacauccccgacagcggugaguaggggguugugguuggacaaggguccaugagacugagggucccccacaccaccuguccagccugguaacuagcuggggcccuguuuucauaguccucuaaaagcaaggacacgugcuaguggcuucccagugcccaaucucagcccugcccccaucccgccacuucauauccuuugaugccuuccuucaggucacuuuucugggccuccagguccuggcuggcacgucuccuuucugcucaugucugcaacuguaggcacggcgcccuacagugucccuuuuuugcagcgggugcccugcccccaccccauccaucaguggggcucccgucucucaacacuucccuuccuccuugucucagcccagccgguuugcugggacaucgcgccauguccgcucucuccuugcaucuccaggucuguccuccaggcccgcacaacccgccaggaccucggggcugugccccgaguggacagucgucuuugaccugucgaauguggagcccacagagcgcccaacacgcgcgcgcuuagaguugcggcuggaggcugagagugaagauacaggggggugggagcuaagcguggcacugugggccgacgcagagcauccagggccugagcugcugcgcgugccggcgccaccaggggugcuccugcgcgcagaccuacuggggacugcaguagccgccaacgcaucagugcccuguacugugcgccuggcgcugucacugcacccuggggccacugcagccugugggcgccuggcugaggccucccugcugcuggugacgcuggacccacgccugugucccuugccgcgauugcggcgccacacggagcccaggguagaaguugguccagugggcacuugucguacccgacgguugcaugugagcuuccgugaggugggcuggcaccguugggugaucgcgccgcguggcuuccuagccaacuucugccagggcacgugcgcacuacccgaaacgcugaggggacccggcgggccgccugcacucaaccacgcugugcugcgcgcgcucaugcacgcagcugcucccaccccgggugcaggcucgcccugcugcgugccagagcgucuaucacccaucuccgugcucuucuucgacaauagugacaacgugguccugcgacacuacgaagacauggugguggaugaguguggcugccguugaccacccgggacacccuuucagggaccgccccacgcaaaagcagggacuguuuguucauguuuuauuggugacaaaaagcuuaaaacaaauuugacuaaaaauuaaguuccau

SEQ ID NO: 4482 - RNA, 2049 nt, Mus musculus
ugaaaaacaacaaagcaacagagaaccuuuuauugagcaguggcuacaggcacuacugucccucuauggaagguugcagcgaacugggcuaacuaauccuuggccugauggaacauuuacuuaucuguuuuuguuuguuucauuguguuuuuuagccaaguucuaauauaccucaggcuggccucaaacuugcuauacaacuuaggaugaccuugaauccuugcucugucuccaucuccagaguccugggagacugcgccucuacacucagcaucuguuuuuguguguuuugagaugauguaauguuggguguccugaacuucgcucuguagacaaggcuggccucagaguuacagagaucucccugccuucgacuccugagugcuuggauuuuaaggaguguccuuacugggagauccacccaagcagaggcagccacccuccuggguuuuucccucgcaauaaaucucguguuagguuuguugugugcugugacuuuguucuauuucuuggcucccaauugccaggaucuuuuggagcacagcugaaacacuuuggggaaccaccuccaccccucccccugcccaagcagagcagauacacuucuguggggggaaugccuuucccuucagagcugcaacacuuacacuuccuccacugaagagugggaaggaaacccagggaggaguguuucucuaagucucgcagcuggcuguggaugcucaucaguugguagcuucugccuagcacacaagagcccuuaguuccguggucaacauugcauguacaccugucaccccaccaccaggcacuuugaggcaggaggauucccccgaauuccaaaccaaccaugguuacagugugagacccucaaucaaaaccaaaacaggccggagaaauggcucagaguugugcacccagcgcuuacaagaggagcucacauccauucauaacuaguucuaggggaccugaccccuucucagcgauucccaggcuagcucggaccagugcgacuugaucgcaagacaaaagaagcauuuaucuucacaggcuucaggagugcucgggguagcagugacuaccauuuggcagaguccccgcucccuacucauuuauucaaucgaugaauacugagaauggccacgagccaagugacagacgggguaacuaagguucaaggagugcaggugcgugguccccgugccacaggcuccacacccaaaaccuucuggagagagccucaaucagcaccuaacgaacauccagcccugaagcccggaggugaggacgucgcaugcgcgcaugcgcaccgcuaggcagcaguuggggcggggccaaguucgcgagcccagguccuuuaggcgguugaaggcccgccucuucgcgcaggcgcacggcgaguuccgcccucccgcuuagcucccagugcuccggugcgguuggcuacuuuccgggaggaacgcgcgcgccugcgccggcgucggacucgcgcacgcgcaucugugccggcguccggcucgcgcacgcgcaccgcagcgguggcggcgacggcgguuccuguccaggggucugagagcggcggucggcuuugaggcgagcagcguuacggaggggcgcggcggcggcggcggcggcggcggcggcggcggcggcggcggcaacucagagcucagaaccggcggcccggcucugcuuucggaggccgacucggagcccgcccggcucucagggcggcggcagcggcuacuccggauuacggccuaggccuagccgaagccucgggcucgagugcggugaggcgcccgcugaaggcgcggcccgggcggcaggaugaguguggaggcguacggccccagcucgcaaacacucaccuucuuggacacugaggaggccgagcugcucggcgccgacacccagggcuccgaguucgaauucaccgacuucacccuucccagccagacgcagacgccccccggcggccccggcggcgcgggaggcccgggcggagcgggcgcaggcggcgcggccggccagcucgacgcacaagug

SEQ ID NO: 4483 - RNA, 3498 nt, Mus musculus
cccuauuuuuuauucacuuuauuuaaagguuuauaucuccuuaucuccucccaggaaggaguucucaccacucuguccuugugggguuggguuuccagagacaaagggaaggaaccuuagcagaggggagccccugagaccucagccccacagugaggacacagagaaagaaaaagcaacacagaugagguuccauacucagaacaugugaggaaugucaauaagccagccccugggaaagcaagauggggggccaaggaggccagacccuccucucucggccacuuagguccacuugucucaaggggacuaagggaugugcuggcaagagagggagggaagacugggggguggauaagcccaagguugguccccaaccugaccuugggauuuaggguacagaacguagggaggccccugcacuuggcaguaggcuggagauuacagcguggucaaaucaagcuucaacuuguaaggaggugugcuguccucauaggcaggcggcggcagggguggguauaagggccagucagacuccaccaagaggcccuugugcuguucugcaguuagaggcuguauagauuggggcaaaagagccuugucuggcuucccaaggcaagcaggaccccccccccccagcaugcagcccuagccaucaugacuguuacucaccuggaacuugaggugcuggccugguguggugaccagagugcagcaacucagccagagcaugaucaggauggacaggaagagacagcagaauaggacccaucgaggcagcccggagcgccuguaccaaggacaggcaucgcucagcuaccugagccucccauaucugcgcccagcccagccuagaccacuggcaccuaccgggacaugcaacugaggaagucacucucuuguugguccucagacucuaccuuggcuuugcuggucuucacucggggcuuagccuuccucacuuuguccaaggggccuacagggucugaaagguggggggcaucucagucccagucucagcuagaaggacagccugguaaggagugggaaauagaugccaggacucgggcaggaggauguguagggcuggaauagaggugcaagggaucuuggaauaugacccacagaauguggagguggaccaugaauccugggaccacuggacccugggagacuauggauuccacgacacugaucauggaucuauugcaaucuuacccaugugcaguucuagggccuuggggugggaccuccuccaggucaccuccacucgcugcagauggcucccuuggaaugcaaaguucucugcuacaggcugagucugagcagggaacaaaauguuacagagguacccucugagcccuggcagacucaucucagaugcaagagggcuagaguuccuuguccagguggcccccaguucucccaggagucaagcgggagaacaccaucccaugggcuguauccauuagccuuaacaccucugaugaucccuagaaacaggaagaugcccaagccaacgacacagaauuacaggauugaccuacauggucaugugacccaaccagccagugccaaucagaguaaacccuuuucagguaaagccccaaacagagggcagguaauauggcucagugaacuaagguaauggcugccaggccgcaugaacugaguucagucaccgggaccuacauggauagcaagaacaguguuccuggauguaauguugccugaaguucucucaugaggacuucauauaccaugaggcaaccacgggaugccacuccgguucacugugccauuguucucucaccuggaacaccaccacuuuccgguugucugucugaagggaauauguccaggaggaggauagaaagcccugggcagaacucaucaggucgcuacagagcauggaaaacagguaccgaagggagaggcgcccccugggcggguccaaagccaaguccuaggaagaggaagcccaagacaaacuggugcuggaaaacugggcugugcugauuuagacaacuaguguaagaaaaccugaguuucaguauccaacagggaccccugcccugccauaugucagcuguguucacuuaaggggaagaagccacacagucuuucuuugagugcuugguuuugagauggggauuuauagguuaggggguucaccuucugcuccagcugggucucagguucagggaucuggccccagcaccccucacugcaggcccguugcuccgcugccuucacguaagcuucugugcaggcugugggccacaggauggagucacugggagcugcuucccaggauaccucugcugcaggcacccccaaagugcacccagcccuggaggacucaccugcuucacauucugucucuguggcauugggccuagagcucuuggccacaaagcggcagauggagaaaagccgacagccacgcucacaagcacugaucaggauagccuuguuauucggggacucugagggacccucuggcucaggcugggaagggagauaagagacucaggcaaagguacucggggaagaaggcuggggucccccuaagaauccacgagacugaagucagguuucagaaagccaggaucaucauggggggaggggugccuucugagaaacagcaagcagcuuucuaagcaggcuggauaguggccugcacaguggccucuccaggauggaggcuggcagagggcuucucagagagaggcagagcuugcacuugggaacagccuggagcagaacugucuccaagaaggcagugaggaacgugggaagagaagagagcccaugggggaaggagggacagcaccaaguagccuuggacuguggguggggugugcuccaggaccucucaggugcaggucucagccucccuuuggcauguccccacuuacaguguucaccccaggugccaauugaucccuuccuagaaggaagggcaguucugagagaccccucccccuucaagacacccucauugcaggcaccucaguuccucccacuccugaagauccuccauccugucgccccacuauuucuagaggacucucuggcucccacaucucuuuagggacucucagaaucccgcaucccucugccaaccugaggaaccccacgucagcucuuuucucauccgagguucccccauccaggccccuucccaggaccccaaucugcacuagcauaccagguacucgcauccccucuuccaucugaggguccuacacucaggucccucuccuuuuccagucacuggguuccugagaguccaucuguuaccugcgcaggaggcgagccaggguggugcuggcgacaccgcugcuggcaccucugaguguccccgagcugcggagcgaaggggucacgcgcugggguuggggugaccagugacgccaacaacagcagcagcggcaaugcuaccgcagccauggcugaagaugcgcagcgcgggcccugggaugcgggaccggg

SEQ ID NO: 4484 - RNA, 2460 nt, Mus musculus
ugccacuugacugcgcagucaugcucaccgccgccacagagguguuggcugcugcagacggucccgggucugcggaguccgcgugggccugggugagcccgguugcgggugggacgggcgcgggguggcgggaugggcucaggacuccggcuucauggccccacacccccauagagagacgccccgaucgcuacacuggugcagaggauucagcagcuucagaaugaacgcgcacaggccuuccgccgucuagaccagugagcgggcugggcuggaggagggggcgggcccugggagagcuugccugagggggaccugaggggaggcggcuggaggcguggcugggaggaccuagguuguggacuuggucggaagagguggggagagagccagaucugguccaggagaugcaggagugcugcugccgggagcagggcguacuugaaagcgaagucuagaaggguggguaaaaggaucugugacacugaagccugucuauuugggggaguuggguagagcugaggguguagcuuuuaguagcaggguagauagguguagagcagcaugugaccgugggcguggccuggcgggagcagcuguggugugacccuccacaagaucccucauuucucugagugcagagaugguuaagcacuagcucuguccugacagacccagucuguggaguucggguuugucucuuucgagucggggguaucuuccacguagcuggagcagggagcguggucugcuugucagcgugucgauucagcauccucccgguccacugcagagcucaccgucaguaccugcucaguggucagcacuaugacuucccgaguuaccggagugucgugcacgaggugacccaggccuucgccgcugccucgcgggagguauuggcaguggaagcagaguuggcagggccucgagcgcaaccggugcucgcccgccacgugcgcagccugcaggagcuagaacagacgcgccuggccacgguaagaccaccaccccucuccuuuuagaguggggcaugguccacaacccauucccagccaccccgaccuacuacuauuuuugccaaacaccucuaugcauuugggcccucucccacucuuuccuggcuaacuacauuucccucccaaauuuuugcuuaauuauaccagccccucuguaaagcuguccuaagaacuccagaaacccaacgcaucgaccacuguggcuguuuaagucccuaacucuggguuaucaccguuggaacccacaaacuacuucuuccacaaacauccucagacacuugucauccuugguccuugacccagaucccaagaccccaccuacccuaaccuuauagccagugguagcaggggaggagcuugcccacuguaaaccauguagcucuuuggucuggaauucuuagugcagaaucccaaacucugcagaguuccauuuccauccuagaauucgaacuccauguccggccacugggguggaggccacacccaccauaccugccaccauucccugguuuuuccaaacugugaccauauucuguaccuccuuccauaggagagcccuaaaagcaagucauacgcuaccucccacucaagcucugcucuccuuagaguccacuccuggcccuccuucccucuguguggcuuuugucuacuguaacucccauuuccuccuccagguggcacuguugcaggugauggggacaccaggagugucagaacaggacccugaaaaguugcaccagcugaaaauaaagugagcccuguuggccccuuggcuugccaccuuagauuggcaccuuagauugagucagcccagcgcagagccagucagagagggcagacacucugaugcacucuggugcucccagaugcguacuuccuaggaugugcauguauaucacaucucuuacaguuuccacugcuuucaggaguuugaaugugaccagucacuugcuccccugugaaccccucuaggucuauugcaggucucuaugcauagauaggcaugcacaaacauccccuccccccaccaccauggccuuucccaugagccuacugugacccaacgagccacccggccuccugggcaugcucccaggcugggcuugagguuuggcagcaagcaggagggcccaaggcuugccauagccccccuccccgcuagcugugcagcucagcuaauucaccccaucuggguuuuauuuauaguuuccauccgcucuuguaggguaauuaaaaccauggaggcgaucggcgagguucugcaggaacucagguuugaugcggaaucugccgagugagggcggcuccccagggaccagaggaagccgggaaaagaggcccauggcgucgagcccagcccugaccgccagcuggcugaggucgugcccugcugggcugcccuccaaugugccucacgcaauaaagaauucucccucugcag

SEQ ID NO: 4485 - RNA, 2158 nt, Mus musculus
ccgccccgggcuucgccgggcgccauguuggguccuggcgagaauagucguucugucuggagccgcuuccggguggagcuuaacacaugagugauagcagcuccugcgggagccuucuccgcugccuucgcggcggggacagguuuuuguguaauugaggcguugugcugucaccgcaacaggcggaccgcggugaguacuaggcuagcccgcgcuaccuaccagucggcugggguucagaguaagccgcuuucuccaaagccaaugagaagacucagcggguaaaggcacguuaccaucaccaucacgguggagggagaggaccgacccgaguuguucgccagcuuuaaccggcgcgcacaggcaauagaaaugaauccuaggccgagcaugguggcgcacgccuuuaaucccagcacucgggaggcagaggcaggcggauuucugaguucgaggccagccuggucuacacagugagugccaggacagccagggcuacacagagaaacccugucucgaaaaaccaaaaaacaaaacaaaacagaguaagccgcuuucuccaaagccaaugagaagacucagcggguaaaggcacguuaccaucaugguggagggagaggaccgacccgaguuguucgccagcuuuaaccggcgcgcacaggcaauagaaaugaauccuaggccgggcgugguggcgcacgucuuuaaucccagcacuugggaggcagaggcaggugaauuucugagaucgaggccagccuggucuacagagugaguuccaggacagccagggcuacacagagaaacccugucucgaaaaacaaaaaaaaaacaaacaaacaaaaaaaaagaaaugaauccuagcaguugggggacagaggccccggauuucuggaaguucaaggccacugugguccacaaaguggagcauccgcagugagcuccuguuucagacaagcaguacaaucacgagaccuugcagagcuaacuuuccuaugagcuuggcuguguggcucuucguuucuuaacuauuucccagugcaccaggcaaaaagcagauguggagguaacugggaaaaugacuuuuuuuuuuuuaauugaaaguaggcucuuuuuccccauauaguauagacuuaucaggauuuccuucaagacgacgccccagauucuccccaggucccuacccacucaaagccacacauuuuuucuuuuuuaauuagaaaagaaacaggcaaauaaaacaaaaccagaauaggaugagaaacacaggcauaagcucacacauuuguaaaacaaaguuggaaaccauaacaugcaaccaaaagguccaaacagcaugaggcaaacaccuccaaaacuacuguugaguucauuuuguggccugcccuuaaagugugcuugguauauccaguaagacucuguuggagaagauaauuuuccauuugugaauggcugucaauuggagauagcuucugaauuaggguugaguugucuuccccucuuagcacuguggcccuuuucuggcuuagacccccacggguccugugcaugccaccagucuugaguucauaccuguuagccaugcuggguuuagagguccuguuauuugguguucucuaucccuacuccaagguuucacccugcacacuguccaguugugggucugucuuuauucccaucuacuucucuaaugcuggccgagcaaggcccuggucugcuuccccaccuauuaccagguagaaaauaccuccaagaagacacuuuuaaugacucagaaaguacauacauguuuaucguggugguuuuguuuguuuguuuuuuucaagacaggguuucucuguguaguccuggcacucaguuuguagaccaagcuggccagaaauccgccugccucugccucccgagugcugggauuaaaggcgugcuccaccaccgccuggcaugugccuggcauguuuaucguguuuuagguguaccacaugaaugcugugcucauagagaccagaagagugugcugauauggaaaugcaguuacugaugacuguggauacugagaauugaaccacuuccucuuccaaaagcagccucuuaaccucugagccaucucagcaacccuaaaaauauuuauuuuuuauguguaugaauguguugccuuuuu

SEQ ID NO: 4486 - RNA, 2158 nt, Mus musculus
aaaaaggcaacacauucauacacauaaaaaauaaauauuuuuaggguugcugagauggcucagagguuaagaggcugcuuuuggaagaggaagugguucaauucucaguauccacagucaucaguaacugcauuuccauaucagcacacucuucuggucucuaugagcacagcauucaugugguacaccuaaaacacgauaaacaugccaggcacaugccaggcggugguggagcacgccuuuaaucccagcacucgggaggcagaggcaggcggauuucuggccagcuuggucuacaaacugagugccaggacuacacagagaaacccugucuugaaaaaaacaaacaaacaaaaccaccacgauaaacauguauguacuuucugagucauuaaaagugucuucuuggagguauuuucuaccugguaauagguggggaagcagaccagggccuugcucggccagcauuagagaaguagaugggaauaaagacagacccacaacuggacagugugcagggugaaaccuuggaguagggauagagaacaccaaauaacaggaccucuaaacccagcauggcuaacagguaugaacucaagacugguggcaugcacaggacccgugggggucuaagccagaaaagggccacagugcuaagaggggaagacaacucaacccuaauucagaagcuaucuccaauugacagccauucacaaauggaaaauuaucuucuccaacagagucuuacuggauauaccaagcacacuuuaagggcaggccacaaaaugaacucaacaguaguuuuggagguguuugccucaugcuguuuggaccuuuugguugcauguuaugguuuccaacuuuguuuuacaaaugugugagcuuaugccuguguuucucauccuauucugguuuuguuuuauuugccuguuucuuuucuaauuaaaaaagaaaaaauguguggcuuugaguggguagggaccuggggagaaucuggggcgucgucuugaaggaaauccugauaagucuauacuauauggggaaaaagagccuacuuucaauuaaaaaaaaaaaagucauuuucccaguuaccuccacaucugcuuuuugccuggugcacugggaaauaguuaagaaacgaagagccacacagccaagcucauaggaaaguuagcucugcaaggucucgugauuguacugcuugucugaaacaggagcucacugcggaugcuccacuuuguggaccacaguggccuugaacuuccagaaauccggggccucugucccccaacugcuaggauucauuucuuuuuuuuuguuuguuuguuuuuuuuuuguuuuucgagacaggguuucucuguguagcccuggcuguccuggaacucacucuguagaccaggcuggccucgaucucagaaauucaccugccucugccucccaagugcugggauuaaagacgugcgccaccacgcccggccuaggauucauuucuauugccugugcgcgccgguuaaagcuggcgaacaacucgggucgguccucucccuccaccaugaugguaacgugccuuuacccgcugagucuucucauuggcuuuggagaaagcggcuuacucuguuuuguuuuguuuuuugguuuuucgagacaggguuucucuguguagcccuggcuguccuggcacucacuguguagaccaggcuggccucgaacucagaaauccgccugccucugccucccgagugcugggauuaaaggcgugcgccaccaugcucggccuaggauucauuucuauugccugugcgcgccgguuaaagcuggcgaacaacucgggucgguccucucccuccaccgugauggugaugguaacgugccuuuacccgcugagucuucucauuggcuuuggagaaagcggcuuacucugaaccccagccgacugguagguagcgcgggcuagccuaguacucaccgcgguccgccuguugcggugacagcacaacgccucaauuacacaaaaaccuguccccgccgcgaaggcagcggagaaggcucccgcaggagcugcuaucacucauguguuaagcuccacccggaagcggcuccagacagaacgacuauucucgccaggacccaacauggcgcccggcgaagcccggggcgg

SEQ ID NO: 4487 - RNA, 3090 nt, Mus musculus
ggcuugcuugagacuugcuuuauugucuuuggcaagggcugaaguacuaugguuggaggcauuggggguagaaggguccgguccggucacuugauuuaagcaguggacagcuuugguguuggugccugcgggugcccauuggcaucgccggugcagccauugguggcaggugugggcucuuucuugcaaggcagugggcugguggccaccaccucuccuggcuugaugccugggccuggacgcuccaucuugugcucuaauagcaugugguucuggggcgggagccccacgcaagcccugcaggggacagugcaggcucagcaagaccaucuuaaggcugucuuugccagcccugagcccuccccugccaccaggggcgcaccugaaaauauucucgauacagcugcgcuggcggaagagggcauucacuacagggcugcccgggggcacaagcggggccuuaaacaggaagcuaagcagggacagcacuguguggaagcccugaggcucgggguccgagucugugcagaagcucacgcgcugacacagcucugugagcagcacuagguccagcaugaugggcgcggccaggagcgaauccuagauuuuguuuggugcagggugugacgggucugaaggaucaucgcccacccugcccaccccgcccggcugcgcccaccacaccucgcagguauuauggagcaccaagguguuugucccacccagcaucagcucggagguguacucguccaaggcacgcuugcugucgccaacauagggcacauauuugaucaccaccugcagagauuuaaaaagucacauagccccaaacagcaccaagccccugcccucagugcccgccugcaaccgguugcacgcacacaguggucuggccgcucuccaggcgcguagagcacaugguugcugugaaccaugucguccaccacacugcucuuugucaccuccuuggagcggaacugcagcggugcagacagguucugcccgucguuguugcccaggugguuauagcucacgauggacauggucuguguggucaaagagacggugaaugcucugcaguacccucaccccggcuuccucccagcaccgcaugaagccuggagguaccuugagcccagagccgaugaggaaguccaccaggacagacuugaccuuagucugcccugacuugaagucaucaccaccuacaaacacauggcgcugcgaagccaguuccagggcaccggguaccaguguguucuguggggauccauugaggaaggcgcaguccuccaggaugcuggccacagcaaaaaguguggacggugacaccuccaggccaagcugagggcagagaaguagucggccaaggauuccucuggacccaaggauuccucuggaccggcacugauccccaggaaucuugggcaaacgcacaccuggauaguauguagcaaguuuucugcugugucauugcgaccugggaccaccucgcagaagcgcuccguauuggcgguccacagcacgaugaccuuauccaaucccgcacuggaucggaaaucucuaauguccuuucggauuugcuccaacugggaaaggaaggaggaagauuagguggagguugucuuaaguuguccggaggcuugggccccgggguauaggaauuauugccaaagggagagaccauguggccauguaacaggugacaguaaggccugggagugggucgaggaccccaccuguugggcacgugugccagggaugagguuguccgcacgugcugucugguuggcagcgaugaacucaggaauguagacugagggccgcggacgcaggcucuccauguggggccacagcuguuccugcagaccgcaguccaggaccugcgcgcgccgcauggccucggccagguucagcgacgagauaucccagccuggguugcggggacccuuaacacaggacccaucccguacccugggcccucccacacuuaaccccaucccgucccgaggcuuugcccaccaucaaacaccaggucguugggggccaccauggguagcagcgcacugaagggcacaaacaccucccggccguucucauccagacccaaguucacggugcccgccugggucaacgauccauaauaguuugccuccugggaagggagggggugcggcaagcagagcaggguguugaggggcugagggguccggcuugcugagacgcgcuaguccaacaagccacgccccucccccaguucugcucgccacacccccaccccguauucuccuaguagccacggcccccaccuugcgaccugugcgcgugggccagguuaggcgcagccgauuggccagaacagcagcagugagcguggagccguuguucccgccccagccgaccaacaugaccccgagucggggcaccugccgggcggugcggaaggugaaacgcguagcccugggcugcaccuaaggaagaguugggagugagucgcgggaccucggguucccaguguccuccgccgcccgcgccccgcgcgcacccgcagcacgccgcccucgcggcugacgcgcguuguccgguacucguagcgcgccucgaugguuucggggcuguagaccacguccgggcuauccacgaggaucucggcggcgggcuccaucguggcgagcugugggccagagccagugagcgcggaaucaccacccgagagccaaccuuacggccuaggauagguucguacuuaccggcccagaguuggaucagacugcggcagcggacagcgugggcccgagggcucuggggcagcgaagaaaaacgccgaugccacgccucgaccacgccccugaugggcgugacuugcgaccaggguucugggugcucuaaacccagguagccggaaggagucucaggcgcgagcgucuugcgcguuaccucgcugcgcacccuuguaccaccaggcagccaaugagcgauggccaccgacagggagguggggcaugucuggucgaggggcuuuuuggggggggggggggucucagagcugcucggcugucugucccgcccucucccaguccuccagcugcg

SEQ ID NO: 4488 - RNA, 2396 nt, Mus musculus
ugcuuggaaacuuuuauaguaagacaaacuaaguucauucccguuuuuaauuacauuuguuucucaaggacugggcuaggccccaccccuaaucuuaacuacaaauggcucugugcugcuucuuccaggcucauguaccccacuuauuuuacccaccaaaucccccauuuggaaauccucuacucuugagcuauaagacucuugucuuuuuuuuuuaauuagguauuuuccuuguuuacauuuucaaugcuaucccaaaggucccccauacccaccccccagacucuugucuucuuuacauucaauucugucuucuugaacccugccuuauguaaaaaugcuugcuuuaauuaacguugccaccuuuaauuggaucguggucuuccuccuccaauguuugggacaaauaacaguugugagcugccaugugggugcugggaauugaaccagaguccucugaaagagcagccagugcuccuaccagcugagccucccuaaaacaacuaauuaagccagguuggugucgaaggccaguaaucccggccugcugaggcaggagauggugaguuccagagaccuacaguuucucagaauuugagauaauccaaugcauaaauauguaaugccauuuggaagcucacaggggagcaccugucaugccuagugucaccaagugucacacauucacucugaauguggcugccgcggucaccaucguccucugcugcuaucucguggccacaucuggaacuacagcccauggcuguuuugagggucaggagagaaugggaugcagauucaucugcucagcaaauacuuauuggguucucuucacgaaaugagaguuugugagacuagcaugcauuaccagcacaccccaaaugaggaaccgguguuugguucugcugugcaaccccaggcagguugcuuugucacuuugacacugcucuacucuaugcaguuguaccaacgcuggguaggaaucagcaaaagaugaauuaagcccugugcuuggcgcugagcugaagauccgaggucggguggaaugggguacugcugggcgacagggcucggucuugcgggggaccaacacguaucagaaguguauccugucucaggaucggugcagcuuagaaguucucaagcggugggaacagucugcgggcugcgcugaaccucccggcggucgaccgggcgccagggugcggucuagugagggcggacgucucucucuccuuccagcguggcuccgagagagcagagguugcgcuggcaccgcagcacagagcaagcagcguccaaacucgggcuuuugcacccaguaacucuacuuugggaacuucguaccccgagagccagaggcacaggucgcccucaggacuccuuccuccuccacuccagguccacgucuccgggcuugccgcgugcaccagcugcggcugcccccuuccugguguuguuuggguuuuaauuuuuguguugcacuuagaaaauuacccauaauuacagcuacggagaggaagcagucuccguguacagccgugcuccagcugugcagccuccaaagcacagcugggaggggcuguggucccggacggagcgggaggggaugcguuuugcagcgacucccgcggcucgcgguuccccgcgagguggcccgggugucagucugaagcacccgcugucaauaauagugacaaaugagguguuuggugaaaucuagagaggacaucaaaaggcauggggacaggguagagaagggugaggaagaggagggaggaagaagaggaggggaaaagaugaacgaaauaaggggaagagaaggguuggaggaggaagaggagggggaggcagcccugcaguuccgggcccggccacacgggggcgcggcggaaccggcuccucugguggaugggguugucaugggacaggaucuucuagggaagaaaguuuaaucauucuguuuuuuuuuuucuggggggggggguccaguuugcagagccuggccaguuuagggaaacaggcaaucuggucccuacugcacccgagagaaaagggagcaggugagggguccccucaaaugccuuccauccucguuaguccaagucuguggccagaucacuguauuugacgcguauacuuacugcugugcuuaugcgugggagcacacguaccauugugcguguauaagucacaagaguagucaacaguuuccaucaugugggugccgggggcuaaacucaagucaucaagcuugguggcaagcgccuucaccugcugacaucucgcccaagggaaaaguuuucugggcucaccaucagccacucaugguggcucuugaaauaaagcucucccacucgcgagcugccgucuccagcacuuuaaccgugcgugug

SEQ ID NO: 4489 - RNA, 5331 nt, Mus musculus
gggucuuagcuccugcugccugccaggcacuuaucagcuaugugcccuccccuagcuggucccuacagccccuuuccaauagccugcugcagaaacuuccacgaagcaccugugaggguuaggagcuuggagaaguaaggacaguuuuuguuuguuuguuuguuuguuuguuuuuuaaagauuuauuuauuauauguaaguacacuguagaugucuucagacauuccagaagaggacaucagaucuccuuacagaugguugugagccaccaugugguugcugggauuugaacacaggaccuucagaagaguagucgaugcucuuaaccgcuaagccaucgcugcagcccuagggacagguuuuaagacuccuugacaacuccuagcuauguguugcuagcuaucucuucuuagauaccuuguggaauucugucccuuuuuccuguccugccucuauuuggggcggggcguggggguggggaucggaccucugaucacuguccaguucugaccuuuuccaggaccagaugucccccgaguaccugcccagagcugaggcacuuuaagugauuguucauugagugaauauuugcagagcccagcaaagaucaggaagcggguggaggggaagcugcgggccaaggagcucagggugaggucacagcaagagagaagugggacaguaaggccccuccuccucucgugagagccugaggcuggcagagggcucucugcuguccccuccacuccuacaccuacucgucuucccgucuucccgcaggcguggauuaacagguggaaagcaccaggagcugugaaccccaacccagacccuaggacccugaggcuuacgagacaucacgaaggccaggaggugagacucaaggcaacgucgcguccagcucacucgcggauugggcaauguagaauaauagcagggucugcaggaaagauggccaggaucgggcuaggagguuuccaggacaacaacucguuugcauacgguugugugguugugucuuggccagugagaggugcugcagagaugcaaagccugggcaggugugugugggggugggauagucuagucuuguggugggcaggugcaggaugcacccauuucacagaccagcauuuggaggcccaggaaccagggaaacccagagaaagguggccagccaggggccaugggcuuccaugucagaaaagccuuaacugguuggggugcuuuauuuggguuuuauugggucucacuaaguagacccggcuagccucgaacucgcagagauccaccugccucugccagacgaguacugggauuaaaggcacgagccacuacaugguuugaauuauuaaucuguauuuaaaacaaaaccaaaccaguguuuaacuuagguguuaccacacagguugcugggaugggaagcaucagaacuagguugcugugguuaugucuccugaugcuguuggcccugcuucacaagucaggaagucaagaucucaccugcaugguucacccgagcaggguagacuggacucagacauuuaauggcaccugccucaauuucaguggccuuggccugucccugccaaggagccccuugcaggccagccaugcucaaguccuggaccugucuaagaauggccugcaggugcucccuggggcuuucuucgacaagcuggaaaagcugcagacccugauugucacccacaaccagcuggacaguguggacaggucccuggccuugcgcugugaccuggagcucaaggcagacugcagcugugggcuggccuccugguaugcucuccgccagaacugcuccgggcagcagcagcuacugugucuacacccagccaccgaagcuccaaggaaccucuccaccuuccuucaggucagcuguccccccagcuggggcccggggaccauuggagcccuuguugcugggacuaucucccuggcuguggcugucaguggaucugugcuggccuggagacuucuucgccgccgccgcagagccagugagcacagccucagcaaagcccagauguccccacacgauauccccaaaccagugacagauuuccugccaagguacagcagccggcgaccuggccccaaggccccagacucaccacccagcagguucacaauggauuaugagaaugucuuuauuggccagccggccgaggacugcucauggucugcagccaggugagugaccauagaucccugcccacagugaacaaggacugcuuuagcaggacagaggcaugccccgucagagucagcggaauuaccagcuacucagcaguuggccugagacugucagcugggccuugugcaggcuguguggccaaguggcuucauauguucagaugagggcugcaggccuccccuccccuuuagggguugggguaagaguuuggaaaguuuccaaggggccaguccccacguugugagcuguaaacccagcucauaccucuggaggaagccaggcuccaggucaacuagggcuuggugaaaggucagcagcccgggcuccugacuucguggaugucuguguccccaugcuauagggacaucaauggaaucucccuguggcuuguaggaugcacagcaggugaggacuggauaaaaugaguaaggcuguuaggcuguuguccccaccuaccuucccacuucccagcggggggggggggugcaggggagagagagaguugagaaauuugugaguugccuguggagggugacccaccagggaaaaagagaaguugggcuggaagcugagguaggggauuuggguaucuugguugcugagaagaaaugauguauggaaaugagaugcaaauauugagaaaggggaagugacucauggagggggauggggaaggucaccaacauaggcugagccaaucugucaggggacuggagagauggccccgcccuaggccucacuggccccgcccuggccucacuggccccgcccuaggccuuucugaacuuccggaggacaguuggaggacgguucccuuccucgaacucacacaggguucagcggagccggucacacccucugccuucucaggcaaaagauaaugaaaaaaguuaaaaguaaacuccgggugggcuguguccaggcuggagugcucacccagacauccccucccugccauccagaccaguuggggugggcauguaaaaucugaguucaggaauagccugggcuacaugagacccugucucaaacacacgagccaggcgugguggcgcacgccuugaaucccagcacucaggaggccgaagaggcaguuggcuuucugaguucaaggccagccuggucuacagagugaguuccaggacaaccagggcuauacagagaaagaaacccugucucgaaaaaccaaaaaaaaaaacaaaaaaccaaaacaaaaacaaacacacaaacacaagcacaagaagcuggguucuggaacuggagagaagauaucagggcacaugugcacacaggcaacagcgagcguggaugcacagacacacauacaugcagaaacuauacaugcacauacggacucacacucacaugcacacgcaagcacagacacacauauucacucacaugcacacacacgcacacacacacaaauacaugcacacauguaaaugcacgaagcauacaugcacauacacagacaacacacaugcucacacacaugcagacacacacaugcacaaacacacacgcauaugccuacacgagugcacauauacaagucaaaucagguguguguuuuccacacuuuuuucuuguuuuguuuuguuuuucgagacaggguuucucucuguaguccuggcuguccuggaacucacucuauagaccaggcuggccucgaacucagaaaucugccugccucuacauccugagugcugggauucaaggcaugcaccaccaugcccgcucacacuuauuuuuuauuuauuuauuuuuuauaaaguaaucuuuuuuuuaagauuuauuuauuuauuauauguaaguacauuguagcugucuucagacacuccagaagagggagucagaucucguuacggaugguugugagccaccaugugguugcugggauuugaacucuggaccuucggaagagcagucgggugcucuaacccacugagccaucucaccagccccacacuuauuuuuaaugaugcugaaucaguaacuuucagaagagugggagucacacacugaguuggaaaacggguaggagcagagcaggagcauagaacugugagagccaggccagccugggcuagcuggugagacccugucucaggaagaaggaacagacagacaggcccaacccuggcugccuccugccucagucacccgccucugauguccaucuuccuccacagaaacagcccuucuggggacagugacugcuacaugaacuacaggagugucgaccaggacucucagcccgucuauugcaaccuggagucccuggggcgaugaggagaguguggucuccuggcgcugaaccagccuccgacagcccccaggauccagcacgcucaacaucacaggggguagaggacaccccacccccccacccccaaagcagaaggagggucagaaacaacccuccggucagugugcaugcaugugaugcucaauaaaagcucugggagcagcugacucuacgcaggacugaccggugguuuccggagaguccgaacuccaucagaacucucgguucugcacucugucuccucugcuugccuggcacccagcggcuguugagauccauacagggccuugugggcccucgcucagaggcuucccacggagaucucuggcccagccagaugcgaggguucaggcgaaagggagagaaccggagcagggagggagagucgccucugcugcugcagcugccuccaccucggucccugccgcugucccuucuguugcuccaagaccugcacgggucgcucugugcuggggggggggggggcgaggggcugagcugguagaaggcugacuagccagcagcuggggggagaggggagcuugggguggugcugaagagcugcuucuggcggcagaucucuucccuaagcggcaguguuacaggucuuaugacagaaacucucagugaguaauucucacacacauuuauuccuccuggauggacuuguuguuguuguuucgagacaggguuucucuguauagcccuggcuguccugaaacucacucuguagaccaggcuggccucgaacucagaaaucugccugccugugccucccaagugcugggauuaaaggugugcgcca

SEQ ID NO: 4490 - RNA, 3066 nt, Mus musculus
ccuugaugacaccuggugccccuccuugcucacuccugucuuccccagaggcccuaacuacagccacuacccuuucagggcccaggcugaccguggauggggcuccuggcaccuucauccuccuccuccaucuucuaucugagccugagacgaacugcccacccccuccagccaccugccgccuccuguuuggaaggaggcccgcagcagauuuccucuucccuccauucccaagaggaaccccuggucuggggauacugaggcaggcacagggcagggcacgugugagcauccagucauccugaaagguaaaucugguuccugaagcgacaacuguucguacaggguuuugaaggauugguaggagucccacagaggacaccgaagaggugcagucccugauuuguccuuaugucccagcccauuugggcacggcuguaaugucuacuccugggacacugaggcauaggggugacuugccugaacuugccuuuucuagguuuuccuuggcuucaccuuugauggggguggagggaggagggagggagagaggaggaaagagagagggagagaguccuggucccaagaggaaggaagaagccacuugaacuucagucuggacuccaucacauguucuguggggacgaucagcccucacucaggucccagcccggcgguuucccucccucccacccccucccccugcggagcccugggauucccgcccgaauuagccuggucacccgaguuggcaucgcacacgggggcggagcggacagaguccaguggguauaaaggcagcugcagagggcuuaacucaaagacacacucaggacacaagcgacauggccccgcccgcgcuccaggcccagccuccaggcggcucucaacugagguuccugcuguuccugcugcuguugcugcugcugcugucauggccaucgcagggggacgcccuggcaaugccugaacagcgacccuccggcccugagucccaacucaacgccgacgagcuacggggucgcuuccaggaccugcugagccggcugcaugccaaccagagccgagaggacucgaacucagaaccaaguccugacccagcuguccggauacucaguccagagggugaguagcaaccagggacccacuucaggaacacccucuccaagcuccaaccaacacacucaaguccacgagcccagcccagcuuccgagacucaguuuccccugcugugaccucuggagcugccagcagcgggcucagccagaguaggacggaugaccgucccuagaccggagcuggacaaaugauguccagagaggucaaggucgcuccuggagaugcacagcacucgaguuggggaggacaugggggaagguuagaggguccuggagggaagagggagggacaggagccagguugggagccaaacggaaagaaccugcgggaacuggaucggaaaucugacgcaaucgcuuguaaagagacugcuacaguaacaagugacagucgcuuggaugggagggaggaggauccaggggacuggacucagcucugggacccagcagggcugagggcgggcccaggcugauuugggucacgcccccuuacaaauccgcuaggguugugugaauccaagcgaacuguagcucucccuaaagaucugcaaagcuacacuuggaugugguggcgcaugucugccauccuaacuacuccggggguugaagcagaauugccuugaguucaaggccagcugggacuacagagugagaaccuccccaaauuuuauuuguagcccaggucgauuucaaacucagggcaauccuucugccuccauuucccaaguucugggaagacagguguaggcaaccaaacccugcuuuaaagaaaaccaacuucuguuuguuaaacacuuuauucagaggcuugggaaaagguuggagagauccaugcuguccugcgcagggcagaccuuagggaucucugucgcuaagagcaaaaucaacuuuaagccagaagguggcgguguacgucuuuaaucccagcacgaggguuuggggugggggugagggguggcacagaacaggcaaauaucugugaguucaaggccagccuggccuacauggagaguuaccaggacagccagggcuauacugagagaccuauguuugacaucugugcagacccuguggucggcgggaguggcacauuugcacaggggcacaucugugccuggcacacccuaaggacaugaguaaccgguguucugguuucuucugcagugagauuggggucccacggccagcugcuacuccgcgucaaccgggcgucgcugagucagggucuccccgaagccuaccgcgugcaccgagcgcugcuccugcugacgccgacggcccgccccugggacaucacuaggccccugaagcgugcgcucagccuccggggaccccgugcucccgcauuacgccugcgccugacgccgccuccggaccuggcuaugcugcccucuggcggcacgcagcuggaacugcgcuuacggguagccgccggcagggggcgccgaagcgcgcaugcgcacccaagagacucgugcccacuggguccggggcgcugcugucacuuggagacugugcaggcaacucuugaagacuugggcuggagcgacugggugcuguccccgcgccagcugcagcugagcaugugcgugggcgaguguccccaccuguaucgcuccgcgaacacgcaugcgcagaucaaagcacgccugcauggccugcagccugacaaggugccugccccgugcuguguccccuccagcuacaccccggugguucuuaugcacaggacagacaguggugugucacugcagacuuaugaugaccugguggcccggggcugccacugcgcuugagcaccgggcccugcuccucaccuacacuccccuucaaggaugcuauuuauauuuguauuuauuaauauuauuaauuuauuggggucgggcuggguggauggauuguguauuuauuuaaaacucugcuaauaaaggugagcuugguuucuau

SEQ ID NO: 4491 - RNA, 11315 nt, Mus musculus
cuccauguggcgacaaauaagcuucagacccaggaucaacaagaugaugacaugaagaaaccacaucagaacaaggaacacuagagcuuaaaaguagccaggcccagcacacaggcuuucacaagcccugcacugaguaggccgagguaggagggucaggauuuaaggucagcuucagcuacagugaauuggaggcuagccugggcuauaggagacccagucucacaaacaacaagaagauccagggaugagaagucacuucagaauucagauccaucaaucccguggggacaccgaggucucuauccauccacaaaagagaagguggcauccacaauguacuuggcuucacuggcaggaacuguacuuggucuuggaaggaguccaggucacaugcuacaucccacccuuccugagagccccuccuccuggcuuggcaguucaaagucagccagagacaaaggcuggcuggagucccuggcacacuuccaaaugcaguucagcagauaucccuguggcugauaggacaugcagggacaugccugggcaccgcagccucucaccccaggucccucacaggauauuagaggcuggcuaucucaagauggagaaaauccacagcuccaggugaugguucacacgguagguucugggucccaggugggccaugugugguggcaaacaccuguccccuuagugcuuaggaaacugaggccagaggaucaggaguucacacgaggccagccuaggcuaccugagacccugucuccaaagaaaaaacaaacaaacaacaaauacccucuaaaguuuagaguaucuaaaauuuuaagagucuuaaaauaucaaaaagagaacaagaaagaucauggcagggucggcuccccacaggcaccagaggcuacugcggccaggcccuugguggccauagcagccugcucuucugagcaaagggaacccacuauggagacccaaaguaugauggcauuuucagggcaggaggcaaaagaggccgcccuccccaggagaaaggaaagacacuuguugguuaggccugaagucuuaacaaugggaacauaaguuacgcuguucuguucuagcacugaaggaagguggguacaacaaagaaggauggggacagacagaggcagagagagacagacacagacagaaacagacagaagauagaaaaggcaaccaggucccaaguggcuuuggcggggaccaucuaggguuuaagacauggauuagagcuaaucuacuuuaugauacuuugugaggccccagccacagggcaagcuucaacuccuuguccauacaccugaaaaugcagacugcgucagggucaagguggccccauggcaugugugcagaccacuagcccuggccucugggcgcagaaguguccccagaugauauucagaugggagcucucucaauugcccccuugugguccauuaggaggggcagaugagucaggauggccccucucucggcaccgcacccagguguacauggcugucagagcuggcggcaacagcugaugucucccucggcuugcuccaggacacccagcaucuccucgaugauagcucguagcgcccggccuagcuggucggcguuguagggcuuacccagugggggcacguggacaaaagcggagcggccgcggcccugguagagcgauguauaauacgugaagucacacagauaccugagacagaugggaggaaaagucacagucacuaugucccaggccaaagccaccaggcuucugaaaaguccuucaaagcucuggggcacagcucuggggcacagcugggagguggaggagaaucuaggggucaggaauuugggggacccuggaugccuacucuccauuuucugaaaacguauuuugcugggcaugcacucagaaagcagaugcagguagaugucaggcugaggccagccuggucuaugcagaguuccaggucaaccugggcuacacagagaaacuaucuucaagccuaagguggagagugacugaggaaguuaucugcuguuuccuccccagccucccugcuggagaggaagcccccccacccaccccucagggccuggagccuaccugccagcauccugggagaugguaacagacacguccagucccaguguggucacccuuuugcacacggcguccaugucgaugauggagucgaugcucucgggaccauccuccacgcagcacugagagccggggcagaaccggcaauuauccaguccuuuguaacccuuguugugcccacauuuuuccagcgucacugugguggccaugcccgacaccccaacaugcacuacgagcuggggacaagagacaauugggggacgguuagcaggagcagcacccacccauacauggggaauaaaaacagugagucucuguuguuguugcuggaaaaugagcuauuaacguggcuaccuaggagcccaggguggccuuuggcuucaccuuugagacagggucucagacucucauguagcccaggcuguccuuaaauucaugaucgcuaagacgaugguuaucuaccaccacuguaccuugcuugagguauguuuuguuuuguuuguuuuuuaguuuuuugagaugguuucucuguguagcccuggcuauccuggaacucacucuguagaccaggcuggccuugaacucagaaauccaccuaccucugccucccaagugcugggauuaaaggcaugugccaccacugcccggcucgagguauguuuugaaaauuauuuuuuuauuaguauuuucuuugguagugcugagcggacaucaggaccucacauauaggacgggcuuggguaaguccuagcugguguacaggcacagaaggcagcaaggcccuaacagggcccuguaaggugugguguggcacuggccauauggcgguggccuuauggauggugugguggucugaaugagaauggcuccggagguucaucuauuugaauccuuaguuaccagggagcaguggaacagcuuggggacgauuaggagguguggucuuguuggaagaggugaauugcugggaguggagaguguguguugagguuucaaaagcucaggccaguccgugcuucugucugccugccucugcucccgugccugccugucugcgucuggaauugaugaucguggauuaacccuuagaaacugaguacaccccucguaagauauuggcuuuuaugaguggcuguggccaugaccauggugacuccucauagugacagaacagugacuaggcucuaggggguggggaucacuuucagcgaugcccugcugcccaccugggggcugugcuucucccacagugcugggaugagccucugcaccgucugguauuccacggggaucucguacacaugcagguccacgcuguccccgaggcccagcuucuccagcuccugggaggaaagacaggggggggugaggauggaggagcugcacggagccuucugugcccagacuccaggcagcucagcucaggguggcacaccaagaucacacagcacuugggagauggaggcagggagcaagagguuauccucugcuacauagaaaaacugaaagcagccuuggcugcaugagacucugccccuccucaaaaaacggagucuugacuucacauaacccacugaguucaucagcaguucaucaggugaccacugcagggcuaccugggaaaugccuuccugcaggagcccagggucuccagggaccaggagacacagugccugccugaggaagaaucaguagucacccauuuccacaacugugacaaggaccacaucauaaaaaaggggguaagccaggcaucacugucauagugcugagaacugucuuaacacuugagaggcugaggcaagagaacugcuauauuaaggccagccucuucuacacaaagaauuccaggcuagccuagguuauauagugagauucuaucucacacaaacaagaaacaaaaaaagcaaaaaaagguuuggggcugaagcucagcugguuagcauaguuguagcucaauuggaagagaguucagccagcaugugggcaaagccuggauuucuucccagcaccacauaaacugguguggugguacaugccuaucaucccagacacuugggagcuggagacagugggaucaggaguucaaagagacccugucucaacaaacauacacccuagacucaaacaaacaaagaaacaaaaucugaaggaauuaaaaaacacaaaggucuaguuucuuuggguuugcacuggggcaguggaaguacgccaucugcuggcugaguggggaaggggcaaagggcaagucguagccauggcaacuggauuugauggccuuuggaacuucauucauaaacaggaaaacaaaauaaacuucccccagcagagcagauggugugaaucauucaagacucugaggcaagaggauugcugugagucccaggaaaaccugggcugcugaggaacccuaucucaaaaaucaaaacaguacuggagagagguaagagcucugccgcucuuccagaggaccugaguucagcuuccagcuccagcaucaaguggcuguagccucuaaggaaugcugggucucaggaggcaucugcauacagguggcucccagaacaagcauuuacaugugcauaauuuaaauauaucuaauuuaaaaauaaaaauaaaacaaaagaacaugccuggcaucacauccugucgcccauuuugggagauggaggcagcaagcaggaagaaguucaaggucagccugggcuacauaguaagugcuuugggggccagccugggcuauaugagacucugucaauaaauaaauaaauaaauaaauaaauaaauaaauaaauaaauaaauaaauaaauaaagcagagaggccagauguggcaaugcacacauuuaauuccagcacuugaggaauuugaagaggaucucugugaauuugaagccagucuggucuuguaagaguugcaguauagccagggcuauuuagagggacaaucccaaaaagcaccaaaaauaaaacaaacacuaaaauaaguaaauaacuccauauccuuucaccccagauccuauucaguguuugcucaggggcccuggugaugcccaguugcccccacguguuuuauuugaaucaggauguaaaucuauaguucacaaaagcaggaaaugaaaccagggucaggcacuaagaccauucaccaacaccccaacccuucaaggggugcacucagggcagaacagagccaccccacccaugggcacacacaucaagacaccccaggugacuggccuucagcagcacacaccugucaugccugcacuggagucugagacaggagaacagaauguggggcagccuaggcuacagagugacacugucuccaaaaaaaaaaaaaaaaaaaaaaaagguuaaguuuucuguuaggggcuaguuguuccuguucuagccaggauuaacuaugcccagucuagugcaggccuccuagcucuccugccucugccuccccagugcugggauagcagcugugggccaccacacccacagucuugccaucguaucuuugaggagcuccccaagaacaaauucaguagcacuggcucccucacugagacuaauggcugccugggccuccagagacuccucaugcuguucccacaggccacccuguucccaaugguggccuggaaggacaggcacaugacaggauauuggugacaggauauugaugaagguauacaccugucagcucuaucaucucugcacgucuuacaaggccaaggccaaggcucaggaguucuuagcugauagugaguuugaggcuaaccugggcuacuugagauccugugucagacaaaaacaaaaacaaaaacaagaaaacaagcaaaacacaaaaugccaggcauaguggcacacagcuuuaaauccagcacuugggacacagguguaagaggaucucugacuucaaggccaaccugguuauauagugaguuccagaauagccagggcuauacagagaaacccugucucaaaaaaacaaacaaaagacacacuccgccccccuacacaagaugaaugacugaggucuagcuggggggcucggcacucacccucaucccauggcuaguaccuucaaacagcaggacucacauauggaccggguaagugaugugggacucagggcuucaccuagaaaaccugaggugggugcgagcugguauuuaaugucucugugaaggccaggcgcuaucagaagacaagcacccuuccaugcugacacucugcuuuuuguggggacucuauggcugagaaggccauuguaguggggacuggucacagaugugcaaguagugucacccuucaccagauucugccuuuugucccuggacaccugguuccagcucucucaggagaagagggcugugagccccacaucccacuuccugaauccuggcucaguacccagcacccugggaaacaccaggcagggcuucagcuguggcauuguccugggucaucuaccugaaaagacucugucgcaaaagcaggcauggcugcaucugaccaauugauucccuugaccccagcacaaagcccucuuuguuugcugguacccuuagcaggucugucuagacuugugguggcaguaauuaucccaggaugucaccacgucuguggcccacucagggagucugugaagaaacaagucagagucagccugguccuugacacccaccugaaccucccaggaaacaaccuggcaccccagacccaggggaaaugaagagaaagccggugugagggcaggcacccucuacaauuccagcacuccggaaacugaggcaggaaaaucaccuggaguuugaaacuagccaagauacagaguaaaaugugauugauuaguuaaccaaucaaaggaggcaggcacaacaguguacaccugucaccccagugcuagggaggcugaggcagaagaaucaggaguucaaagucagccagagugagauccugccucaaaacuuaaaaacaaaaguaaggcucaagggugaugaagcccguggcccagccuggucuccaugcuccauucagagcacucacacaguggaaggagagaagcugguccagagagcuacccucugaccuccacaggcgugcucuuccacacucgcaaucaucaaaugcaaaaacaaauaaaauauuuuaaaggaauagguugaggaacagucuuggucuauucaggacccggaguuucccccaguccaagagcuccaaggggauauucacaaagauuguuuaauugauuuuccuucccauuuacaugcagauggcggugucuggggcccaggaauccagacacuggcuuuguguccacuuagcccgugaagccuccugucuguaacucgcacaaagccagacacacaagucuucugagacacacuggggcuuuuugucugguggucccgggaguggaugcacaagcaggggcccggccacacucccaucugcgaggucccugggaccccgggguccuccaccuggcucacagagugaagguggaaagaaaagagggaggugcuaaagcagcugggacuucugaggucugcagcacggggagggugacaggcugguggugggggacgugggagucucgggugagaagagagaacccuuaaaucacacagcuaaugggcuaaaauuaauccuggucugcugccgucccagccaguuauuaccaaagaaucaaacgucuguuucucuccacucaauuguucccuagucugucugucugaaugucccaucuggcaaggaaauacaaguuaguagagucacuucuuggauggcacucugggaagagccacccccugagguucucagugaagagacugagucccugcccagggcgccugcuccccagccacagggaacccgccggaacacacuccaccuuucuuuucuuuucuuuuguuuuuguuuuguuuuguuuguuuguuuguuuguuuuucgagacaggauuucucuguguagcccuggcuguccuggaacucacucuguaggccaggcuggccucugccucccaagugcugggauuaaagguguguuccaccauaccaggucaauugaaaagguuuucagcuacugcucaggaggcugaggcaggaggaucaugagcuugggcuauauagaauuacaucuuggguuuaaaaaaaaaaaaagucaagguuaaaauucacuguuaaauuguauuaaguacuuggaaagauacucagcuccuggcgaggcuccucccccagaucagaguuaccuggacagcgauccagcuggcauucacaguaugcuccccaaaagggccgaauccugaaaacaggaaaagagaaguuauucucucuucuuaccugaguucugaaaucucauccccagacacaccccuauucuagcuucuuauccaguccuuccugguaugccccagcuaugggcuguggccucaacuugcugaguccuggggugacaggcacaggcuuccuugucccaauuggguccucacaccugggaggaccuaguuagccucucucuucaaugcucuguucuccagccaaaauccaacuacucuaucacugucuggguggggcuguggaccaccacuacuuuaagauuagcucacagagacugggaggggggugucuccaggacaggcuggguggacaccagacugcuucugcuuuuggucaguucaaccuucaaccuccagguccuaucucugaccaagacagaccuccaaggccuuguggcauuuggcuccauucccucugaagucaggguuuccagggccuaacugucaugagcaagaagugacgcagagagggggcugacucuaccaggucacacagcaggagugggaagaggcugggauuuaucccauauggguaacucggccuccuucucuagccacuggguugccaagaaaaguuaaauugagaaaaacaaaaaccagcccacuggccucugggugccauggugcagacccagacuccaagacuguuucaggccaguccaggcuacaugagacccugcuucaaaauaaauaaauacagcuggaaagauaccucagucaguugccacacagggcccgaguucagcucuccagcaccauauaccggaggugaggaggcacaaacuuguauucccagggcugaggaagcagagacaggcagucuggggcgcuauggccaguuagucuagccuaacuggcaagcucuagagcagggguucucagccuuccuaaugcugccauccucucuuucuuucucucuuuugcuacuucauaacuguaauuuugcuauuguuaugaaucauaauauaaaaaucuguguuuccccacaaucugaggugacccuugugaaagggucaauuggcccacaaaggggucgugacucacagguugaaaaaugcuaccucugaaugcguccuaaauugagacacuuucucaaaacagagguggauggagccugaguaaugacacccaagguuaaccucuacacacacacacacacacacacacacacacacacacacacaucuaagaaccuggguuaguguaacucaggugguaagagccugcugccaguguuaagagguuaagagagagccaccauaccucaggacagcagguagaggacacaucuuggggcaucucaucaugguggcacaugcugcucacccuaucauuuggaaguuugaagcuaaaucaucacccuggguuuguagccagccuuggucacagaguuaaguuccaggucagcaggauagugcaacagaaugagacucuaucuuaauaaaccaaccaaccaaauaaacacccccacccccagaaugcuccaauggaucagggacacugucguucacacuuguacugcagggaacagcagggagaaagucccaaccuuucucaguuauaaaacaccuguaggagugggaguuuuuccuggcucacucccuguggccucucagggcagaggcuaacccgagugcccuccuccaaggccuggaaauaagaacaguuggcuuccgggggugcuggugacaguaggagcuggucucuagagucccugggucauuccggggucagguugacuccaggcccaacaccugccccaaaccggguugcaggccccuccaacaauacaaggugccaggagcagaagcugagcggaucguaugucacugggacuuuuccuggccguaaacccgccuuuguccccggggucagcggguggggacaugccagagcucugaagaggcagggagggacugcaguacgcgaggugaccugucugcacccuaguccccgcgcacuccgaacucccggccgcgugaccccggacuuuccagguuaccaggaccgaacggugcuaucgcgggcggcgacaacugcaaaccucuggcaaccgcgaacacuugccccgccgccccgguccagaugcaccuaccgguuaccacuaccgccuuccgcggcugcuccaugguggaaugcacucucuaggauccuggcuguagggacuggagcggacacggacccccgagccccgcccggccgcucggccccgcccccuaacgcugggccugcgcggacacgccccggacacgcccccgaccagcuguacgcuccccugcgcggccccccggguuccgccgagccccaagcgcaccacuacacccuggaccccaacgcccgggccaggccauuccuaggccacgccuccuagaaaccacaccccuagccaaccccgcccccagucuuccaaagacccuccuccagguccuguaagggacccaccacgcccccaagaaucacacgccuggagcuuuccaaacucucaggucggggucacgcuccagccaggucccaagcucccaagacacucccaaacccauccuuaaaacaacugggcccaggucauguaccuccgccuacucccacgcaagugcagauccuuccaaugccccucggccaggccgcaguccacguucacacccgcgacccaugacaucccuggcucaggccaugcucucugaaacuucuuccuucuaaaaucuacuccgcccugaacccaccuagggcaacgaccccgaccccccuucccuuuaugccacugaaaacacugagcugggcaugcauaccgggucuccaucuaggcuccgcccccagucuaccaccgccagguucccuguggccgcagggcucacaagguaccuggagccaugccccg

SEQ ID NO: 4492 - RNA, 11315 nt, Mus musculus
cggggcauggcuccagguaccuugugagcccugcggccacagggaaccuggcggugguagacugggggcggagccuagauggagacccgguaugcaugcccagcucaguguuuucaguggcauaaagggaaggggggucggggucguugcccuagguggguucagggcggaguagauuuuagaaggaagaaguuucagagagcauggccugagccagggaugucaugggucgcgggugugaacguggacugcggccuggccgaggggcauuggaaggaucugcacuugcgugggaguaggcggagguacaugaccugggcccaguuguuuuaaggauggguuugggagugucuugggagcuugggaccuggcuggagcgugaccccgaccugagaguuuggaaagcuccaggcgugugauucuugggggcguggugggucccuuacaggaccuggaggagggucuuuggaagacugggggcgggguuggcuaggggugugguuucuaggaggcguggccuaggaauggccuggcccgggcguugggguccaggguguaguggugcgcuuggggcucggcggaacccggggggccgcgcaggggagcguacagcuggucgggggcguguccggggcguguccgcgcaggcccagcguuagggggcggggccgagcggccgggcggggcucggggguccguguccgcuccagucccuacagccaggauccuagagagugcauuccaccauggagcagccgcggaaggcgguagugguaaccgguaggugcaucuggaccggggcggcggggcaaguguucgcgguugccagagguuugcaguugucgccgcccgcgauagcaccguucgguccugguaaccuggaaaguccggggucacgcggccgggaguucggagugcgcggggacuagggugcagacaggucaccucgcguacugcagucccucccugccucuucagagcucuggcauguccccacccgcugaccccggggacaaaggcggguuuacggccaggaaaagucccagugacauacgauccgcucagcuucugcuccuggcaccuuguauuguuggaggggccugcaacccgguuuggggcagguguugggccuggagucaaccugaccccggaaugacccagggacucuagagaccagcuccuacugucaccagcacccccggaagccaacuguucuuauuuccaggccuuggaggagggcacucggguuagccucugcccugagaggccacagggagugagccaggaaaaacucccacuccuacagguguuuuauaacugagaaagguugggacuuucucccugcuguucccugcaguacaagugugaacgacagugucccugauccauuggagcauucuggggguggggguguuuauuugguugguugguuuauuaagauagagucucauucuguugcacuauccugcugaccuggaacuuaacucugugaccaaggcuggcuacaaacccagggugaugauuuagcuucaaacuuccaaaugauagggugagcagcaugugccaccaugaugagaugccccaagauguguccucuaccugcuguccugagguaugguggcucucucuuaaccucuuaacacuggcagcaggcucuuaccaccugaguuacacuaacccagguucuuagauguguguguguguguguguguguguguguguguguguguguagagguuaaccuugggugucauuacucaggcuccauccaccucuguuuugagaaagugucucaauuuaggacgcauucagagguagcauuuuucaaccugugagucacgaccccuuugugggccaauugacccuuucacaagggucaccucagauuguggggaaacacagauuuuuauauuaugauucauaacaauagcaaaauuacaguuaugaaguagcaaaagagagaaagaaagagaggauggcagcauuaggaaggcugagaaccccugcucuagagcuugccaguuaggcuagacuaacuggccauagcgccccagacugccugucucugcuuccucagcccugggaauacaaguuugugccuccucaccuccgguauauggugcuggagagcugaacucgggcccuguguggcaacugacugagguaucuuuccagcuguauuuauuuauuuugaagcagggucucauguagccuggacuggccugaaacagucuuggagucugggucugcaccauggcacccagaggccagugggcugguuuuuguuuuucucaauuuaacuuuucuuggcaacccaguggcuagagaaggaggccgaguuacccauaugggauaaaucccagccucuucccacuccugcugugugaccugguagagucagcccccucucugcgucacuucuugcucaugacaguuaggcccuggaaacccugacuucagagggaauggagccaaaugccacaaggccuuggaggucugucuuggucagagauaggaccuggagguugaagguugaacugaccaaaagcagaagcagucugguguccacccagccuguccuggagacaccccccucccagucucugugagcuaaucuuaaaguaguggugguccacagccccacccagacagugauagaguaguuggauuuuggcuggagaacagagcauugaagagagaggcuaacuagguccucccaggugugaggacccaauugggacaaggaagccugugccugucaccccaggacucagcaaguugaggccacagcccauagcuggggcauaccaggaaggacuggauaagaagcuagaauaggggugugucuggggaugagauuucagaacucagguaagaagagagaauaacuucucuuuuccuguuuucaggauucggcccuuuuggggagcauacugugaaugccagcuggaucgcuguccagguaacucugaucugggggaggagccucgccaggagcugaguaucuuuccaaguacuuaauacaauuuaacagugaauuuuaaccuugacuuuuuuuuuuuuuaaacccaagauguaauucuauauagcccaagcucaugauccuccugccucagccuccugagcaguagcugaaaaccuuuucaauugaccugguaugguggaacacaccuuuaaucccagcacuugggaggcagaggccagccuggccuacagagugaguuccaggacagccagggcuacacagagaaauccugucucgaaaaacaaacaaacaaacaaacaaaacaaaacaaaaacaaaagaaaagaaaagaaagguggaguguguuccggcggguucccuguggcuggggagcaggcgcccugggcagggacucagucucuucacugagaaccucaggggguggcucuucccagagugccauccaagaagugacucuacuaacuuguauuuccuugccagaugggacauucagacagacagacuagggaacaauugaguggagagaaacagacguuugauucuuugguaauaacuggcugggacggcagcagaccaggauuaauuuuagcccauuagcugugugauuuaaggguucucucuucucacccgagacucccacgucccccaccaccagccugucacccuccccgugcugcagaccucagaagucccagcugcuuuagcaccucccucuuuucuuuccaccuucacucugugagccagguggaggaccccggggucccagggaccucgcagaugggaguguggccgggccccugcuugugcauccacucccgggaccaccagacaaaaagccccagugugucucagaagacuugugugucuggcuuugugcgaguuacagacaggaggcuucacgggcuaaguggacacaaagccagugucuggauuccugggccccagacaccgccaucugcauguaaaugggaaggaaaaucaauuaaacaaucuuugugaauauccccuuggagcucuuggacugggggaaacuccggguccugaauagaccaagacuguuccucaaccuauuccuuuaaaauauuuuauuuguuuuugcauuugaugauugcgaguguggaagagcacgccuguggaggucagaggguagcucucuggaccagcuucucuccuuccacugugugagugcucugaauggagcauggagaccaggcugggccacgggcuucaucacccuugagccuuacuuuuguuuuuaaguuuugaggcaggaucucacucuggcugacuuugaacuccugauucuucugccucagccucccuagcacuggggugacagguguacacuguugugccugccuccuuugauugguuaacuaaucaaucacauuuuacucuguaucuuggcuaguuucaaacuccaggugauuuuccugccucaguuuccggagugcuggaauuguagagggugccugcccucacaccggcuuucucuucauuuccccugggucuggggugccagguuguuuccugggagguucaggugggugucaaggaccaggcugacucugacuuguuucuucacagacucccugagugggccacagacguggugacauccugggauaauuacugccaccacaagucuagacagaccugcuaaggguaccagcaaacaaagagggcuuugugcuggggucaagggaaucaauuggucagaugcagccaugccugcuuuugcgacagagucuuuucagguagaugacccaggacaaugccacagcugaagcccugccugguguuucccagggugcuggguacugagccaggauucaggaagugggauguggggcucacagcccucuucuccugagagagcuggaaccagguguccagggacaaaaggcagaaucuggugaagggugacacuacuugcacaucugugaccaguccccacuacaauggccuucucagccauagaguccccacaaaaagcagagugucagcauggaagggugcuugucuucugauagcgccuggccuucacagagacauuaaauaccagcucgcacccaccucagguuuucuaggugaagcccugagucccacaucacuuacccgguccauaugugaguccugcuguuugaagguacuagccaugggaugagggugagugccgagccccccagcuagaccucagucauucaucuuguguaggggggcggagugugucuuuuguuuguuuuuuugagacaggguuucucuguauagcccuggcuauucuggaacucacuauauaaccagguuggccuugaagucagagauccucuuacaccugugucccaagugcuggauuuaaagcugugugccacuaugccuggcauuuuguguuuugcuuguuuucuuguuuuuguuuuuguuuuugucugacacaggaucucaaguagcccagguuagccucaaacucacuaucagcuaagaacuccugagccuuggccuuggccuuguaagacgugcagagaugauagagcugacagguguauaccuucaucaauauccugucaccaauauccugucaugugccuguccuuccaggccaccauugggaacaggguggccugugggaacagcaugaggagucucuggaggcccaggcagccauuagucucagugagggagccagugcuacugaauuuguucuuggggagcuccucaaagauacgauggcaagacugugggugugguggcccacagcugcuaucccagcacuggggaggcagaggcaggagagcuaggaggccugcacuagacugggcauaguuaauccuggcuagaacaggaacaacuagccccuaacagaaaacuuaaccuuuuuuuuuuuuuuuuuuuuuuuuggagacagugucacucuguagccuaggcugccccacauucuguucuccugucucagacuccagugcaggcaugacaggugugugcugcugaaggccagucaccuggggugucuugaugugugugcccaugggugggguggcucuguucugcccugagugcaccccuugaaggguugggguguuggugaauggucuuagugccugacccugguuucauuuccugcuuuugugaacuauagauuuacauccugauucaaauaaaacacgugggggcaacugggcaucaccagggccccugagcaaacacugaauaggaucuggggugaaaggauauggaguuauuuacuuauuuuaguguuuguuuuauuuuuggugcuuuuugggauugucccucuaaauagcccuggcuauacugcaacucuuacaagaccagacuggcuucaaauucacagagauccucuucaaauuccucaagugcuggaauuaaaugugugcauugccacaucuggccucucugcuuuauuuauuuauuuauuuauuuauuuauuuauuuauuuauuuauuuauuuauuuauugacagagucucauauagcccaggcuggcccccaaagcacuuacuauguagcccaggcugaccuugaacuucuuccugcuugcugccuccaucucccaaaaugggcgacaggaugugaugccaggcauguucuuuuguuuuauuuuuauuuuuaaauuagauauauuuaaauuaugcacauguaaaugcuuguucugggagccaccuguaugcagaugccuccugagacccagcauuccuuagaggcuacagccacuugaugcuggagcuggaagcugaacucagguccucuggaagagcggcagagcucuuaccucucuccaguacuguuuugauuuuugagauaggguuccucagcagcccagguuuuccugggacucacagcaauccucuugccucagagucuugaaugauucacaccaucugcucugcugggggaaguuuauuuuguuuuccuguuuaugaaugaaguuccaaaggccaucaaauccaguugccauggcuacgacuugcccuuugccccuuccccacucagccagcagauggcguacuuccacugccccagugcaaacccaaagaaacuagaccuuuguguuuuuuaauuccuucagauuuuguuucuuuguuuguuugagucuaggguguauguuuguugagacagggucucuuugaacuccugaucccacugucuccagcucccaagugucugggaugauaggcauguaccaccacaccaguuuauguggugcugggaagaaauccaggcuuugcccacaugcuggcugaacucucuuccaauugagcuacaacuaugcuaaccagcugagcuucagccccaaaccuuuuuuugcuuuuuuuguuucuuguuugugugagauagaaucucacuauauaaccuaggcuagccuggaauucuuuguguagaagaggcuggccuuaauauagcaguucucuugccucagccucucaaguguuaagacaguucucagcacuaugacagugaugccuggcuuacccccuuuuuuaugaugugguccuugucacaguuguggaaaugggugacuacugauucuuccucaggcaggcacugugucuccuggucccuggagacccugggcuccugcaggaaggcauuucccagguagcccugcaguggucaccugaugaacugcugaugaacucaguggguuaugugaagucaagacuccguuuuuugaggaggggcagagucucaugcagccaaggcugcuuucaguuuuucuauguagcagaggauaaccucuugcucccugccuccaucucccaagugcugugugaucuuggugugccacccugagcugagcugccuggagucugggcacagaaggcuccgugcagcuccuccauccucaccccccccugucuuuccucccaggagcuggagaagcugggccucggggacagcguggaccugcauguguacgagauccccguggaauaccagacggugcagaggcucaucccagcacugugggagaagcacagcccccaggugggcagcagggcaucgcugaaagugauccccacccccuagagccuagucacuguucugucacuaugaggagucaccauggucauggccacagccacucauaaaagccaauaucuuacgagggguguacucaguuucuaaggguuaauccacgaucaucaauuccagacgcagacaggcaggcacgggagcagaggcaggcagacagaagcacggacuggccugagcuuuugaaaccucaacacacacucuccacucccagcaauucaccucuuccaacaagaccacaccuccuaaucguccccaagcuguuccacugcucccugguaacuaaggauucaaauagaugaaccuccggagccauucucauucagaccaccacaccauccauaaggccaccgccauauggccagugccacaccacaccuuacagggcccuguuagggccuugcugccuucugugccuguacaccagcuaggacuuacccaagcccguccuauaugugagguccugauguccgcucagcacuaccaaagaaaauacuaauaaaaaaauaauuuucaaaacauaccucgagccgggcagugguggcacaugccuuuaaucccagcacuugggaggcagagguagguggauuucugaguucaaggccagccuggucuacagagugaguuccaggauagccagggcuacacagagaaaccaucucaaaaaacuaaaaaacaaacaaaacaaaacauaccucaagcaagguacaguggugguagauaaccaucgucuuagcgaucaugaauuuaaggacagccugggcuacaugagagucugagacccugucucaaaggugaagccaaaggccacccugggcuccuagguagccacguuaauagcucauuuuccagcaacaacaacagagacucacuguuuuuauuccccauguaugggugggugcugcuccugcuaaccgucccccaauugucucuuguccccagcucguagugcauguuggggugucgggcauggccaccacagugacgcuggaaaaaugugggcacaacaaggguuacaaaggacuggauaauugccgguucugccccggcucucagugcugcguggaggauggucccgagagcaucgacuccaucaucgacauggacgccgugugcaaaagggugaccacacugggacuggacgugucuguuaccaucucccaggaugcuggcagguaggcuccaggcccugaggggugggugggggggcuuccucuccagcagggaggcuggggaggaaacagcagauaacuuccucagucacucuccaccuuaggcuugaagauaguuucucuguguagcccagguugaccuggaacucugcauagaccaggcuggccucagccugacaucuaccugcaucugcuuucugagugcaugcccagcaaaauacguuuucagaaaauggagaguaggcauccagggucccccaaauuccugaccccuagauucuccuccaccucccagcugugccccagagcugugccccagagcuuugaaggacuuuucagaagccugguggcuuuggccugggacauagugacugugacuuuuccucccaucugucucagguaucugugugacuucacguauuauacaucgcucuaccagggccgcggccgcuccgcuuuuguccacgugcccccacuggguaagcccuacaacgccgaccagcuaggccgggcgcuacgagcuaucaucgaggagaugcuggguguccuggagcaagccgagggagacaucagcuguugccgccagcucugacagccauguacaccugggugcggugccgagagaggggccauccugacucaucugccccuccuaauggaccacaagggggcaauugagagagcucccaucugaauaucaucuggggacacuucugcgcccagaggccagggcuaguggucugcacacaugccauggggccaccuugacccugacgcagucugcauuuucagguguauggacaaggaguugaagcuugcccuguggcuggggccucacaaaguaucauaaaguagauuagcucuaauccaugucuuaaacccuagaugguccccgccaaagccacuugggaccugguugccuuuucuaucuucugucuguuucugucugugucugucucucucugccucugucuguccccauccuucuuuguuguacccaccuuccuucagugcuagaacagaacagcguaacuuauguucccauuguuaagacuucaggccuaaccaacaagugucuuuccuuucuccuggggagggcggccucuuuugccuccugcccugaaaaugccaucauacuuugggucuccauaguggguucccuuugcucagaagagcaggcugcuauggccaccaagggccuggccgcaguagccucuggugccuguggggagccgacccugccaugaucuuucuuguucucuuuuugauauuuuaagacucuuaaaauuuuagauacucuaaacuuuagaggguauuuguuguuuguuuguuuuuucuuuggagacagggucucagguagccuaggcuggccucgugugaacuccugauccucuggccucaguuuccuaagcacuaaggggacagguguuugccaccacacauggcccaccugggacccagaaccuaccgugugaaccaucaccuggagcuguggauuuucuccaucuugagauagccagccucuaauauccugugagggaccuggggugagaggcugcggugcccaggcaugucccugcauguccuaucagccacagggauaucugcugaacugcauuuggaagugugccagggacuccagccagccuuugucucuggcugacuuugaacugccaagccaggaggaggggcucucaggaagggugggauguagcaugugaccuggacuccuuccaagaccaaguacaguuccugccagugaagccaaguacauuguggaugccaccuucucuuuuguggauggauagagaccucgguguccccacgggauugauggaucugaauucugaagugacuucucaucccuggaucuucuuguuguuugugagacugggucuccuauagcccaggcuagccuccaauucacuguagcugaagcugaccuuaaauccugacccuccuaccucggccuacucagugcagggcuugugaaagccugugugcugggccuggcuacuuuuaagcucuaguguuccuuguucugaugugguuucuucaugucaucaucuuguugauccugggucugaagcuuauuugucgccacauggag

SEQ ID NO: 4493 - RNA, 5524 nt, Mus musculus
cucuuucuaugguguuugcuuuuauuuuucaaacagaagauguacaggguauggcugguaaaggacaggugagccgccaugggcugagccugcagcuccaacugaaacucaaacaugccuggaagaagucagcccuucaaagggcaucuaaggcuccacaggcaccucagacucggaaccuuccagaaacugagucaguggccagcgagggacuucacuggaccagacgccaaguggggcuucacacaaaggugcccugaggccucacccaccguucugggcucggcucaggcagggagugaucacuguuugccugccugccgcccuggcuucuucucgggcuggccucggccugcaccugggaugccaccccggccccggccaccaaacacaccugcacagaacagaaaaggcagaguuagacaccagcgucccuagacagggacaagggucuuccccucugugcccugguccacugcgcaaggguccugugggagauuccagguuguacucagccuacaggagcccacaccaccaugcccuacaugugauugaagagggugcagagaggcgagugcccaggugucccucccccaccucauccucacagggaccccaccucggccagcgccgcccaugccucggccuuucugcugcuucugcugcugcgguccuccucgcccucggcccuuggcggccuccucccgcaccaugucaaugaucucaucagggaugcgcagguacuugauggugcugccacggauguagcacucaggcauccuccagaacuugucaccauccuguggagaggggaagugugacaggugggcauaguccauccaggccagcagugcacccuccccgcaugaccacucacccgcgacgugcagaucaccucccggagguugauguucauccaguugucacagcucaccagaugcccguuguaggucuccccauucuucagcuccaccagcugugggagagcccaucagccuagcucaaacacagcuggcuucccaucccaaacuacagcuuucugggugugcuuugggaucaaccucuaagggcuggcugccgcucagcucauaagugggugcugugauaagcaggcaccgcccagguuccccacccaauguauggacaaagacaaauuaaaacuccacacuagcugggcaugguggcacacaccugugauuccagaacucuggcggcugaggcaggaggauagugaggaaacaaugggcaagcccagucuagucaccuacagaaggaguguuaacacagccaagaaaaugacucaaaaccacugagugacagacaagccacacucagaaaugcucacaaaaugcaaaggagcagacgucaggugggagcagugcacaggcaaccagggcugggguagacccgaggugggugcugaggggaaaugagaagaggcugggcucuggcuguguggagucuauaaacacacuacacaccacagaggcauggcuccuucuguggcaccucggauggaacccaggccugcagcuugcugggccaugccuuggcuauucggccacacugcugcuccuuuucaaaaaaaaaaaaaaaaagcuucaaccaguggcaauccuccugcugcauccucccaggcagcugcgaugacaggggaccuggucuaugcugugacucucagggcagaaucaggggcaugaguugcacagugcccagcuucuucuugacauuacuuuuaaaagauuuuuuuuuuuuuugguuuuuuuuuuuuugagacaggguuucucuguguagcccuggcuguccuggcacucacuuuguagaccaggcuggccucgaacucagaaauucgccugccucugccucccaagugcggggauuaaaggcgugcaccaccaugcccggcuauagauuucuuugugaacguuuuccuuuguauugcauuugccauucugucugugugcagacagggcagagaacaacuucagggaagucaugaaccccuccaucaucacauggguccuggggauugaacucagguccuucggcuuggcagcaagcaccuuuacccacugagacaucuugccaggccuucaaucaugaacugcaaaagacugagcugugggcacaugaagggagguggcccagagugcuuaccauggggugauucugcgcugucuucagcagcgacaagggaagcuggaaggcaaaagucagugugagguguaguccucaauucagggacgaccacaugggcauggcuacccccaaugcacucgccugucuucaggucacagguaaccucacaucaucccauucuacagaugugagccaccuggaccucccggaccauuuuggucauuucuccacaauuucugucaccuggaaccacagaagcggggcacaguccucugucuggagguagcuuuucugaggcagaaucuugucauaagcccaggcuggccacagccuucuaaaugcacaggacugcacaccagccugcuucacaucccguccaugugcuuccagaacaggugacuuggguugccugagccccagggcugaggucaaggugacagcaaggcuagugacacuuugccuuccagagccagcaucauaaagaccaacauaaagccagguguguugugcuacacccgucaucccagugccagggaggcugaggcagggggauaaggaauuuuagauuauuuucagcuacagucugagaucagccuggacuacauuagaccugucuucaaaauacacaaaaaucaaauuacagccaagcaugcagugcacacauucaaucccugcacugagaggcagaggcaggugaauuaucuauaaguuccaggccaacuggguuacacagugaaacaaacaaacaacuacacgaggggcuggagacauggcucagcaggugagagcacaggcugcucuucuggaugaccuggguucaauucccagcacccacaugguagcucacacaucuauaacuccuguuccagggggauccaacacacucacagacacaugcaugcaggcaaaacacaugaaauaaaaauaaaucauuuuaaaaacagaagaaacaaacaacaagagccccagauccucagggccaucaugcccagcauggggacuuugggucaugagaggacugggggagccuacaguacaaggcccuucccaagaagagcugaggggcggggaggaguuaguggcagggaagugaagcucuagcccacuuccugcagaggcuuccuggaaggguaggaggcagaggaugacuuuugugaaaauggcugguggguggguggguggccuuggugaucagugacaaugguguccacccugauccucaaauaaacagcagaaaagagccacaguauagcauccuauggcuaagcuccagguaguuggagccaugguuauccuuggcuacagugugaggcuaaccugggcuacaugagauccuguuucaauaaaggaauagaauagucaaacucccaaauacaaggcacagcaagggcucaagggcaaacauugcuaaacaagaauagaggcacacaaagcucuuccggaacugcuauggcccagcacagccuggaggcagcgauggcaagguccagccuuacugcucaacuuucguuccuccugccagggccccagccaccacccagggugcccuucccuagacucucugcccaauccugcugagcauguccccuccuguggucaggacccuaauggccacccuaggcugccagccuguuuccagcucagcagcugaagccgcucucuaauuaugggugauuagcaucagucucccuggcuagacacaaggucagugugggcgugggcucugcugcagcagggaggagcaguaaacacuugcugaacacgcagggguggggacacccagcacaggugcauccuguccagugccacagguaagaaaagugugguguagggacaggccaccacaaccccccacuccccuacugugugugcagugggagagaggaaugaaagaaguaauuaggaaugucuccccaaaaugaaggaagaaaaagcucagagugaaaugggccagggcagacagggaggcuggagcugggauagucacaggcuuuugaguggaggagacauagcuuuacacagagcagcugcagguguuauagccacccguucuggaauccagucccagcaccucccauuagaggagccaguuccaggaagggaaauuccuucucagccaucauccagacucucugggauccaguguguagaugagauagcuaaagaaccaagucuagggcucugaguucaggaauguucagcugggacacuccuguaccagccugaccgcagagauaugggagugucugugcgcaccugcaugagguggguguccaguccuggacgcaccuggccaucccuucaggaaggcucaggguacacccaguggggagugcuuaccuagcauguguuaggccuagaguuccugcaccacaaaacccagggucauucuggaguaaaggcagggucaggaguucacagugaugcauguauacaaauggaguucaaaggcagccugggcuauaugagacccugccucacauccugacucaaauguggaguauacacguguccuuuccauacuccagugacugaagcaagaggaucaggaguuugagguuagccuggauuaugucaguucagaucagaaagccuaaccaaaaaacaaaccaaauauccuaccaucaagaacuggggagaugggaauauguggcucuccucacuuaggccaacgcgccccucgacagagcagggggaaaccuggccuccuuuacuuguuuaugccaggucuaagaguccccaaacugaggaggccugagccuaaacuaggagaaaaaaaaaauccuuucuuccugagcaagacaugcugugugucccagggagagaaucaacccgcucucugagcuggauuuccagccaaaggcgugggcagcugaggucagacaccagauaagcaucaagagggcaacgaagcccacgugagccauuaagcccgcccauuucccggaaacgcagcuuuccuaucaaugacggugacaagccccggaaacgaucauagucccucuuccggucgcaaaaaccguguccaucaagagauaaauccccaacggugaccgucuggggcccuggagggacaccggucacuccggccucaguuucccccaucucucagcagcccgaagacccugcgcgcgccccuccgccucgcggcccucaccaucuucccugcagcgauaacuuccgccgcggcacagacacacgcgcucccaccggcggcccaccgcgcgccccagacugaaaaagacuggcagaaacuaugaccaaucagcgagcagcucaacggacaucuauccaaucgggacgggcuagggcgguaccuacggaacaagacggacggccucaccguauuucuacggugggauugagagguagccguaaagugcga

SEQ ID NO: 4494 - RNA, 5176 nt, Mus musculus
gguuggguacauagcaggugcuuuuuaaugcaugcuugagguugguagauugauaugggaagguuuucuccgggagagagcccuuuaugguaacucuugacugucaacuagucaucaacaaacaucccagagacacuggaccggugaggaagcugagggugcgcuucauuuccucauuuuaaaaagguuuuaugaggcuggagggagcuggcagcaacccagaaaacaggacauggggccuggcggagaagccgcgcaaacaccugcggucucggccugcgccggcggaagcagcacgggaggggcgggaggccggguuuucucgguaacccgaccucaggaaugcggucgccccacgggcccugccaccuggggacggugcccacaagcucugcccucacacuccugggacaguccccucucugccucagccacucccaggggcccccuuucugucuucccgguuuaugaagcugaucauugguuucugccugaucaaggaaagacugaaaacgcaaacuagaaaagucaaauuuaucuucgcacuguggaaggguuccugagaaccuggggauucgaacacaggcccacccacgagauuucagguucaaugugaagggugcacagucuccacgcugggccaugcgucccguacaagucacuuccccagacacugaccagggaagacagaagcgaaaacagaauccagagugggcgcuguuucugccacccacugaccagccgcacugcauggccuccagcccaacccagcgccccgagacuuuuugaaucccuccacuccuuauugcaguuguuuugaagguuuaguaggaguuuuucccagaggcuaagggcaccccaagaccagcagguuaaguuucuccaaauaauaaaauugaagaaugacugauggggugucgagauggcucugcggguaaaggcucuuguugcucuuguugagagcugacuugaguucacaggacccacagaaugggagagaacagacucugaaagcugagguccuuccccagccucucaacaagcccuuuuccuacagaaauacaauuaaaaaaaaaaagucagucaggacaggccgcucccgccuuuaaucccagcauucgggagucagaggcaggaggaucuuugaguucgagacuaaccuggucuacagagugagcuccaggacagccagggcuacacagagaaacccugucucgaaaagcaaccaaaaauguucaggucuuacuauuucuuuacauuuuccaugccacuacaaaaugcucuccuugccugauagggaaagugagucucaacagagguaaaacuuaauuugguacguaaaccuguccccagucagcucaaaccaccgccuccagagcgcacgcccgcccaucccccacccgccaaggccaagucccaaggucagggcggagccucgcgcgcuccgccaagcuccguacggccccggggagaggcaggccuggcgccgggggcuggcuggcguugggccagcacuagcuggcucagucguuuggcggggggcgggggagggggugcuggcugggauauggcucgcgaagcgcaaaccccacguguguggugaggggagaguccacucuaucuuucuggauggucacuugccuacaaaaggggauaaaaccuggguguguggcucucugaggcaacaacuggucaaggcucgggcggggguuuggggggaggggggagaacccucugaggccucaauggccugggcgaagguccugaggugcaaaggagcuccaaugggguacagauuggagaggagucacagagaagggaugagacuccucucuggucuucuaaggguuguguugagugugcugggacuuguugcucccaccucuuccaccuccguucccagcaagcagaaaagccugcaucaggccugguggcauacuguacuaauuaagaggguaauuaccaguccggauucucauuugcaggcuccacucugggacccaccucaggcucuagaagagucaagaguaaaaacguguacugccauggcuguccagaggccuggcacccuaguucuguccuugggaggacaaaugugugguaaaugccuguccuuacagcacauagaaggcagaaggaucacuucucaagucuagccugagcuacagaaaaauucugucucaaaacaaaggcaaaaacaaaacaaaacaaaaaaaaccccacaagcucaccccagaacuuccaucagcaggagccccaggucaaccuggguuacagcuuuugcauagugcccuuuaacucuagcacuuagcagguccacaucuguaaguucccagccagccccagcuggaaggugagagauccuugcucaaaacacaaaguaaaacucaacaaacccaagacucaaaucucaugcuaagaugaggugaugggcacgucuuucacguugaggcagugaaaucacccucagucuuggucagcuaggguacaggguguccuaauaacugaaaccgaagcaaggcacaauggcauauauuagucauccagaagccugaggugagauuuugggggguucgggaggucauucugggguacagagugagauucuguuucaaaacgucccaauccagggccauaggguaggcuuagaaaguaaacgugacugcacccaagucggacagccagagugccacaccggggagaacagacucccaacucuccucugaccuuccuggacacacacacacacaaagcacagauaccuacacagacaaacacagauacacaaccacacagacaaacacaccagcauguaaaauaaaaaccgagaucuguaggccgagguuaagagacucaggccuguuacugccacacuugggaauaugaaacagggggacugaaguuaaguucaugaauagcggagucuagaggaugagauccugucuugacccaaaacaaagauuaaaaaaauuuuuuuucaccgagaucaagaaaaaaaccuacaacugauggcuacccuggcugcaguuggacuccacacaucccauccucaguuuccccaaggaaaaggcaggaggucagcuuuuagggcguucgacuccacccugugaaacugacaaggagcuaaguaguuguggggacucuccaagggacccuccucugccucccccuuccugcccacaccugccagcucccagccggaggaacccuggccggcgcccggcccccgaggggcgugccuucggugggcgugacgcggggcguggcuucacagagggccuggguuuaugaggcuccacacaucacgccacagaagugccagagacaggggagagauagacgcacagaugagguccaguuugagaaacagagaggcaagaucuagagggaaguaaagaggggaggaagagaaagggaggagaggcaagaaacagcaggguagggacagagccugcccggcaauccaagcugggcguggugacccggccaaaccgcguucagccccacccccaugacgucaacccacaaugcagcgcguuguugugccauguagcgagcgucgcucuuggcaacagcggccgccaccaggcgagggcgucccgcucccgccccuuuaugcaaaucaacgacgucaccucgcgccaauggcgagcgggggcggugagcucaucgcgggggccgaggcuauaagagugcgcgcgggcggcgcggggcagagcggccggcaucggagccggucuguacgggcagcggacuggggggcauacggggccccccggggaggccgcggccacuccccccgccccggggccgagcgcggcgggggaagguggggauggaaacgcccuucuauggcgaggaggcgcugagcggccuggcugcgggugcgucgagcgucgcuggugcuacuggggcccccggcggugguggcuucgcgcccccgggccgcgcuuuccccggggcgcccccgacgagcagcaugcugaagaaagacgcgcugacgcucagccuggcggagcagggagcggcgggauugaaaccagggucggccacugcaccuucugcgcugcgccccgacggcgcccccgacgggcugcuggcuucgccggaucuugggcugcucaaacucgcgucgccggagcuggagaggcugaucauccaguccaacgggcuggugaccacuaccccgaccaguacgcaguuccucuacccgaagguggcagcuagcgaggagcaggaguucgccgaaggcuucgucaaggcgcuggaggaccugcacaagcaaagccagcugggugcggccaccgcggccaccucaggggcucccgcgccucccgcgcccgccgaccuggccgccacccccggggccacggagaccccggucuacgccaaccugagcaguuucgcggguggcgccgggcccccugggggcgcggccaccguggcuuucgccgcggagccagugcccuucccgccgcccccgggcgcgcuggggccgccgccaccuccgcauccaccgcgccuggccgcgcucaaggacgagccgcagaccgugccggacgugccgagcuucggcgacagcccuccgcugucgcccaucgacauggacacgcaagaacgcaucaaggcggagcgcaagaggcugcgcaaccgcaucgccgccuccaaaugccgcaagcgcaagcuggagcguaucucgcgccuggaggagaaagucaagacccucaaaagccagaacaccgagcuggcguccaccgccagccugcugcgcgagcagguggcgcagcucaaacagaaaguccucagccacgucaacagcggcugccagcugcugccccagcaccaggucccggcguacugagcccgagcgcggggcgcaugcgcggacuagcugcggugggggggcgccccggacucuuucgagacucggugcccccggacucgacaagccggaccccccuuaacucuggauggggaacccgagcgcacgacccccgcccucgcgccgccucucuacccccaguccugcgcguggcugccccuuuguaccuccgaguaggggcucuaaggggcgcgcagccucacgcucugccuuuccuuuuuuuuuugccuuuuggaagagagaacgggaguguccgauuccgcccuauuuauguuucuacucgggaacaaacgu

SEQ ID NO: 4495 - RNA, 2880 nt, Mus musculus
gcaaggcacaauggcauauauuagucauccagaagccugaggugagauuuugggggguucgggaggucauucugggguacagagugagauucuguuucaaaacgucccaauccagggccauaggguaggcuuagaaaguaaacgugacugcacccaagucggacagccagagugccacaccggggagaacagacucccaacucuccucugaccuuccuggacacacacacacacaaagcacagauaccuacacagacaaacacagauacacaaccacacagacaaacacaccagcauguaaaauaaaaaccgagaucuguaggccgagguuaagagacucaggccuguuacugccacacuugggaauaugaaacagggggacugaaguuaaguucaugaauagcggagucuagaggaugagauccugucuugacccaaaacaaagauuaaaaaaauuuuuuuucaccgagaucaagaaaaaaaccuacaacugauggcuacccuggcugcaguuggacuccacacaucccauccucaguuuccccaaggaaaaggcaggaggucagcuuuuagggcguucgacuccacccugugaaacugacaaggagcuaaguaguuguggggacucuccaagggacccuccucugccucccccuuccugcccacaccugccagcucccagccggaggaacccuggccggcgcccggcccccgaggggcgugccuucggugggcgugacgcggggcguggcuucacagagggccuggguuuaugaggcuccacacaucacgccacagaagugccagagacaggggagagauagacgcacagaugagguccaguuugagaaacagagaggcaagaucuagagggaaguaaagaggggaggaagagaaagggaggagaggcaagaaacagcaggguagggacagagccugcccggcaauccaagcugggcguggugacccggccaaaccgcguucagccccacccccaugacgucaacccacaaugcagcgcguuguugugccauguagcgagcgucgcucuuggcaacagcggccgccaccaggcgagggcgucccgcucccgccccuuuaugcaaaucaacgacgucaccucgcgccaauggcgagcgggggcggugagcucaucgcgggggccgaggcuauaagagugcgcgcgggcggcgcggggcagagcggccggcaucggagccggucuguacgggcagcggacuggggggcauacggggccccccggggaggccgcggccacuccccccgccccggggccgagcgcggcgggggaagguggggauggaaacgcccuucuauggcgaggaggcgcugagcggccuggcugcgggugcgucgagcgucgcuggugcuacuggggcccccggcggugguggcuucgcgcccccgggccgcgcuuuccccggggcgcccccgacgagcagcaugcugaagaaagacgcgcugacgcucagccuggcggagcagggagcggcgggauugaaaccagggucggccacugcaccuucugcgcugcgccccgacggcgcccccgacgggcugcuggcuucgccggaucuugggcugcucaaacucgcgucgccggagcuggagaggcugaucauccaguccaacgggcuggugaccacuaccccgaccaguacgcaguuccucuacccgaagguggcagcuagcgaggagcaggaguucgccgaaggcuucgucaaggcgcuggaggaccugcacaagcaaagccagcugggugcggccaccgcggccaccucaggggcucccgcgccucccgcgcccgccgaccuggccgccacccccggggccacggagaccccggucuacgccaaccugagcaguuucgcggguggcgccgggcccccugggggcgcggccaccguggcuuucgccgcggagccagugcccuucccgccgcccccgggcgcgcuggggccgccgccaccuccgcauccaccgcgccuggccgcgcucaaggacgagccgcagaccgugccggacgugccgagcuucggcgacagcccuccgcugucgcccaucgacauggacacgcaagaacgcaucaaggcggagcgcaagaggcugcgcaaccgcaucgccgccuccaaaugccgcaagcgcaagcuggagcguaucucgcgccuggaggagaaagucaagacccucaaaagccagaacaccgagcuggcguccaccgccagccugcugcgcgagcagguggcgcagcucaaacagaaaguccucagccacgucaacagcggcugccagcugcugccccagcaccaggucccggcguacugagcccgagcgcggggcgcaugcgcggacuagcugcggugggggggcgccccggacucuuucgagacucggugcccccggacucgacaagccggaccccccuuaacucuggauggggaacccgagcgcacgacccccgcccucgcgccgccucucuacccccaguccugcgcguggcugccccuuuguaccuccgaguaggggcucuaaggggcgcgcagccucacgcucugccuuuccuuuuuuuuuugccuuuuggaagagagaacgggaguguccgauuccgcccuauuuauguuucuacucgggaacaaacguugguugcguguugaguguguguuuccuuguguugguuuuuuaaagaaacgggaagaagaaaaaaaaaacccucuccccuccccccccccccgcucucucuccucccgacaccauccccucucuuuuuguuugguuuuguuuugcuacgaguccacauuccuguuccguaauccuugguucgccgguuuuguguuuucaguaaagucuucguuacgccag

SEQ ID NO: 4496 - RNA, 4428 nt, Mus musculus
cguuugcauagaaagccccgccccuggcuuugcaggacgucagcuaggacugcaggggccugagccuccuccgcugccgccugcagcccccgccgccgccugcaucccccgcauccucuucuggggcccggucgccagcgcagucgccacggucgccgucgccagcguugucucagcuuagagaggguaagggugagcgcaacccagguccacacacugaggagcccgcguuucacugacagcugggggaucaaggggagcgcaacucggguguaguggcuaugggucucgcauuuggcauucuuggucccgcaucccgcaccccucgcccuuaaccuggcaccuggggcccgggcucugcgacagagggggaggggaaagccaggccuugcgggaggcuugugcgugcucgugcucguggggugaacacgcgugugcgcgcccgcugggcauggagaggcucgagugaccgcaggacgcgcagcgugcacacuugugauacguugugcgugcaugguccgcgugcgcggugcgcguggaucuuaguucaaguaugugcucacacgcguguggagccaugcgcgugugugguguguccucccggauggccagguacagucgugcauuggugcagggagcugugcucacacaugggcuugcacacaccauacaugucugcuuguuucgccuguuagcaccacucuugcaugcagggcagguguuugggucugccugcccuagaugcuucauugugcuuguguguguguguguguguguaugcgugcgcgcucuugugcucgcgauuuugugugugugagccuacguucauccugucuucgucacgugauguggcuaucucagggccccaguucuugcaggagaaaaauaaggaugagcgagaacuggggauccuccuguauucauguuccggugugggucucugugagagacugaugggaaggcagaggaggcucagucuucccucaggguacaggggaaucugagguucacagccugcuuaaaaccuuggugcugucaaggucacagcucugccuuauguugguuggggggguugagcaugugacauugggggguauccucaccuaccccugugccgugcccacccugugcgugguccugaugcuccccucaggcccucugugccacgccucccgcagauggcuuccgccacagacucucgcuaugggcagaaggaguccucagaccagaacuucgacuauauguucaagauccugaucauugggaacagcagcgugggcaaaaccucguuccucuuccgcuacgcagaugacuccuucacuccagccuuugucagcaccguuggcauagacuucaaggucaaaaccaucuaccgcaacgacaagaggaucaagcugcagaucuggguguguagggcuggaggggagaugucuuccugccaacccccacaaaaggaagcugaggcuagccaucggcuggcgcugggauuuaaggccugcaucuccaucccaguaugagcuucccguuuuccuaagucccgagcauccccacucaucuucuagcauaguguggcacagggcauucaggcagcacccaguacauguuuguugagugacuaaguggccuugcagugacccauuugggucacugucugcuuuuccugacccacuguccccgggccucaaagugguugcuggacaaccuuggagcacguuuuucucucgggggcugcugcgaggucccuucugaccuaucccucuuuuccccaggacacagcagggcaagagcgguaccgcaccaucaccacagccuauuaccgaggcgccaugggcuucauccuaauguaugacaucaccaaugaggagucauuuaaugcagugcaggacuggugagcagcccaccuacucagaaaacacaaggcugggauuggaggugacuuagcuaagcuuagcuaagcuuaguugguagggugccugcuuggccaggacaaagccuuggguucguccccagcauggccaaaagacaaccaagaguaggccucuggugggacaagccauguggcuguucccaaggcuugagguuguggaagcacacaagguaaccagugaguagacaaggaaccucccacugaucucuacccagguagcccaggcaggagaaccacguuagcucacuugucugaggucaagugauucucuggccaagcgcuuaccucaaauguaugagaaccuggauuccagccacagcaccaaaaauuaacucccccaggucuugacauuugguguaguggacaccggcccaucuucccagcuuugggaagauggagaggucugagugagauaggcuggacucaguuaccaaggggcaguggucucuccugcaagggcuagacacaggcagagacucggggauggggccagguccuccggcuuccucuucagccucuggcugucucugcagguccacucagaucaaaacuuacucgugggacaaugcccaggugcugcuggugggaaacaagugugacauggaagaugagcgagugguguccucagagcguggccggcagcuggcugaccaccugggugaguacugaggacuguggcccuuaccaggcuggaccagagaccuggauaccugauagcuacacacccagugucucacugaucaggacaugggcuugaauccaggggguuugcacuugagaaaacuaggccuuauccaggaggcuuuaccaugggucuugauggacauggaggugcuugccauguuggcugucagcugucagccaugagcuaccuucaagguacugggccugugaaguuuucgaacuagaaagagaaauggguggaagaggcuaagccuggcuucccggagcaggcacaacaugccuguaugggaagguugguauaggcagagucgugacaguggugcgugaucgccccuuagaggaacuguggcugucacugcaggcugagcugacaagaaaccaggccauggagguuguaggucucuggaaagggacuuggagccuggcuggguggcagauggaagggaugucucacuagggugcuuaagauuaucccaagggauggguaguaauggauggcucacccagaccaguguggccucccugggagggacccuucagugcgagggccugugugagugcgucuggagccuacagcucuguugccaccccuccauuuccccaauauaggcuuugaguucuuugaggccagcgccaaggacaacauuaaugucaagcagacguuugaacgucugguggacgugaucugugagaagaugucagagucccuggauacugcagacccugcggucaccggugccaagcagggcccgcagcucaccgaccagcaggcgccaccucaucaggauugugccugcugagccacuucccuucccugcugccaggggcacgucccccauccccgacuacccuauuuauuauuguagcuauuuauuuauuuauugaggaugugccccgagcgcacccccuucccacccuguacauagcuccacccagcucggccgugguguauuguggucacugcugcucccucuccuuuaccccccacccccauuuuguuuuuguaaaccaucccguccacaguugucaguugugaagaggggaccagaugucacucugcagcaggcugauggaagauggcggggccugccaaccccgaggcugggggaucgccauauggaccaccugguugacagacggcuucuugcuugccugggccuucugccuuauacuuugggauaaaugggguguaggggauauauucacuacuuugggauacccccaaaccuguucugacgucgugagugucaaaugugucccacuccucccuagaaguuaugaacacuacacacagucaauaaagcgaauggaccuugcugagucugcuggcccagccccugaacccacccacacgcaguccuugacauuaaagagaauuuaaugaauuuccgcacccugcccagccuugcaucaaguuuucugaggccaaaccagaccccacuucaaggcuguggaggguguccaggcagacagagggcuucauggucccacuggaaaaccgggagggguuggggggagggcggacagccugugcuggcgucuguucuacaugggaacagucucugguggacucaagggacugcugguccaggggcagucagccuggguuuuggacauggcccagagcuuuuugaccagcuucgguaaucuccugugggaguguauccaucggccaacucaucugccaggcuucaguuucagucugcacagcccggagucugaagggguucagggaccuguccgcagcagagggacagucaaacaggaauaggccggaacccacgcccucccacacucccacaccauggaguugagcu

SEQ ID NO: 4497 - RNA, 4428 nt, Mus musculus
agcucaacuccauggugugggagugugggagggcguggguuccggccuauuccuguuugacugucccucugcugcggacaggucccugaaccccuucagacuccgggcugugcagacugaaacugaagccuggcagaugaguuggccgauggauacacucccacaggagauuaccgaagcuggucaaaaagcucugggccauguccaaaacccaggcugacugccccuggaccagcagucccuugaguccaccagagacuguucccauguagaacagacgccagcacaggcuguccgcccuccccccaaccccucccgguuuuccagugggaccaugaagcccucugucugccuggacacccuccacagccuugaaguggggucugguuuggccucagaaaacuugaugcaaggcugggcagggugcggaaauucauuaaauucucuuuaaugucaaggacugcguguggguggguucaggggcugggccagcagacucagcaagguccauucgcuuuauugacuguguguaguguucauaacuucuagggaggagugggacacauuugacacucacgacgucagaacagguuuggggguaucccaaaguagugaauauauccccuacaccccauuuaucccaaaguauaaggcagaaggcccaggcaagcaagaagccgucugucaaccaggugguccauauggcgaucccccagccucgggguuggcaggccccgccaucuuccaucagccugcugcagagugacaucugguccccucuucacaacugacaacuguggacgggaugguuuacaaaaacaaaaugggggugggggguaaaggagagggagcagcagugaccacaauacaccacggccgagcuggguggagcuauguacagggugggaagggggugcgcucggggcacauccucaauaaauaaauaaauagcuacaauaauaaauaggguagucggggaugggggacgugccccuggcagcagggaagggaaguggcucagcaggcacaauccugaugagguggcgccugcuggucggugagcugcgggcccugcuuggcaccggugaccgcagggucugcaguauccagggacucugacaucuucucacagaucacguccaccagacguucaaacgucugcuugacauuaauguuguccuuggcgcuggccucaaagaacucaaagccuauauuggggaaauggagggguggcaacagagcuguaggcuccagacgcacucacacaggcccucgcacugaagggucccucccagggaggccacacuggucugggugagccauccauuacuacccaucccuugggauaaucuuaagcacccuagugagacaucccuuccaucugccacccagccaggcuccaagucccuuuccagagaccuacaaccuccauggccugguuucuugucagcucagccugcagugacagccacaguuccucuaaggggcgaucacgcaccacugucacgacucugccuauaccaaccuucccauacaggcauguugugccugcuccgggaagccaggcuuagccucuuccacccauuucucuuucuaguucgaaaacuucacaggcccaguaccuugaagguagcucauggcugacagcugacagccaacauggcaagcaccuccauguccaucaagacccaugguaaagccuccuggauaaggccuaguuuucucaagugcaaacccccuggauucaagcccauguccugaucagugagacacuggguguguagcuaucagguauccaggucucugguccagccugguaagggccacaguccucaguacucacccagguggucagccagcugccggccacgcucugaggacaccacucgcucaucuuccaugucacacuuguuucccaccagcagcaccugggcauugucccacgaguaaguuuugaucugaguggaccugcagagacagccagaggcugaagaggaagccggaggaccuggccccauccccgagucucugccugugucuagcccuugcaggagagaccacugccccuugguaacugaguccagccuaucucacucagaccucuccaucuucccaaagcugggaagaugggccgguguccacuacaccaaaugucaagaccugggggaguuaauuuuuggugcuguggcuggaauccagguucucauacauuugagguaagcgcuuggccagagaaucacuugaccucagacaagugagcuaacgugguucuccugccugggcuaccuggguagagaucagugggagguuccuugucuacucacugguuaccuugugugcuuccacaaccucaagccuugggaacagccacauggcuugucccaccagaggccuacucuugguugucuuuuggccaugcuggggacgaacccaaggcuuuguccuggccaagcaggcacccuaccaacuaagcuuagcuaagcuuagcuaagucaccuccaaucccagccuuguguuuucugaguaggugggcugcucaccaguccugcacugcauuaaaugacuccucauuggugaugucauacauuaggaugaagcccauggcgccucgguaauaggcuguggugauggugcgguaccgcucuugcccugcuguguccuggggaaaagagggauaggucagaagggaccucgcagcagcccccgagagaaaaacgugcuccaagguuguccagcaaccacuuugaggcccggggacagugggucaggaaaagcagacagugacccaaaugggucacugcaaggccacuuagucacucaacaaacauguacugggugcugccugaaugcccugugccacacuaugcuagaagaugaguggggaugcucgggacuuaggaaaacgggaagcucauacugggauggagaugcaggccuuaaaucccagcgccagccgauggcuagccucagcuuccuuuuguggggguuggcaggaagacaucuccccuccagcccuacacacccagaucugcagcuugauccucuugucguugcgguagaugguuuugaccuugaagucuaugccaacggugcugacaaaggcuggagugaaggagucaucugcguagcggaagaggaacgagguuuugcccacgcugcuguucccaaugaucaggaucuugaacauauagucgaaguucuggucugaggacuccuucugcccauagcgagagucuguggcggaagccaucugcgggaggcguggcacagagggccugaggggagcaucaggaccacgcacagggugggcacggcacagggguaggugaggauaccccccaaugucacaugcucaacccccccaaccaacauaaggcagagcugugaccuugacagcaccaagguuuuaagcaggcugugaaccucagauuccccuguacccugagggaagacugagccuccucugccuucccaucagucucucacagagacccacaccggaacaugaauacaggaggauccccaguucucgcucauccuuauuuuucuccugcaagaacuggggcccugagauagccacaucacgugacgaagacaggaugaacguaggcucacacacacaaaaucgcgagcacaagagcgcgcacgcauacacacacacacacacacacaagcacaaugaagcaucuagggcaggcagacccaaacaccugcccugcaugcaagaguggugcuaacaggcgaaacaagcagacauguauggugugugcaagcccaugugugagcacagcucccugcaccaaugcacgacuguaccuggccauccgggaggacacaccacacacgcgcauggcuccacacgcgugugagcacauacuugaacuaagauccacgcgcaccgcgcacgcggaccaugcacgcacaacguaucacaagugugcacgcugcgcguccugcggucacucgagccucuccaugcccagcgggcgcgcacacgcguguucaccccacgagcacgagcacgcacaagccucccgcaaggccuggcuuuccccucccccucugucgcagagcccgggccccaggugccagguuaagggcgaggggugcgggaugcgggaccaagaaugccaaaugcgagacccauagccacuacacccgaguugcgcuccccuugaucccccagcugucagugaaacgcgggcuccucaguguguggaccuggguugcgcucacccuuacccucucuaagcugagacaacgcuggcgacggcgaccguggcgacugcgcuggcgaccgggccccagaagaggaugcgggggaugcaggcggcggcgggggcugcaggcggcagcggaggaggcucaggccccugcaguccuagcugacguccugcaaagccaggggcggggcuuucuaugcaaacg

SEQ ID NO: 4498 - RNA, 2319 nt, Mus musculus
caugugauuggcgcgggcccggcgcucggcugccgcggcucccuggugucuguagcggcgauggcucugggaggcuggcgcugggcucgcaaggcguuggcugcggggcgcccgcuguuccagggccgcgcgcugcuccucaccaacacacugggcugcggcgugcucauggccgcgggcgauggcgcgcgacaggucugggaagugcgcgcgcggccuggacagagauucagcgcgcggcgcucaggugagagggaccugugcgcgaacgagagggacccccagagaccgagcggucaccuggaccgggcacccaccuuccuggggccugucaaucacucugggaccuggcacccacucugauggguccugucagucucucugcaccucgccaggagguucugccauugacucucccugucccgcagccagcauguucgccgugggcugcagcaugggccccuuccuacacuucugguaucugugguuggaccgccuccuccccgcgucgggccuacgaagccucccgagugugaugaagaaggugcuaguggaucaaacgguggcaucucccauucugggcgucugguacuuccuggguaaggagcagcaggacuuugagaacucagaaguugugaugggcagagccugguuugugcuuaggggagugcugacggggcuucucuucuauuuuuucccuccccccccccaagguuucuuuguguagaccuugcugcccuggaggaacuugcucugaagaccaggcuggugucaaacucacauagauccaccugccucugccucccgaguacugggauugcuuuguucuaggaggcaucauguacucucgcugccuugaguuugcuaccaacuggucaguagcccaguuuccuguccccauuuugagacagagacucacauguagucccaacuggccugaacaucucuuuguagaccaggcugauugugccugccucgccucccugagugcuagcauuaaugugugucaccacucccaacuuucuaaaauccuaaccaaaaggagucugggccagaaaggguuuuucagccacaguuguggggaaaccaggcaggaacuauacacagcuagucacaucucagccagagagaacugcaugauuucuugcuuuguucagacuauuuuaccacucaugagcaguccaggacccugggucuucccacaucaacuaacuuaauuacauaagccuauacaagcaucccacaggccaaugcauguagacagcccccggagacuauccgauaacucuaggcuaagucaaauugacaaagguaccuguuaacacagcgauggggcucgugaucuaggcucacgcauuuauguuuucauaaguaacucaggcucccucacaccaaccucucauuuuccuggaccugccugcugcucugccugagaccugcccugcuucugccuugcagccaccucagccuuuauaacuacuucuuggucuucuucccaggccuuggcagccuggagggucagacacuagaggagagcugccaggagcugcgggccaaauucugggacuucuacaaggugggcgugcccacgugggcucucucaacauggcuccacccccccucuuuaccuuccagacccacacccaaggccuuggcccccacccacuuuucaagccccgccccucguagccgcccccccucucacaguggcccucccacuuuuccacaggccgacugguguguguggccagcugcccagcuagugaacuuccucuucaucccuucucauuuccgagucaccuauaucaaugggcugacacugggcugggacacauaccuguccuaucugaaguacugggugagcucaacuccauggugugggagugugggagggcguggguuccggccuauuccuguuugacugucccucugcugcggacaggucccugaaccccuucagacuccgggcugugcagacugaaacugaagccuggcagaugaguuggccgauggauacacucccacaggagauuaccgaagcuggucaaaaagcucugggccauguccaaaacccaggcugacugccccuggaccagcagucccuugaguccaccagagacuguucccauguagaacagacgccagcacaggcuguccgcccuccccccaaccccucccgguuuuccagugggaccaugaagcccucugucugccuggacacccuccacagccuugaaguggggucugguuuggccucagaaaacuugaugcaaggcugggcagggugcggaaauucauuaaauucucuuuaaugucaag

SEQ ID NO: 4499 - RNA, 2373 nt, Mus musculus
cccacuuuucugcucucagcggaccaaugggcaagcgcacaugagucucgcgggccucccaccccugagccgagcugaccaaugguagguggcugccucucgccucgccgccucgcccacaaagcuuccugggaaugggcggggcgaggggcauuagcaaagcugcuggacuugaccuuggcgugaccucuccugugccagcgaagcugcucaggcaaguucauagacaccggucuaaccucagcuauuugagaccuaugcucauacagcccaggcuacagccuccaccgccgcgccacaccucugcguuucgaagacugaauaggaguucauuaugcaaaauucauguauugaucucuucacagcaacuuugugucacucuggaaacaaacauccuuacuuccuuuauucuuuaaccauacacaagacaagccacuaaacuguuguccgaugcccagguuuucgaguaucucaccugccuuuuccaggaaagucuuauuuauuuccuacaguaaacacaugcucccgaccccccuuuaagucucugccccaucauagguuuuauaguuacguguuuauccaugaauuucuguucugccuaaggaacuccuauucauucuucaaagcccaauucuaaaaugccuauccucauuauauagacucuacacaucccauccuuccagucuucauuccuccccuggccuauccuggcuucacuaaacuagugacaggauugguucugcauuuccuggacagaggacucauugguaacugguccuuggcaucuuuaggugugaaggucaauucugucaaucagacaggaucuagagucaccuugaagacaaccccgggggcauaugagaugguuggucuagaaaagugguucucaaccuuccugaugcuaugaccuuuuaauauaguuccucaugcugugcugacccccgacuauaacguuuuguuguuagguaauuuugcuacuguuaugauuuguaaauaucugauaugugaccgcugugaaaggguugucugaccucccccaagggguguggacucacagggugagagcagcuggucuagacuguuagcugaggugaaaagauucccccgacccagaauguggguggcaccauccuaugugcuagaguucuggacaaauuaaaaaguugcaagugucugagcagugguugcccacaccuuuagucucaucuuucaggaggcagaggcaaguggaucucugugaguuugagggacuuggggacagaacaaguuccagaacagccagggcuacauucugucuccacccaaccccucccaccaauaggaugaaguggguggagcaucagcauuugccugcuugccuccugacugcauacagugugacuucaagcuccugucuggacuuacacaaacacacagacacagacacacauaggagaugggcuauagacucucacaaggugagccagcauacacccuuccuuccuuaaguagcuuuuguguuuuguuauacaaugaaaaaaguaauucccagagacuggcauuuuuuuggcuuuucagaugggaugaacucuagggucuggggcauugagagcugagcaggugcaguacccuggguuacagcuccacauuaaagacaaaaacacaaacuccaacucuaggaaaaaggaaucacaggaguauagaugauuuauucuaugaauuuaaauuuagcaccauuugaaaauaaggcaagauccuugucucugagaagucuggagucugggcuuugugggacaugugcaagguuuucauagcgaggcagcagcucuugcagguuggcaauuugaagaagcugggcaguuuuuccugggacgaguuugagguuaugccuuuacuuauagcagaccuuccugggggagucggcaauggaggagcagaugucuggcuucuccguucccuggagggggaugaaaggcuaggaaugggggaccucuggggagacucaaccccccuagaugaaccccaugauucaugcccagcuuaccugguacagcugacagacuaugcucaggagcucgcugggguccuucaaagguuucugcauaucacaggagacauggguaagcacagcuggguaagaggaaugagccugggagcugacguagggggaucacugauaguuccagaacacucucacuuguacugaccuaggcagggcggcugaucugucacucugcuuugggaucuuucagacaaagacucuuguguaugaggccagagcucaaaauggaggaucuuuguugucuuuuguuauuuuggcuuuggugucuuuuuucuaauuaaaaucuuauuuuuagauuuguuuaucuuauucauguguagggauguuuugcc

SEQ ID NO: 4500 - RNA, 2373 nt, Mus musculus
ggcaaaacaucccuacacaugaauaagauaaacaaaucuaaaaauaagauuuuaauuagaaaaaagacaccaaagccaaaauaacaaaagacaacaaagauccuccauuuugagcucuggccucauacacaagagucuuugucugaaagaucccaaagcagagugacagaucagccgcccugccuaggucaguacaagugagaguguucuggaacuaucagugaucccccuacgucagcucccaggcucauuccucuuacccagcugugcuuacccaugucuccugugauaugcagaaaccuuugaaggaccccagcgagcuccugagcauagucugucagcuguaccagguaagcugggcaugaaucaugggguucaucuagggggguugagucuccccagaggucccccauuccuagccuuucaucccccuccagggaacggagaagccagacaucugcuccuccauugccgacucccccaggaaggucugcuauaaguaaaggcauaaccucaaacucgucccaggaaaaacugcccagcuucuucaaauugccaaccugcaagagcugcugccucgcuaugaaaaccuugcacaugucccacaaagcccagacuccagacuucucagagacaaggaucuugccuuauuuucaaauggugcuaaauuuaaauucauagaauaaaucaucuauacuccugugauuccuuuuuccuagaguuggaguuuguguuuuugucuuuaauguggagcuguaacccaggguacugcaccugcucagcucucaaugccccagacccuagaguucaucccaucugaaaagccaaaaaaaugccagucucugggaauuacuuuuuucauuguauaacaaaacacaaaagcuacuuaaggaaggaaggguguaugcuggcucaccuugugagagucuauagcccaucuccuaugugugucugugucuguguguuuguguaaguccagacaggagcuugaagucacacuguaugcagucaggaggcaagcaggcaaaugcugaugcuccacccacuucauccuauuggugggagggguuggguggagacagaauguagcccuggcuguucuggaacuuguucuguccccaagucccucaaacucacagagauccacuugccucugccuccugaaagaugagacuaaaggugugggcaaccacugcucagacacuugcaacuuuuuaauuuguccagaacucuagcacauaggauggugccacccacauucugggucgggggaaucuuuucaccucagcuaacagucuagaccagcugcucucacccugugaguccacaccccuugggggaggucagacaacccuuucacagcggucacauaucagauauuuacaaaucauaacaguagcaaaauuaccuaacaacaaaacguuauagucgggggucagcacagcaugaggaacuauauuaaaaggucauagcaucaggaagguugagaaccacuuuucuagaccaaccaucucauaugcccccgggguugucuucaaggugacucuagauccugucugauugacagaauugaccuucacaccuaaagaugccaaggaccaguuaccaaugaguccucuguccaggaaaugcagaaccaauccugucacuaguuuagugaagccaggauaggccaggggaggaaugaagacuggaaggaugggauguguagagucuauauaaugaggauaggcauuuuagaauugggcuuugaagaaugaauaggaguuccuuaggcagaacagaaauucauggauaaacacguaacuauaaaaccuaugauggggcagagacuuaaaggggggucgggagcauguguuuacuguaggaaauaaauaagacuuuccuggaaaaggcaggugagauacucgaaaaccugggcaucggacaacaguuuaguggcuugucuuguguaugguuaaagaauaaaggaaguaaggauguuuguuuccagagugacacaaaguugcugugaagagaucaauacaugaauuuugcauaaugaacuccuauucagucuucgaaacgcagagguguggcgcggcgguggaggcuguagccugggcuguaugagcauaggucucaaauagcugagguuagaccggugucuaugaacuugccugagcagcuucgcuggcacaggagaggucacgccaaggucaaguccagcagcuuugcuaaugccccucgccccgcccauucccaggaagcuuugugggcgaggcggcgaggcgagaggcagccaccuaccauuggucagcucggcucaggggugggaggcccgcgagacucaugugcgcuugcccauugguccgcugagagcagaaaaguggg

SEQ ID NO: 4501 - RNA, 13958 nt, Mus musculus
gggcgggcccgaaggcuuggaaccgcggcgacgguggcugacgcagggaucccgcggcugcggcgacggcggcggcggucguggugguggcgacggcggccggagugggugagucgauggugguggggaggacccgaggagagaaggagccgcacaaaaccgggcuccgagcugagcguggggcugugcagccugcgggguagagacagggucucuaaggccgggagguccccgcccgcaacggggcggagagcgggacacgaccccggauccggccacuuccgucguccaggggucuucggggugcacgagggucuaggggcccgucugugugagcacacagacuaugcgugcaucguaggccccuccuuuugcauuggggguuccgcgauacccuccccccauggugugcagacgugcucggcacgggggcgggcagacggguggcuuucuuaggagaggccucuccgacccucaguuucccuaccuauaacaugcaggccacaagaggccggacagugagucacaccggauacccuggaccacaaagccuuaagucccucuaggacaccugcaccggguccccgagaucuggggaugaagcccagacccuccccuuggcacgcuaaacgccuuuuucauggcuucuuucugaaagccucugcauccuagacaggcgucuuccaccaucgggccuuugcaggaaccggucugucuaugcauugcccugucccuauacgaggaccugucagccuugcucccccaggaggaugcacagaagacccaacugcaggcuggaauggggacccaggcuaggacccaaugugggguguccagcuccuguccccauccuacuguggcacuaaggugaccaugguucuucuugacaccuccccucucuugcaucaccagagagccccaggcuaaggcaagcuggggacaccccugcacccugucucaaccuccccugcaggaaccaaggcuucuguuuccuuggaugcccacccaggccacagcucuugauaggccauguccacugcucagguguucaaccccuucuugggguuccccaauaaccccaagucuaacuggccauguggucacugucuuuguuccugccuugaacuugggugcaucugugguuggcuuccuccugaugagugggguucuucagagagcucugaacuucaguucccacaacccuaguggggacagcaaagcauucagcucccagcaccccgaagaaaggcugucaguguggccucucggauggggagacuaaucaguagugggacaggggccagccccaaggucacugggggauucuguccuggcucacuccgccuuguccauguccuuuaggcugguguucccggcugagcaugguagcagccuguggucugggucccuucgucuggugucaggcacaucuugaagagccaguaagccugggcacccacagcccagcuaaugaaggagugauccaccuaucccagcuugaccaucugaugggugacacaagccaaauaauuugagaaaacaccaggaacaucauugcacaggugacuaaaugguggccucugugacagauggccaucuaggcaugugcggcccccgaggucgccugugacuucuggaaguagaggucuacaagcccaccacacaggccgcaccagcccauggggucccuagagccccggggagccagcugacgguccagaaccccccaggccagccauggcaggagccgagggcuuccaguacagggcuguguacccauuccgccgggagcggccugaagaccuggagcugcucccuggggaccuccugguggugagccggguggcccuacaggcacuugguguggcugauggaggagagcgcugcccacacaaugugggcuggaugccuggcuucaacgagcgcacccgacagcgaggggacuuccccgggacauacguggaguuccuaggacccguggcucuggcucgaccaggcccucgcccacgggggccccguccguugcccgccaggcccuuggauggaucuucugagucaggugagcagacaccguggagaaggaaugaguccacucagacuguucuguggucucuuuucucuggugaauguaggguacuuguguugggacgcugcugucagugagcucaccccuggagccagguccuggucaggcuucuuauucaggaagugagaaugugucacucuggugaccagaguggugaggaguugagggcuuaggcccuccaggcacagagcacaacuccugcaaaggccccuaugugagcuucuaaccuuguucuuacugagccauaaugccagaaaaggugggaugucuggccuuagugugcugcagagugggaggcaaggaccccacaaaccuguugaagacaaucaggcagccggaaguggaggugcaugccaguaaucccagcauugagaaggcugaggcaggaggaucacagaauguucuaagacuagcuauguggcuucgaugucuaaugcagacaguuacauggcuguagccccucacuugggguggguggaucugcagcacagcugaggccugggagguuggcucaggccacgcagcaucuggcguccccagagcccaggccuggcccugagagcugcagggccccagcccauccgggcucacagccagagccuguggcugccccaguaacagccgccucccuccccaggcuggccaagguccagccaucucaaaugccccgccucacccucaaaccuucaggacugagggcggcccucugcaggcucaguuuccccaccagcaaaggccgcaccuccgaguccugaagaaccaccuggaaccacucagccagcuccuccugcaucucgaagggggugaggcuuuuaccaguggggccuccguuuggcauuggggucccuggcuguuguauccgcccuccccugcuggcagggugcugcccaccuccucuccucuccuacagguuuggggagguuguuucuuuuucuuucuuuuuuuuuuuuccauacagcugggccagcuccacucagagaggccccgcaggcccuggcuugccucuccugcaugccagggcaucccugccgagggccagagccaacccagaugguaggggcaggcagagccuugccaaggccagccagacaccugugcacaaaaggcccuacaugggaaccaggcacuacuggaagggggcugggccuggaagcugcggugggggaggguggaagccagguguggggaugccuguaaucccaaccagaaaauugcuuuggguuugaggccacuagggcuacauaguaggucucugauucaaagccaaacaaaagagcaucagacuugguggcccaggccuuuaagcccagcacucuaggaggcagaggcaggaggaucuuugggaguuccaggccagccugaucuauauacugagacccugucucaaaauaaaaucuaaaacaaaaagauacuccagucuggcaauuuucuuugaaguguaaagcccagaguggugaucccugaggucggggcugcacagcugaccguaguagagccaacgccugugugagcuuugcucgcugccucaugagucaucucgagaccucauaggugcagccgcauguuuguagaggccaggcgucugaagugaagagggcuggugugggcuucucuggcgguuccaguugaauacagaagccgucugcacugucaccucuuuugcuuuuggagacagguucuguauaacacaggccuccugccuucauccccagagugcuggagugauggcuguccacucccacaccuugcacugagcucuuaccguccuucguguccuccacuaucccugggcuugcagauuccuugugguaaacuucggaaauaacucccacugacacagcgcucccugugcccuggguucccaagcugggcggcugcacagucuugcaggcauagagggcaugaguguucacgcccugccccuuccuuccaggccacauacucccagaccuggcagagcaguucuccccaccugacccugcucccccgauucuggugaagcugguggaagccauugagcaagcaggugagguccagccugaguguguggggggggggcgggggggggcggggcuccagccuggucuuuucauggacagaggcagagcugggaugcuguggguuuccuuguuggcuggggggaaagggugacaccuaauagggagggagguguccugggccccauguuacauaugcuggucagucacgugaguccccuucucccagagcuggacagugaaugcuacaguaagccggagcugcccgcaacacggacagguuagggauccugcugacuuucccguggugaugggaggggcaggcacauucaccaggcuggacugugaugcguugccauaccugcagacuggucccugagugacuuggagcagugggaccgcaccgccuuguaugaugcuguuaagggcuuccugcuggcguugccugcagcuguggugaccccugaagcugcagcagaggcguaccgggcacuucgagguaaagccuggcagagcagggugggcaagggaccuugggguggauacccgugugguuacuggcccaacugacuggcucuggcugucugucucugcccgcagagguugcaggccccguggggcuggugcuggaacccccaacacugccgcugcaccaggcucucacacugcguuuccugcugcaacaccugggucguguggcccgcagagcacccucgccagauacagcuguccaugcacuggccagugccuucgggccgcuacugcugcgcauaccuccgucagggggcgagggugaugggugaguggguggagccugcgacgagguguggcuugguggguaugggcaucacugugugggaugggucccagaaaugauggaagggaaaaaguaguuuuccuggaugggaacagccagugggaccaaaagcuuuggggucuuuaagguagguggggucagggagagcugcuguauagggcagaaagacuggaucccuaagugaaagggagcagggcaggggguggcugugugggcaggguuuucacuguggcuacagugagggagcuacaagcagagaggggccgucaagccugcccacgagcuuggcauuacuuccuguuuuccuuggagcuccuauugcacaugccuugccacaccugucuuccuacacugccaauuguguuccacaccugcaccccaucuucucacacauggugcagcugucacucccaggacuugacucccccacuucccccuaggagugagccuguacccgacuucccugugcugcugcuagagaggcuggugcaggagcauguggaggagcaagacgcugcccccccaggugacuguucucauugaugggcaagucuaugaccagugucguauucaguuaguacuuaacgugagcgugcuuuuugcagcggcaguaugcacuugguguguaaggcauguguguuuucucccccagcgcuaccaccuaagcccucuaaggcaaagccggcacccacagcucuggccaauggagggagcccgcccucgcuucaggaugcagagugguacuggggggacaucuccagguaguucugcugcagcaaaagaugagcuucgugugugcgugggacgggcauggggagcaggguggggcagauaggcuaugucaguggcuccaugcccccauuccccagggaagaggugaaugagagacuccgggacacaccugaugguaccuucuuagucagagaugcauccagcaagauccaaggagaguacacgcucacccucagguagggccggugcauaggcagugggucgggaggcuccgguuggggaggugucccacgauaaugaccccaccccugcauacaggaaaggcgggaacaacaaguugaucaaagucuuccaccgggauggucacuauggcuucucagagccccuuaccuucugcuccgugguggaacucaucucccacuaccgccacgaaucacuggcccaguacaacgccaagcuggacacacgccuucucuacccuguguccaaguaccaacaagugugugcugcgcuggggguugugggccucggcugggccuggguugggagggaagcacugaugguuguguuugggauccaggaccagguggugaaggaggacagcauagaggcugugggcgcccagcucaaggucuaccaccagcaguaccaggacaagagccgcgaauaugaccagcuguaugaagaauacacacggaccucccagguaccugggcucugcacauggggggggggggggcugagguacagagggauagcccaagccagugugugcucccccagcacucagugcuacaccccauuuccucccagugcuucuuacaaaucuagguuugggauucccaaaaaugaauauaaagcaaggauggguuuguagugggauuuguaggcugagucaguuagcugagugcagccagccagcacuauugaaauacgguucucagugaaggagacagagcagaguuacccuucacuccugauaacggacggacguuagggacuugugggcagaacugagcuccaccccauccccaggagcugcagaugaagcgcacagccauagaggccuucaacgagaccaucaagaucuucgaagagcagggccagacacaggagaaaugcagcaaggaguauuuggagcgcuuccggcgagagggaaaugagaaggagaugcagaggugcggggguuccuccugugcauccucugguggccacggggcaagagggaauggaagguggcucucaccgaggaggcugguaaucacuggaaauggaauucggagggugcauaggaguucgcccugccuuuuuccucaggauccugcugaacuccgagcgacucaagucucgcaucgcggagauacacgaaagccgcacgaaguuggagcaggaucugcgggcgcaggccuccgacaaccgugagaucgacaagcgcaugaacagccucaaaccugaccucaugcagcugcgcaagaucagggaccaguaccucgugugagucgcacccucuccugcucaccagggggcgcucgugcgcaucacugcugugcuggguaaaccacguucugagcgccccuuugggccgccagagauacugcacuuggaacccacucugguuuaccucgguuucccaggcauugcucacuuaccucucccuugucagguggcucacccagaaaggugcccgacagaggaagaucaacgaauggcugggaaucaagaacgagacugaggagugagugaugugcugcaaggggcaaaaggacuucauaaagggaggggguacucgcguuggugguggaggaugagagcucuccaggcaguggcuccucuccugcuucaccccacagccaguauucacugauggaggaugaggacgcccucccccaccacgaggagcgcacgugguacgugggcaagaucaaccgcacacaggcggaggagaugcugaguggcaaacgagacgggaccuuccucauccgggagagcagccagcggggcuguuacgcaugcuccguggugugagugcugggcuauggguugggguugagucauuuguguugcgaauccauugugugcauugagcacccauuuccauugugugcuaggcucuguugagcuuggcagugaagagggggagaggcaggcauggcuucuucucugagcagcucuuuuggccacgcaggguggacggcgacacgaagcacugugucaucuaccgcacagccaccggcuucggcuucgcagagcccuauaaccuguacgggucccugaaggagcuggugcugcacuaccagcacgcaucacucgugcagcacaaugacgcacuuaccgucacccucgcacacccugugcgugcccccgggccuggcccaccgucugcagcacgcugagcgcccaccucgccugccucccuguccaugucugucuccagauccccuccccuggugaacacgcgcaggaggccaucccucccgcugcgccugccauguuuacagaggcuguggggccacuggccugggcgcccugaguucuucaagccauauccccgggguuagaaaggaaccgcgcuaggugguuuccaggaacucaggccuggacacucggggccgggcgggacccgccccgcggaccccaacuuccccucuuaaggucgaagugaaaccagucacaggggguuaccccgcagcugccgagaaucuuccccacucuggcgggcaaaauacaaacucuggcccucgcccaggcccugcgcuguucuccagacugugcaaucgccuccccuuugggacaagggcccugggugugucccugcucccuggaccccauaccugcccagggcggaugggcagcagguuuuguacgguacauuuauugauacgaauaugaaacauuguaccuguuggcugagugucuuuggggacuggaauuccuaaacccuguugcgaacgacagacuuuguccugccaguggccaugccccauacccauguccuggccugccagggacccuaaacccaagaacagccccucuucugcugccccagcuccagggugcucggacagacacaagcugugacgcccaugucguccuuaacuuccucaucaggaagaaaggcaacaaccucccagccacccaggcgggugucgccugucccuagucucccugauuugugaggggagaccaagcucuggcccucugcacacuugcugaccagaccccaggaucugugcucauuagcaaaaguccugcacuaggguaggaacacaucaagacuuaagcccaugaguacuuugccaagugcucccauucccccuccagcgcguuuaggcucagcuaggacaguaacggacagaacccgucccugacccacuacccuauggguucaguuggccuugguccaugcugcauccugcaagugaccuaagacaaacagcaccuugugaccccagagccugggaagcugaggcacaaucacaagcuuauuagcuggggagacaaaucaacaaaagagaaaacaaauguuauccguacucguggccucagggguggucucugcccagcuugcagaggggugaggguuggaaucaagacuugguuagaacagaacucagcauguagccaucccaaaucgccauccccucuagcuugcugucuccuacacagaaaacccgguuuucucacgcuuggagcuggaacuuuuccugcuggugcugcuguucuguggccugucacugcuccagggacccaggguucaauucucaaacugacuuggugcagaggcucucacagcaugauccuuuccuggcgacucuauccacagucaugugucacuagcaccccauuucacagacugggaaaccgcagcugauggaaaaggacagugucuggaguccaggcacaucuccagucucacacucaguugcuggaagcaaguaccucagcuauguccucaacccaagccagggcccagaaccagagaugggaaguugcccugccuaagcuagcuucuuugcuguggccugaaucagcggagguggggggaugugccgggcgggcggggcuggcuugcugugaccuggagucauggcaguaagaauuagugaugagaaugugucacucccccaccuccgcugggcucuggggaagaacaugagccuccugucccucggucuggucgucacugucuggagucccccuucccaugccugauccaaaaacuucacgugaccagacaugcuagccgcggaggacuggaggcuggacagagucuuguggccucgugauuugggaccagcaccuggcuggggcggagccuucaggaaaggagucccaggguuagaaggagccuggauggggcguggacuuaguggguggggccuccacuugcuuaaagucucccgccuuccuggccugaccaagcaguccugccagcuuuuuccuccgcagccauguccuggucuccgauccuaccauuuuugucccuucugcuucugcuguucccacucgagguucccagagcagccacugcgucccuuucgcaagcauccuccgaaggcacaaccaccugcaagguagggaccgcaacgcaggaaggggcccagggucagaugcccgccagucugucagcuuagggacuucucugcacuuauuccgugaacucguuuuggggaacuccaaugucuucagggaaagcugucacgcccagggccgccaccccuaauccagucccugaacucugaguaccguguccacguccuuucucuuccccaucucaggucugaaaaaugcagcuauccccugcccgccuugccugagcauuuaucaaccaccuaccggauaugucugagugaagagcugagggaugggcacgcgcacgggguguguguaugugugugaggggggguguucugcuccagaccuguugaaucacugucuggucuccacccucacacaauucuugucgcuuacggugugcguuccagccgaagaagagagggggcuagcgugcuucugaccuggagcaaacacaugccccgcacgccuagauccuugcucagacucggcccgcccuccccggggaccggaagucucugcacgcaucaggcaccuucugugucuagucgggcaucagacugggugaaguuucccugggucccuggagaggaagaauagagucuucgugggugaaaggcaucgcugugaugcgcaaaauuacagagguggggagggaggagggacggagagagaucaagcgagagagcauguauuuggcuucagagugugcaucucugaacagacaaagcugagcgagagagcagcaacuagaaauaugcauaucuuuuuuuuuucuuuuacuuuauuuuacuuuauuuugauuugguuugguuuucuguuuuguuaauggaggggacagagucucaguguagggcugacuguccuggaacucacuauguacagcaggcuggccuggaacucuuccucugccucccgggugcuaguguugucuuagcacuuccugaauauaguuaaagauugugcauucgcugagcaccuacuguuugagagccugucagguuccguuuuguagauaaacugugauugcggaacaggaucuagagucucgaaaaccucagagggggaaaaaaaagccuggcggugguggcgcacgccuuuagucccagcaauugggaggcagaggcaggcagauuucugaguucgaggcuagccuggucuacaaagugaguaccaggacagccagggcuacacagagaaacccugucucuaaaccccccccccaaaaaaacccucagagggcccgggauguggcucacugggagacugcucccccaacacgugcaaagaaaccuuuaguccccagugccacaaggcugaacgaacuauaagggucuuggcauagggcugcccucuucaggggugaccggggccauaccucaccagacaccucucuuccuuucaggcccacgaugugugccucuuggggccacgcccauugcccccuucaccaccugucagagucagccuguauuaugagucccuguguggagcuugucgcuacuuccucguccgggauuuguucccaaccuggcugauggugauggaaaucaugaacaucacccuggugcccuacgggaaugcacagguacugggggcggggcaaagaaacugaagcaggagggaugccaagggacaggaacaccuggucaccugagcucaccaggaacaccuagucaccugagcucaccaagauccauugcuaucuugcaggagagaaaugucagcgguacgugggaguuccacgugccagcacggggagcuggaguguagacugaacaugguggagguaagcuggagugcggaccugcggugaagggaggcgggauuggccacuuucucuggacaacacuugccugccucuccaggccugucugcuggauaagcuggaaaaggaggcagcguuccuaaccaucgucuguauggaggagauggaugauauggagaagaaacugggaccggugaguuguugggugggagguugugccgcccuggcuccaauaucuaggcaggggauccauuccugagccacgccccaggcccucacuagggggguucuaggcagggcuccuccccaagucacaccccuagcccuuggcgugacuuucccucacguaguuucuauacaggaaaaccuuuaggucuaugagcaaagccugggaucuucacuauuuguagacacaagacacaggugacaggagauaagccaggccgagccugcuucccagagcauugugggaaauaacguccaaagguucacagcucuccaaucacuacuguggcuuaucaaacaaacgucaggccucccagccuccuggagccugcgggacacucccagcccgacuccuuugguaggacuggagagucaaggagccugagcaccaaggagacaccaaggaacaguaggguguugccagcagagggaucggcauguaaggaggcccugagauaaugagauaccagggggcagaggcugcaaauccgguguuacugggaggcaagagcacccaaagacucagcuucaaggaaccuccacccagacggacagugagaggggagaggucugucuggggccacuugggggcugauggcgaaaugacugaacaaugugucccccucuucucacagugccugcagguguaugcuccugaggugucaccagagaguaucauggagugcgccacaggaaaacggggcacacagcucaugcaugagaaugcccagcucacagaugcccuacacccaccccacgaguaugugcccugggugcuggucaaugagguaagaacucucuagccagccagggcagcacagucugaguucaaagccccagagucauguaaaaagcauggugguguauuccccagcacugaguguugcuacagcagugacuccaggcucggugguuaagaaagcuggcccucuuugcagaugaccuggguuugagucccagcaccagcuccagggaucuaccgcccucuuguggccgccauggguacuacauaaacauuguguacacacauacuugggggcaaaacaucccuacacaugaauaagauaaacaaaucuaaaaauaagauuuuaauuagaaaaaagacaccaaagccaaaauaacaaaagacaacaaagauccuccauuuugagcucuggccucauacacaagagucuuugucugaaagaucccaaagcagagugacagaucagccgcccugccuaggucaguacaagugagaguguucuggaacuaucagugaucccccuacgucagcucccaggcucauuccucuuacccagcugugcuuacccaugucuccugugauaugcagaaaccuuugaaggaccccagcgagcuccugagcauagucugucagcuguaccagguaagcugggcaugaaucaugggguucaucuagggggguugagucuccccagaggucccccauuccuagccuuucaucccccuccagggaacggagaagccagacaucugcuccuccauugccgacucccccaggaaggucugcuauaaguaaaggcauaaccucaaacucgucccaggaaaaacugcccagcuucuucaaauugccaaccugcaagagcugcugccucgcuaugaaaaccuugcacaugucccacaaagcccagacuccagacuucucagagacaaggaucuugccuuauuuucaaauggugcuaaauuuaaauucauagaauaaaucaucuauacuccugugauuccuuuuuccuagag

SEQ ID NO: 4502 - RNA, 4595 nt, Mus musculus
agugucuuccucccauuuuuauuuauuuaauauauaaaagugaacaauucuucagaccauugaaauggcaagucccuggcaggucugggaugugggggauuugcccagcugcccccaguugccuguucuccuugugauguccccagcugccccaguugccuguucuccuugcgauguacuugucuguauccugaccccugagggaggcugcagguucugaacauggcagaucacaacugcagcucuggguucaccugggccaccaguucacaaaagcuggagccucuggaccuucaggucccaaugacuucuccuuugugucugucccugagcccucugcccugcuaaccucacagugaggccaugucuaagacaccuuaaugccugggcucccaaccguaggaagaaggaaugggcgcuaucugcucugaccauuuccucugugcuugucugcuugcugagcuccuguucauaucucaaagccucagccgaaaugcccuuuggaagucuucugucuccccucuggacuucuagcugguucugguuccuugagacuggaaguguccauuccuagauucaucucucccaaacuacaguucccuagaggagccgagcauugcuccacagccucguuggugggucuaaacgcagagaaccagaagcuuugagaagauggacuguccuuggaagccaugcugcuccuuugcaauguugggagacacauugccucauuuaacccuguguucccaaagcagauggcgggacuucauggccaaagagugugaaccugguaccgaaguugucagcccauggaucagcaggucaugcagcguggccucacagccucugaggguggguuaggguccuccugacagaaagagcccuagugagccacacugugugccccaacaccccaaccccuucagaucaagcagucagucaggggucccgaggagagugucaccuggaucuuaugauucuucuaccucagccucccaaggacugggacaacaggccugugucaccacacccugcccccaucagcauaucaccaaacaggcuacugaagcaagagagggugcaggcagcuuaccucggaguacagaggaggcgggcaguagcggaacuccuggagacaggcaaaguagggcccuucuguggucacaccuaggucguguaggagggaggagggccccggugacgcacauaccagcuggcucucccucaccaccucggaguacucagguggggcugcaaaggaaagacagugagugaggcucugggagacccgugguuguaacauggugacaacugagcccuuuuccucuggggacagcuccucuugcucaggcuaacaucuaauuuguagcaauccuccugccucaaacugucauccuggacuuuuaguuuugaauacugauucuuugugcuuuuuugagccaggaucuugguguagagcaggcugcccuccggaugcuugcuggcauuauaggccugucuuuccacacccugauuuggcuuggcuuugaaguccaggucucuugaagcccgggcuggcuucuaaauuauuaaguacuggaagcuggccuugagcugacuccuuagcccuuggugcagguuugauuggugccugggauuagucccugcuuguauagagaccccuuggacaaaggaccaggccugggccguggcucugcccgcccacaucccuugccaguuggcuaagcucacccucuggccgauccaucauggugcacaggccccagucuugcaggaagcuggcgcggcugcccacacuagcggagcggcugcccagaggaugcagggggaccgugccuaugaccagaggcagcuccagcagcagcuuggacgagccuggaauguccacgaagaccugaagggagcagcagcgaagugggcuaccagcccaccugugcccucccccuugguuuggacgacaggauguaagggagcccuggguaccuugagugaguaguccacacuaagcacgcggcacugcaagauggacgggcccaccggggggauacgcagcgcacgaccgggccacagcgcacggcgauucgggcccacaggcuccccguccacacuggccaccacagcacgcuucugcuugcgggcaccucgggccaugaaggucugugucuguacuagggcagcacggggcugcacagcucgcguggaaccauugucaaucuccgcaaagauagggaugaccucgccuacagcagacagcagcuugccucaguuuccccacuaccgauuacccauuccagcugcacacagcuccccauguuaccuggaguguagccuuugcggucaaucuuggccgagagggacacgaggccacgugugcaguaccaggaucgugccaccuucucccgggcuccagccugggguuccuagggagacaccaagugcauuuugagcacugggcacaccaagggucauuuugagcacugggcacuuggagaccugagucuuauagaaagacugagacaagcgggcuguuuuaaguuuugaccagauacccccaaauaacauaacccugucucuuuuuauguuuguuuguuugcuuguuuguuuucgagacaggguuucucuguguagcccuggcugucuuagaacucacuuuguagaccaggcuggccuugaacucagaaauccaccugccucugccuuaaaggcgugcaucaccacugccuggccaacccuaucuuaggaagccaaaaguugaauaaaaauuaaaaauaagccaggcgugguggcgcacgccuuuaaucccagcacuugggaggcagaggcaggcagauuucuaaguucaaggccauccuggucuacagagugaguuccaggacagccggggcuacacagagaaacccugucuugaaaaaaacaaaauaaguaaauaaauaauaaaaacaagacuagaugugguggcaccuaucuuuagucccagcagguauauuucuaugggcuuaguuagggccagccuggucuacucagugaaucucagaccagccaggauuacacagagagagaccuuucuaaaauuaaaaaaaaaaaaaaaagucgggcagugguggcacaugccuuuaauuccagcacuugguaggcagaggcaggcagauuucugaguucgaggccagccuuaucuacaaagugaguuccaggacauccagggcuauacagagaaacccuguuucaaaaaaaccaaaacaaaacaaaacaaaaaacaaaaacaaacaagaaaagaaaaagaaauaaagcaaaacccaaaaccaguaaagacaaaagcaaacacaaaaacaaaaauagcccuaucauauccugcuuuccaaaugggguaucugaggcugggaaagagcaagauaccuucccagaggcacacagcaggugagcacccucagaauuugcacuuaccuauaguggguuuuaaacucaccacuaacuccuggcucccuguuacagaggucauuugagacccucaaaucuaaaaggugucaagcagccaggcuggaccccaacccccauggggcagccacuugccagcagggcagguguguuuauguccacagguucaaugacagugaacaccuuccgggcgcagcgugcagggacccauggccggugcagaguggcuuugauggaauagcggacgcugccguguuugcccucgaaggaugucaccagggagcugggguggcaagaguggguaaucagaggaucacuaucaggagauaguggggugaagggcauacaagagggaugucccgagaagucagggcugagggaacccuagaugcccagccagaaggcgacaguggggcuuacauaggcagcuggaagcugaagggaaacucguggcguccagcgggaagcguggcgauaucccccgagucuaggaacaagacccggggcucagcggacguaggccugggaaucgcaugcucggugcgccccaaaagguccccagcccguaccuggcgcgagcagcguggcgcggugguucacgacuuccacgcgcucgcuguaacucugaguauaagcagugcuggagcccgcgcugcgcgacuccguccagugcgcgcgcgcgcggccccgagcgcgcagccugagcgcgcccacgcgugccgcgcccgcaagcuccaacaguacccggccugccacggccuggccuccguggaacacgggcucggugcccgugcgcgccccgucuaucucuacuacgaacgccuucaccuuaucgaacagcauugcggugacggucgcgaacccaaaaaagagaucggccaggugcucgaacccgcgaaaagaaagagcuagagacugcgaacgcagcgggcucgaacuacguacacacacaagcgggacaacaggacggaagaccgcuggggacccgcagcugcgucgcacuuauaggacgguuggagggcggggccugaggagaagaccgcaccuaccggaagagacuccgcaaacacagcaguagggaacgggaccccagaaaagacuaggccaauagcgcggcgaaggaauggccugaggagaaagccacaccuucaggagaagacucc

SEQ ID NO: 4503 - RNA, 5933 nt, Mus musculus
aucuuuaccagacagccucagccagccccacacauuuguguuccgugugucagccuggagaaaacugccuuacaccucaggcucagggugggcaccugcagcuccaccgcugcugugugacugacuucaagccucuccaaucacccugcccuauccagggggcgugcaaguccagccccuccugucacccuugugggacccaccacacauacagacaugggccucagccucgccacagccuuuauugggaggguacuccacugggcucugcagggcucacggggacuaggaugucagagcagggacccucuggguuguugaggaugaccuauggcgcagcugggagaaucccaggcccggaacucuaugaaucccuggucaggccuggcuggagggggaugagcugacucagacaagcuggacucagccugguucugucacuugggcgcauuaaagggcagggcgcgcugguucaucggguugucaggggagcgcaaccacuccuucuucagcagcugcuucaguugcgacagccgcauguugggguucuccugcuucaaccguggcaguugcaccuccucaaacgcggugaaggccgcucgcauccggcgcucaggaugccggucagcuuccucagccacacugcaagucaaggagucaggacccagaccuaagucccgccccaacaaacucuccucuucagggccccgcccacacagcccgccccgcccaccugagcacugcgauggcguccuccacagugcgcgccuccacgcugcccucuuccugcaggcgccgguuaagguucucuuccaguggcagcucuagguggcucuuagccuuuuccacugugggugacagggacagaauaugagaacgaggcguuggcgcgaagcccucgggggauuugccccaggccacaugcacaccuggcucugcccgcugcucucuccgcagcgaguccucgaucugugcacgugugaccuuggcgggcgccacacguggggccuugccgccuuugagccgugagucuuccuccuccagcaggcgcugcgucuccuucuugcgcuccagcugcuccaggcgucgcuucuccuucuccuccugcaggggcaacaggggaaggcuauguagacagaagcugccugggugcccaggguggaacccaagagggcgcugcucccuccuucccuauccccccagggcacccuuguacaaaaggaccugggcagcuaaagugcuucacaaggguauuuccaugugccuuuaccccaaaggcagagaggaaugccuaucuggggucaaaaucaaagguguuugaaggcagcaucuuccggaggcuccuuugccucagcgcuaucucgcuacauggcuuuugaauagcacccugcccuguggaauuccuccacuagcucugaacaucccacucccacucugucuucuggggacagagggucugggcagggucgugcaccaggacagcucaucccaaaagaaggucaucaguacugagaaagacacacagaauucugaucauggugcgaaccuggaguaccaccaagcugcagggggagcugaggcagguggagaggcugagcccggguguuccaggccagccugggugauagaaacagaacaaugaccaacccccuggauagcagggcgaggccugcuguggagacagggucucuguugccaccuagugggcagacacgucagcaccaagcccgaaccacuccaguaccaaguaggcaccuggggcuggcucaagacaggccucggucaggaaugucacaauaagguuggagacaaacacagacccacuucagcuagcuucugaguaugcaucccuccauggcuaccucgagccaccuuucaacaccgaagcccaugccgcccaccuugcguugcuccuuccgcaucacguguuuguccucauccuuccaguaagcaucuuccagcuccuucuguuucuuggcaucagcggccgccuuggcuucagcccuccgugcucgggcagcugccgacuugcuguucucgcccuggaacuucuugggcaucccucagcaggcugcaggaaggacaccguggaggggcuggacugugacuaggacccacccaucuccaagacuuuacagacugcuugcaaaagcgauuuuuuaaaaaacagggucucauuauguagagcaggcuggccugacaugauccugucugacccuuggacgcuauuaggauagcaaggagcagcgagucccucaagucagcauuuccucucauuuuauuaacauauauaacaacucuguacccacaaaacguaggcagggccuccacagggcggagggagcuccaccugaaccuccacacuggaggacaggggcucuagcccugagccauguccucaccccucccuggugauucuaggaaggggcucuacuguuguguuucuucugaggcuuuugaacaauuuuuuaaaaaagauuuauugcugggcggugguggcacacgccuuuaaucccagcauugggaggcagaggcaggcggguuucugaguucaagaccagccuggucuacagaguaaguuccaggauagccagggugucuugaaaaaauaauuaauuuuaaaagauuuauuuauuuuauguaugugaguacacugucgcucuucucagacacaccagaagagggcaccgggugccauugcagaugguugugagccaccaugugguugaugggaacugaacucaggaccuugugcucuuaaccacugagccaucucuccagccuacugaaauaauuuuuuuaaaacuauaauuacaacguugugcaaagaccaacacugcguacuccagaagacuccaauccuaucagcugucacuuccguuccuugcuccagcuccugagcuacuuccccucugccugucccuggagguauuuccgguuaacagacuauucaccauguggaauucugucuggcugcugucacucagcacuggguuuugugucgugucagagccucugguggcauauguuguauggagcauaucuaaccguccaccaagguaugggcuuuuacaagucacaguguacuggaacccugcaaggugggugauggcuguugggguguccuauuuuagacuguguagaugggggacacucuguggccugugagccuacacuggaccccaccagaugaaaggacacacagccaaugugccuggaagagacauuguaguagacugacuccacgguaggcccccagaaccucaacuguggggugcucaggcauccccaggguaagugaccaaacugaggagucuggccuucaggugaggggagcaccccuguuccugucaggugugguggugugucccugggaggcugaggcauggggaccagaaguuucaggccaucuuagcuacacaaagaaagaaccacacccagcaugcacuggcucaagggcugcagcccacugggccucagacuuaugcaccgagcucccgcccagugcuucagagugagggagacaguucugaguggccggggaccaccagggaauucccacccucaggcccucuguucccucuacaggagacccugugcauccuaucaggagacacuccccacagacagcucagagcaugcaaagguccaguggcaggaaugaggcuguguguucauugggguccauggaagcucuggugggugagugagggguaggaaagaggagggggcagggcuggggacacacuccuaucuggcuuacaaagucccauucagcucccgugggcacugcugggugugaacaccaugugggcagggaucaugagagcaggcuaugaggccaguucaugaagggugagggcccugacuggcuccuaagcacugucuggccucaaaugggccaucagacaaagcgcaaggaggaccguggcaacuugggucccuguggucaaggcgcuccuguuggccucaguuuucucauagggaugcugugaauucugaccccguaucaugggguaggcaccccagcuggaccccaaacagucccugacucccaagcuccucacuaggucuucccugugagaggcacaccugccucguuugagccuucaaauacacccaccagcccugcccucaggaccucacacccagccugaaacuuuccauccuccugccucagcaggaugacaggcaugcagcauuaugcugggcucauguuucucuucuaacccaauaaacuccugcugaaacuucagggcaaggcuggcugggacuagaggcauggcugccacgcugggacagguggauaccucuaagcuccaggccagccuaggccauacagagcaucccucaagaaacaaaccagggugcuggugagauggcucagugguuaagagcacugacugcucuuccaaagguccugaguucaaaucccagcaaccacaugguggcucacaaccauccguaacaaaaaucugaugcccucuucuggagugucugaagacagcuacaguguacacacauauaauaaauaaaucuugaaagaaagaaagaaagaaagaaagaaagaaagaaagaaagaaagaaagaaagaaagaaagaaagaaagaaagaaagaaagaaagaaagaaagaaagaaagaaagaaagaaagaaagaaaggaagaaagaaagaaagaaagaaagaaagaaagaaagaaaccaguucagguguagcaccagagaaggccgaccaagagcuccugacguucccagaccggaaauuucucuuuaaggcauuuggugguggcguuguggguguguggguguggaguggguauccggagucauuuguauccagaaagagccucgguaucuugcccaggcuauccuggaacucagaaucuuccugacugaaugucuacuguauauaugucauuuaacaaaccaucgucaucagcaaguugggggcauuaaggaguccgcgagcacggacagcaaaggacccuccucacuagggaccugaucagauccgcaccaccaccucaguuuccggaccuaccuaggguccgaggccgggcaucgugggcccacgccugugauuccagcacuuagcaaugcugaaguaggagaauuacacugaguucgaggcagccuagacuacaaaaugagcccaggacucuaaauaauccccuucgaaaagugccuacgugguuccccaugacugccaggccgcgcggcaggaggaaagugacagaaaacuccuacuccuccuccuccaggaagcccucccggcucgaccugggccggaaacuggcugaacuccccgcgagcuucugcgccugcgcgcugggagcacccaccaccgggcaccccaucuccaguuccgccuucccgccggcaggacccccaggccgagccgcgcccgcccagcgugccccgcaacccggcuccgcccgcgccacagccguuccuaccucuucccccggcaccggcucggucgcgugucaaugacgucgccgcgccugcguacucaacuuucgguggcgcucuacucaugacguucucgaaugccgccaucuugguagagucuguaggaguuuuucucugagccaaaauacuaaaccaguguugccagcucuccuucuuuccaagcaaaauguuuucaagaauaacacguuaucggcccaucucagauauuggugaacaaaaacggaagauaaacgcuaaacuccauaacggugaccucaccaagauggccgcugcccggagaaaagauggggaggccggccccagcccuguggcgacggccgggaugugguugcugugccaccagggggcgucaguggcccacccggggugcgggccuggcugcucugggcucuuugucaggccaauggcuccuccaacucagggcaaaagugagaagacaucccuugcccugucugagucggg

SEQ ID NO: 4504 - RNA, 9874 nt, Mus musculus
gggucgacggcccagcaggaacucgcgcugcgacgacgcucgcucugagaguccccgacguccuccgcauccucuccguuccgaguuaccugucuccauggagggcgcggaggcaggggcccgggccaccuucggccccugggacuacggcguguucgcgaccaugcugcugguguccacgggcaucggucugugggucggccuggcccgcggcggccagcgcagcgccgacgacuucuucaccgggggccggcagcuggcggcagugccuguggggcugucgcuggccgcuagcuucaugucggcugugcaggugcucgggguccccgcggaggcagcgcgcuacggucucaaguuucuguggaugugcgugggccaguugcucaauucgcugcucacagccuugcucuucuugccgaucuucuaccgccugggccuuaccagcaccuaccagguaggggacuuggucccaugggaagguuccgggaagaugccgcgggcaccgggcagggccaggaaggaggaagagccaguccgggccccacagcucgcagcagccucggggcaguggccucccgcugacaccugucccugcgagugcccguaccagccacccaccggcgcccgacagaguucaaacgccugcagugagguguaggauuucccaaacgcucaacaacuguagugaaaacggaauagcauccacuugcaguuucagcacuagggagauugaggcaggaggauugccaugaguaccaggccaguuuggacucccuagggauaccccaguuucaaaucugagggcgcaacuaggcacccugaaacaacgguccaacaaguguagcgacaauaugaagucccaugugugauaucucaguacuagagaagcuuuggcaggaggauugcugcgaguuccaagccggcuuaaccuacacagagacucuguaagcucaguugggcacuccggaacagaguagaaacagugaggauggcugaggggucacuugcccgguaaccuccagcccuuggcucccucugcaguaccuagaacugcgcuucagccgagcgguccggcucugcgggacgcugcaguacuugguggccacggugagcgagcugcccgcccugccacgcccacacgagcaauuaucauagcccgcuccaaccugaccucacgccacaccccucauccuaccuggccccgcccccuuccagcuugagcuaagcuucucugggacauacaaggaccacgccuauagcucugcccucauucugccuaugggcacccucucaccuagcuccaccccauccuaccuaaaaacaccuucuugcaaccuggcuccgcccuuucugccugauccgcgcucucuucuuucugccuccaacccguuugcccgccccuugccaucaccgaccuccccacccacagaugcuguauacuggcaucgugaucuacgcaccugcgcucauccugaaccaaggucuggcugucgggagcgggaggggccaggagcccaggcuggacccuacaugagcaggcaggaugagggagaccugacaggggguguguuuugcagugaccggguuggacaucugggcaucgcuccuguccacaggaaucaucugcaccuuguacacgaccgugguaaguggguugugguggcugacacgcggaaaaccucaggcaggcagcaccacuccagcuuccuggcaccugagguagccgcagccugccuaacugugcccguguccucuccuacauaaagacugauagacaugugagcuucaggugcggcuggauccagcagcccugacagagcuuuaccuucccauggucacucuggugccaaaacuggcccccugccuuuccuggcuccugcccagcagugaacugguuucagcuggaucugccugagacucuggccuagucuucuccugguccccugauuggcugugccaccuaagggacuggcauguucugguugcuguuuauguacggcgauggaggcucagauuucuaugaauggcagggagaaauacauuugugaaucagaaguagcugcuuggcuccuuucacagcagcauuggggaggcuggaagcuuguaaguucuaggccagucugagcuacauggaccagaaauaaacaaaaagggauaaugauaauacuggguguuggauuguuugcugggaugccuggggccauugcgucuguucccccuuaccuuaucuaauccucugacugaccauagaaacacacaauauuucacagaugugccacaggaagccaggcagggugagcugggggugcucuucagccuucuccccacgcagcccugccccagcagcccugggcggguuugugaccuguauccccucucccacacagggugguaugaaggccguggucuggacagauguguuccagguugugguaaugcucgucggcuucugggugauccuggcucgaggugucaugcucauggggggccccuggaacgugcucagucucgcucaaaaccauucccggaucaaccugauggagugagagauggugccucacugugcagcccaggcuagccccacuucugucccucagccuucccagcacugugucucagaggggaacaaaacucaacauagaaaacuccuacucauacuucaaaacucacugcaaauguccccuuaggaucuagaaaaggcauaggugaucuggggagggugacauccucacaugguuguuuuuguuguugaguuuguuuguuuguuuuguuguuguuuguuguuuugguuuugguuuugguuuuugguuuuucgagacaggguuucucuguacagcccaggcuguccuggaacucacucuguaaaccaggcuggccucaaacucagaaauccuccuuccucccaagugccgggguuaaaggcuaaaggcaugcuccaccacugcccggcuuggucuuuuuucuuguuuuuuuguuuuguuuuguuuuguuuuguuuuguuuuguuuuguuuuccucacaugguuguuaaccugccucauucccuacucagcuuugacccugacccucggagccgcuacaccuucuggacauuuguaguagguggcucccugguguggcucuccauguauggugugaaccaagcccaggugcagcguuauguggccugucacacggagagaaaggccaagcugugaguaugcagcgagugugcagugagggacccacacagaggcugcugggacagccuggcccuccccacacacuccuaaggccacuccaucccccagugcccugcuugucaaccagcuuggccucuuccugauuguggcuagugcagcuugcuguggaauugucauguuugucuacuacaaggacugcgacccccuccucacaggccgcaucgcagcccccgaucaggugagcucugcucagcuuucccaucgugggguggggcuagaaaagcauuccuucuagaaggcacaggcugcaggcuuuugaugcagagagcucagaggcugguccaaggaaagcuggggggggggggugagccugggaggcaggcaguagggagccauaguggagugagagcagccagaggaccuuucaacugagagucagucacagaaaugcccuaggaacaucaaggagagggaagaccucaggcagccagugugacaggacacuuaagauaaugauagcuggacucuuccuuuuggaggguaagggguuguugagauagggcuucauguagcucaggcugaccugcaacucacaauguagccgaggcugaggcuggccugucuccgugucccccuugucacagaggccucugucuuccacaguacaugccauugcucguguuggacauuuuugaggaucugcccggaguccccgggcucuuccuggccugugccuacaguggcacccucaggugggcucccugcugccccucagcaugacucugcccccaggggcucuggugcuaauugacuggccagcauccccuggaggaugccaaggucuggccucauccaucaguuagggaggauggcccugggaaggggacugcaccagcucucucgggguguccuaagacuuauuucuccucccuccauccccagcaccgcguccaccaguaucaacgcuauggcagcuguaacuguggaagaccucaucaagcccaggaugccuagccuggcaccccggaagcugguuuucaucucuaaagggcucugugaguuugggggacuaggguucaggaccaggaugguacccuacacugacugagcuaccccucccccacagcauucaucuauggcucaaccugccucacuguggcugcucuguccucgcugcugggaggugggguccuccaggugagacccccaaccccaccugucuuguaccuacgugagucucagcccagguucagggagauguucgggcuauuggacacuacuagcugggaguagggauggggugguguugaacgccugucauccuagaggcugaggugggaaggugaggaguucgaggccauuccuagcuagauagagaguucgagggcacacgugaaacccaccacugacucugucuacuagccuugggggagaaauaggacugagaaaacugggacacagaggaauuucaaaaccugcagugguuuugugcugagaaguggugaguaagcccaguccuuuuccaccugccuuucagggcucuuucaccgugaugggugucaucagugggccucuccuuggcgcuuucacccucgggaugcugcucccagccugcaacacgccagugaguagggagggcugggcguguccugugagagaugagaucaaugugccccgccccucacuguggccccgcccccagggcguccucuccgggcugacagcaggcuuagcuguaucccuguggguggccgugggggccacgcuguacccgccuggagagcagaccaugggggugcugcccaccucggcugcgggaugcaccaaugccucuguccucccgagcccacccggagcugccaacacuuccagagggauccccaggugaacagcccggagucgggggggggggggggcuggggggggaggguccagggugugaugugaggguguuaacaggaauggacugggagcagaggaaagagcauuccuagagggacaaaaucgguuugugcaaaggcccucgggccacgccacguucaaguucuaaggcuacagggaggugaucugguuuuaauagaagggcagaggaaccaaaggcagaagaauuggcuugcuuuuccucuuauuuuuuguauuuuaguacuuugagagagucucagguaacccaggcuggcccuagaacucucuacauagccaaagaugacccugaacaaaccccugauccuccuuccucuaccugcugcaugcugaggugacaggugugcuccaacauaucuggcuacucugguuuuuucuucuuuuccuucuccuccccuccccccuccccccuccccucuccuccccuguucuccccuccccuucccuuuuaggucucuccagacaggguuucucuguguaguccuagcugugcagaaacucacucuuguagacuaggcuggcauagaacugucuucugucuuuauuaauuauucuacuuuuuauugggauguaauacacagcuaaccauaaaagcuuagguuuaacuggguguaguggcugagcuucgcagcacuuuagaggcaacaggcuagaucauaggcuauccuugacuacaagauaaguuugaggacaauuugguccacauuaauaaauuaauuuuuuuuaauucucacuucugggaagaucccuauuuuaagucuguggguugaccucuacuaggcauuuccuaagaacaaaaucuuacaauaugugaacuuuugcaucucaccuuguuuuggaaauucauccuugauuaucuaugaccgaaguguccaccaucaguuccuucccuuucagggcugagugauauuccauugaauggauauaccacauguguguaacugcucaucaguagauggccauaugggugaugcccugguuggugcuguugugaacagaguuccauauaccuuugugcacacagccaagugugcacaggcuucucuuccuagcccuggggaaggcuugagacuuugucucaaucgaggccuggucuugggguguugcucacugguugaguacuagccuagcauuggagagguccuggguuccuucuagaaaaaugcagagaaagaagagaagaugcuagaugaaacuccaugcccaucuaaaaccuuccaaagcuugguugggucuggcuggcauucuccugugugugccucuucagaggacaggucuuugaagguuuugaccagaagguuguuuucuaagcauucaguuucacuuaauugcaagaucaaugggcagccauggugggugguaggcuguagcagaaagagaggagacccggcaacugcauacaucucuguauuugagggaugacugaaguuggucucagcugacacagugggcugguggacaaacaggaagaaggcaucucacaccuguccucccccaccgcaguucuggaauggacucgggccgcccagccuuugccgacaccuuuuaugcugucuccuaucucuacuacggggcucuggguacuuugaccacuaugcuuuguggugcucucaucagcuaccuaacugguaagugcagcagccuccucuggggucagcgguugguccuccugucuccacccucaacuccccaaagggagagaugaaagagauucccaugcggcugagagcuggcacauuuuuaccucauccuugagacgccccacaaggccgguucuauuuugcagaugugggaacuaaauggggcagguuccuccggaaagucccugcuauggccggggaugcgggacgcuguccgcgguccugaagcaaaucagcauggggaggcccuugggcucuaacaacauccuguuugcuuggauuugacaugggggugggggaucucucucugcagcucaggcugacccucaugacaauccuccagccucaccuuuaugaguacuuggaugacaugugcgcaucaccgcacucagcacaggcuauauucucuuuuagucauauauuuccuuuugagacagggucucacuuagccccggcaggccucgaauuccuuaugaagcugaggcagaccuugaauuuaggaucccccucuuccacccacuccugaguguauucaccaccauaccugguuuaugugguucugaagguggaagccggggcugccugcgugccaagcacucuacccucugagauggaagcauuugacacccgacccucaggcccagccuggcuuacuccuaugacucagcgacuuggugcccccaggcuguugcugaacuucuagacauuaggguugaaacagugaagggccaaaggcugggcacagcucccagccagcugagcugauggcgccuaucugugaugccaacacuuggaaggcagaggcaggaggacugacugagcuguagcccaccugucucaaaagugaaaaauaaccuaagacugaaaccaacuccucacgauucagaugaagcaacugagaugaacugggugggccaccauggcuggcgauggggcugggcaagcacucaacgcugaguccccguccucucugccccucaggccccaccaagcgcagcucccugggccccggauuacuguggugggaccucgcucggcagacagcaucuguggccccaaaggaggacaccaccacccuggaggacagccugguuaaggucagauuuagcccaggucacugggcgccaaggucauggggaccuggcggguguggccaaaggggcccggcagauuccucucugugguuaaagucaucccuuucccaggggcugacacaugagcgcugucuauuuuuaucauaucuguuuuuuuaaacaaauauuuccugccuguggcaggggaaacugguuuccccuugagagagagagagagagacacucaugaagaagucuuaagauaacauuacuuaauucagaauuacauaagaaaugggggggcuggaggggagagcuaggcuggagcugaggccggggacuguagagccagucgaugaucugaaaguuggagacacugucaccucaggucaagugaccagauugacacaaaggaaggagaaguuuuucuaguacaugacaccaaagguagaaauguggagugccaggccaggaguucgaggccaacccgagcuacauagcaggccugaggccaguguagaucucaaguaacaguaggaaggggcuggaggcgccagcugggcuggcaaaggacccaguccauucaggcaccacaugaggagcaccaccaucugucacuccaguucccccagaucugaggccccaggcaugcacacacgcuggcauaacacccacaccccauaccuguaacauagaaauaaaauaagguuaugaaccuuagugaucccaguacugaggcagaaggaucacugcaagucugagguuacaccgggacuggggcugggccuugguggaacgcuuucacaacaccagggagguagaggcaggaggauggaccucagcuacaaggcuagccuggacagcagcugacucugauggagggaggggugcugggccacucugcauguagcugaccuaguuaguccucugggaccccaucuggggcggguguaugauguccuacacuuucuuccagggaccggaagacaucccugcugcgaccaagaagcccccuggcuucaggccagaagccgagacccacccccuguaucuggggcacgaugcugagaccaaccucugagggcgaggcccgagaaagccaaucacaggccucgggccagcagccuccucucugaaugguuggaccaucaccuguacagaagcuuggcugauagaggcccugcccgcccugaagucccugugucccaccugugccccccaaaagaggguugguucucuauccaccaaggaaaacaucuggaaccgcagugaccuuguagauugcaguaggcaacugagaacacucagcuucuccagaccgugagguuuucccauuuaacaagcagagaagcugagggcggucaccccaacgcugggaagguagaggcaagagauucaggaggucaagaucauccacagcuacaggcugagacccugcccacccccaaauauauaaaaguaaucugggugagccgcguggcuucgcgacagagggcuugcccagcacacagaagacccaaggcagagggagaaaugggauguccacagaacacagagccccaaggauugugaagcuuccgcgaagugccaagggacagauucucagagcccucacaagacacggauggacgaguugccuccucaaagggacugacgguuugcagacuaucagagaacauguuccuucugugaucagccaccuaggcuccgcuaaugcguuccagcuuccaggagacccugcagaccccaccucccaugcucucugcccuuuaccccugugcuuuguacacacuaggcaccugcucuaccacugaaccucacaccuacaccuccauuuuuauuuuauuuuugacacagugucuuaagguagucuggcugaugucuggcuaucacucagcgcuuuuuuuguauaucaauauuucauucuuuuucauugccaaguggucuuguaaagacauaccacagugugucauccauucccaguggguggaugggugaauagcugcauuguuuucagcuuuuguguacaccaauaaaauugcuguagguguucagaugca

SEQ ID NO: 4505 - RNA, 2729 nt, Mus musculus
uuauggcuuucacauguuaucuucuaagugccauucacacauugcuaucccugaaaguacucugggccauguguagacauggaaaugucuacaaggggccagaggcaagucccucagagguagcaauuguaggcaacugcaguagguuccucccugugacagaacagucccaggaagcuucaggccugugcccuuucaagauugggcaccaugaugaugccgugcuggcugcacccaacaaaaggaacccccauguuuccuccaucauucaccaaagcguaacccuguccccaucuaaagcuugcaagcucacuguggggcuuggcuggccucauuuccaccuagcugaagcuuagagccagcaggauaaaaagcucaaccagguccccaggcuuggauuauagucaugucuggaauucuuaggccugagacagcagcacccuggaguccagaaacagacugcuaccccucagugucacaggcagggcucaggcuauguccuagacaaaucguaguggggcugaagcuaaucuaaggggauacacaccuauggaaagaugccacugagcaaggcugacaggcaggugagcagggcuagcauguuguuagggacgggaccaacugggaccucuccagggacauagaagcaaacaagcaaggacagucucaaguuuuuauucagugggucucugugucuagaagaagguguugggccucuugguggugaagcguggcuugugcuggcgccgcaacacacgguggggcagugggaauuugaucuuggaguccuguggggagggaagcaaucaguguccagagacuguccgugugcaaccacccccugcagcccugcgucagccccacacucggggucacucacguggaacugcuugacagcuggccggcggcacuugccagcugcaaucucuuccaccuucaugaucuggauggagugggcacgggcacggugucgggcacccaugucucggucuguggaaagaaaagaaaaucagccccagccacccagaaugcccccacauucuguagagccuacugauucacucuggggggcacugcacagccccccaaaggcgacgaagccccuuugcugugugcaccacuauuuaaacagccgcuacaggcagcgacaguucuuggguugggugccagaaauuggcagaggguuggagacucacagcacugugugacugcaccagcaguggucaggucccuguacucccgauacauguugugugugccacugcgggagucauagcgcagccagaugccaaaguucuucacacgcaggggugacuucucaaacaccuguggggaguagggaggacaugaggagugcugcccuggcucugaugguacccagcgaccggcauccuguggggccccagaccucaccuguccgcaguacacaauuuccccggaugacuucuucaucuucuucagcugugacacaaaguaccagaagcgggacuuggccaccacaugguugggugcaaagauucgcauacgguacaguggugguguguggcauuuugggguuggcaagcagcgccccaccaccuuguacucccgaagcugaaagacaugucaggagagaaaguugucuaugugggggagggguguggaggcagagccggccugagauucaguccucccacaggcagggguguccaaagugggcucauacacucgagcccagugugaggcaagucagaaggcuugugcuccgcuacgaagcugccucagggucuacauguggcaggcugcucugcucucccugaaacuccaggccaagauggcaaagguggcucacgucuuuaaucccagagcaggaaaaaggccauuuguucuacagagaaacugucucuggauugggacuaauugacgauuccagacuagcuuuucaccaagaguccgaaggauuguguccaacacaccggggccaguaugagauccggcacccuaggcuaccgucagccagccuuuagaacuagcuaaggaugauucuagcgacgcucugcuucgauuucaagugccgagauaaguggcagcaggcucgguguagccagcgcuggggacaggccgcaagcuuaccaaaugcucucuaaaccuaaggcgggccgcguguccacuccagucuaaauagaccagguuagcuuuaaaccucauaagagacuaaaacaagccagccgggcguggugucacacgccuuuaaucccagcacucaggaggcagaggcaggcggauuucugaguucgaggccagcuuggucuacagagugaguuccaggacagccagggcuacagagaaaacccugucucgaaggaaaaaaagacuaaaagaaccacggggcuagauuuggcaacgaaaaggaguguaacgcugauauacacgaaaaggcggagggccuuccggugcaccccgaucuaacccgcuccguccucggccgcccagcacgcggcggccgccauguuggccgcaaggaggcugugggcgaggagagcugcccguaaccgcugagggacccucgcgacgaacgcaccaccaccccggaggacacagccaacccgagcggcccugccgccaacgccgcaccuuuugccccgccgcggccuccuuaccgugcccgaggccuucauggcacugcgcacucguucaccgccagucacaaaaggaaguguugucuuucgcgcaggcucucaccauggucu

SEQ ID NO: 4506 - RNA, 8071 nt, Mus musculus
ucucggcagcgccgcacaaacuuccggccaggaagauggcggcuuccuagaguccugauugacuggccgcggugcccaggcuacagaguggaaccugcggcacugugaacgcgcgugagcuuugugucgccguggucuaacuucgacccggauugcuguagcuccagguucguucuucuugaggacuuaggggugggggauucgaggucccgagaugccaccccuaaaaccgcgcauccaucgcagggucacuugggcuuccuguguuucccuagggaccggaccggcgccgccucaggggaaaaguaguuuugggaaacuucaacuguaucuuuucggcuccacaaaccaagucucccaggugugggagccacuggaggccuuaaugggucgaauacccagugaccaggcaacugggguguucguccuguguaaacagcggaaagcuaaggaugaacagcaguucaguuggaacagugcuuguggcucaguugguaaagaguuugccuagcuugcaugaggcccuggguauccgucccuagcaccaccuaaacuaugugcggcgguguacuccggcacuuggaaggugaauacagaaguacccggccauuauaagccguauaguuuuagaguuagagugcagccugggccacauggagcugucacaaacaaaaaagaaaacgaaaaaacuuacuucaccugagggugguuucuggacacacugucuuaugguagcauucuguagcccucagagacuccugugcguaaggggcucgugcccaucuucugucuuccuaguaaccauugucuuuacaaacucuuaaggcaggauccuggcuuccacuauccccccuucaucuaaccacucgggaaccauggagguggcagaggcgaacagccccacggaggaggaggaagaggaggaagaagaaggagaggagacgauaucagagcccaggccucacacucgauccaauccagagggggcugaggaccgggcccugggagcucaagccagugugggcagccgcagcgagggcgagggugaggcagccacugcagauggcggggcagccagugucccaggagccgggccuaagcccuggcaaguaccagcaucagcaucugagguccagauucgaacaccaagggucaacuguccagagaaggugguaugugagggucuuggcuggagauguaggggauggagacccucagacaggccacuccucuaaauugcugccucaguuuucuauagguuccaugaacaucacacacuugguagcuuaaacgucacugaauuuagauucuuguuuuuauuuauuuauuuauuuauuuauuuauuuauuuauuuauuuuuauuuuguggcaccuggacuuccauuugugcuauagccauucccccuccauucuaggcagaggcuccaccccugagcccuuuuugagcucugcuggcuaggacccacccaaucuguaauaacuguaauggcuguagucugguuugguccuguacucucuuucuucucuuuauguuucagaucaucugucuggaucuuucggaggagaugucugugccaaagcuggaguccuuuaauggguacuguggcauugaguuuggacauaggcagcucagaaugcauagggucauuccuccacccaguaggauucagguguucgugacacugacacuuccaaggcuguguccauauguaugacacucuuaggagccaacccuagcuggccucaaggugaugggcuaggccacugucuagcucgugaagcuuuguguguaccccuggcagccugggguaucagguguuacaucuggacuggccuuggcucaggagccaguggcacacacuugccauuauagcgcugauggaggcagagauggaggcaucaggaguucaggguccaccuuugcaaugcagcuugugcucuagaguguguuugaggcuagccuacacuacacagugaguuugaggcuaaccugguguauauugguguucuauauaugagugagacauauuagaguggcucucaggcuguggugcagcugguccuccaaugacugucugccagcggaagacccaacaguccagcaguuguucaguccaugagacuggaugucucagcuucuccuuagcaggcaccauaaucaugaagaaguaggcucugaugccagugaaggagcaaacuugcuaaauagagcagagcaagggcaagcaagcaaagugucccuucucucauguccuucaccuaggcugcaggcagagggcccaggguaaagguggauucuacccacaucagagaucugggcuaaaagugcaucuucccacuucaaaugauuuaauuaagaaaaaaaucccucugggcagugguggcgcacgccuuuaaucccagcacuugggaggcagaggcagguggaucucugaguucaaggccagccuggucuacaaagugaguuucaggacagccagggcuacacagagaaacccugucucgaaaaagaaaaagaaaaagaaaaaaaaaaaaaucccucacaggugugcccagccacuuggguuuuaguuaaugccagauguugucuaguuggcaaccaacacugucacaccuggcuuucggcacccugcugauauuaucugaccucugucaucugaccucccucucagcucuaggacaaacgcccugaaugugucucagaagaugguugagauguuuguucgcacaaagcacaagauugacaagagccacgaauuugcacugguuguagugaaugacgacuccgccuggguaaggggggugggggggaacacagggacucugguggaccucaggacugggacccagcaccaaagucuugacuuucccauagcugucuggccugaccucugacccacgugagcucugcagcugccuguaugaccuggagacggcguccugcuccaccuucaguauccuugucacuguccccagcccuacuucagugacgaugcaguggggccucaguaguacugugggaucccugcaacacacagcccaaguugugcagccaauccccaaaaaauacaaacccgggaaucaguguuuuccuugagaguaacacuacagagcuucagaaccaugccuucaacuccccccuccaacucgccucucucccuucuuccaccuccccccuuucccccccccgccucuccucccugucuccccuuccccugccucucucucauguuuaugagugcuauaucugcauauauguaccagagucaucagguccaaguauagaugguugugaaccuucauaugguugcugagaauugaacucaggacuguggaagagcagucaguguucuuagccacugagccaugucucuagcacugcccuauaauucuuucauuuuuuuuuuaaagauuuuauuuauuuauuuuuuuauauauaugaugaguacgcuguucagagacaccagaagaaggccccagaucccauuacagaugguugugagccaccaugugguugcugggaauugaacucaggaccucuggaagagcagucaaugcucuuaccgcugagccaucucuccagcccaauucuuucauuuucaauauuuauugauugagauaggaucucucucauuauacagcugucuuggaacuuacccuggaccaggcuagcuucaaauucacagagcucaacuugccucugccuuccaagugcugggguuaaagucaugugccaccacccgacaucaaauauguaauuaauauauuuuugagauuauuucuccuguagcugaggcuggucuugaguucacaguguaacuaaggaugaauggccuugagccucuggucugucugcuuccaccuccuacaguguuggcaugaggguguguugagcacacugaguagcuacaugcgugcugagcaagugcucuagugacugagcccaagucccagcaaacugggaucacaaauggaguauuccauguguggcauucuagguggagucacauucaaaacccaccacagggaggugcugggguacaggagugucagcccagagcugaggcaagaggguuagaaguuccaagccagccuuagcuacaaaucuagacucuuucaaaaacaaaaucagcagcaacaacagaaugcugccuguuauauacaaggaugccaaagcccaaagccaaccagaaccaggcucugucgcuggcauccugugugguuggugggacaggugucagcuagugugacugaacauguagcagaugcacucagggagcaugccacuggugagccagugcacccucuuaauggugauguuugccugaaaagucacacgaaugccuuucauccuguuggcccuaacaugcaggaucccuccuccauacccugaccaucugaguuaagaaagcagagaugugggccaggcgugguggcgcacaccuuuaaucccagcacucgggaggcagaggcaggaggauuucugaguuccaggccagccuggucuacaaaaugagguccaggacagccagggcuauacagagaaacccugucucgaaaaaccaaaaaaaaaaaaaaaaaaaaaaaaaaaaaaaacagagauguggcaggacaguggaaccccagagggccuccagggggcuaaggccagcaucccacauuguggugugugaaaggaagcaggcuuagagaggugcagguuggggugaggucacaccucaccuguacucagaggccuguauucagaggugcccaccaucuucccaggucuaggucagggaauccccugccuccaagccagcaccuuguccuuaacauccucccagauuuggaaggccucuucagccucaugugagugcccauccacccacagugggcauggcccugggucccuuccccaccaaggugcugacagcugccuaaggccacccagggggcaagacuucaacaugucuagcagggaagcuugaauuugguuuuuuuuuuuuuuuuuuaaagauuuauuuauucauuauauguaaguacacuguagcugucuucagacacuccagaagagggcaucagaucuuauuaccaaugguugugagccaucaugugguugcugggauuugaacucaggauguucagaagaacagucaauguucuuacccacugaagccaucucuccagcucuuguuuuuguuuuuuuaaagauuuguuuuauugcugggcagugguggcgcaugccuuuaaucccagcacuugagaggcagagguggugaauuucugaguucgaggccagccuggucuacagagugaguuccaggacagccagggcuacacagagaaacccuaucuugggaaaaaaaaaaacaaaacaaaaaggagauuuauuuauuuauuuauuuauuuuacguaaguacacugucgcugucucagacacaccagaagaggacaucagaucccauuacagaugguugugagccaccaugugguugcugggauuugaacucaccucuagaagagcagccaagugcucuuaaccacugagccaucucuccugccccuugaauuucuuuuucuuuugagaauacuuuucauugugcauuuccugugcgugugucaugaugcauguguggaggucaggggucauuugugagaacccccugcuccugcuuccugcccucacagcucaggucuccaggcuuggcugcaggcuccugcagccccauuucccccgcccuggcuucuauuuaacauguagcgccccuaggaucugggccugaggcacuuggcugagaugggggcacuaagucacauacagacccucacguccgcagcucuagcugcugggagggggggucugggucaggguggauugcagcuggguaccgagcccuccccauucuguagccagcagaagaccgagcugccagucacagagaaugugcaaaccaucccaccccccuauguugugcgcaccauccuggucuacagccgcccacccugccagccccaguuuucccugacugagcccaugaaggugagccuggagggaagggagggcagugguuagacaccaaagggucaggauugcagaggcuguggagagaacucacccaccuaccucucauucacugcagaagauguuccagugucccuacuucuucuucgacaucguuuauauccacaauggcacugaggagaaggaagaggauaugagcuggaaggugagaugucaccacagagaauggaggggacaucucgggacaucugacuugggccugccucucccugccauugauccaguccuucagucauuaaccauucccuacauuuccacuuugagcuggugauugggacuugggaggccgcugcucuggcagcccagggagcaggcucagccccgccacaccaucccuagcacuccgcccuauuccugacauuccccagcuguauccuccccucucaaccccucccaaguugucucuucaccuaugaacuugcugugugaucuugaguaggagggaucgaaagucugugaagucgaguuuacaugacugaggcaugggucagauaaaggcacuugcagacaagcugaggaccugaguuuaaaaccaggacuggcaugaugggaggaggggacugacucccaaagacuguacucugaccuccacaccuacuaagcccaggcaggugcacacacugacucuagcccuucaccuugagggaaacaccugaaaggcggaggcugggauugugauaugagggugucccaucugguuuggucucacaguguuugcacagggaggagccuagugcaucugcucaguuuuagggacuugggaagcuguuuggagcuguuuaccuuccugcuucaggggcuuuccuccaggauggacuguuucagucucaggggaaacugauacacaagaggcuagccuggguuacagaaacaccaacccagagaagaguccuccuguggggagcugcccuuggccucccuucuggcucuggcuugaagcagggucucugguuguaccccagcugcccugguuggucucuggcuucaggauccuuccauccugcauugggagugccucuggcuuaaaugugcccugcugcauugagcuuucugagguaguuuuguguccacugagcugccuccaagccacacacugcgcuuauagaaugcugggaacuguugcugacugcaauaguuuguggccacucuagaugucacuuccucugggaaggccuccagggacagggagggccuguaaggacuaaugaucauccugaacagcccgcagugccucccacacugaugaucacccuaaccaguccgcacugccuccacaggacauguuugccuucauggguagccuggacaccaagggcgccagcuacaaguaugagguagcacuugcugguccugcccuggagcugcacaauugcauggccaaguugcuggcccacccgcugcaaagacccugccagacccacgcgagcuacagccugcuggaggaggacgaggaggcuggagaagaggaagccacugugugaacuaugacaugugacaucuccgcacccuccuaugaggagagcgcaggcacacuauuauuggcccaugcucaaucccacucuguccacuguaaauucauucuuccugggacuauuuuugucaccggaauaaaaaucugaggucccugagcccacccuuggugucacuuugggcucacugagaccuguuauuaaugucacagaaaacaggcacuaaacaaagcagugguguauggcuucaggcucagcuguauccgaguaacccacaggcugguguucacugcgcuuuccaaacuccucuucauccuacagaacccacuccagauguucuuuuauccagaaaguccuccagaaacagggaagaucuauugaaaguggaacugguauggcugucauauuugggaccuccuagauacacaaaagucccagcuccaagugggaaguggguucugaugacaccugucacccccaaucucaguauccugaucugauugaacuuguguagccauguggucucgccaugagcaau

SEQ ID NO: 4507 - RNA, 4538 nt, Mus musculus
ugcagagggcggugacuccuaugggacauggccgauacugcaugcuuggcucugaggcugcuagcagcacuacgcgaggaggaggcgcggugagggcggccggguccgggugcuacccgaccuucugcuccccggguggucaggaggucugaggucuacugugcucguccuccugcagggcuguggaggagcugcugcgccucggagcggaccccaaccugguguuggacgauggcgcugcggcggugcaccuggcagccagagcgagccacccgcgcgcccugcauugccuucggaugcugcugcgcuggggagcggaucccaaugcucggugaggcgcggcccgggucccugggugcgguaggcgugacuugggacagcggcacuggacgucaggcuccggguccgaggcgucagucaggucuaagauggaaaugucugcuuccaaggucggguacaaggugucccauaacugucaucuggcacucugggagacugaggcaagaggaugaccgugaauuagagucucacaugguagugggcaccggucaucccagcacggggaacugaggcaggaggagcaggaguucauggcuagccugggcuaugcgagacugccuaggaaaggaaccaacgccgcacaccucuccucugucuuuggggaucccagguccgcggaggggcugacgccugugcauguggcugccgcguggggcuguuguggugcucuggaguugcugcugagccgaggaggugaccccacacugcgggaccaggucaguaccccgcgcaggcacacauggguggcaggaggguggguuaaggacgcccccugcugacggugacugcacaggaugggcucaggcccuuggacugggcacuacagcagcgacaccacaacugcgcacgagugcugcaggagcuggacacgcccacccagccugaugagacccgagaacccacaggugagaggaacugaggggguguaccgggcuaccacacugcccggcccaguucuguuuguacaucuaucgugucaaucacuauccauggucuaucuuaucggucacauaacuaucaugccaauuaccuaccugucagucaucucgcaccuauaucauuuaucaugucuauaucauaccuguuuauaucuguguuauaucugauuacuuauuuauccauacauuuauacaucuauaugcagagacguuucauguagcccaggguagcuuugaaacugaaacaugccaaggaccugccuuagcagagucuucuggaguuucucaagauucggaguugcacgugcauagagcugagcuggagguggaggcuguagagguggcugugcauccccagagcucugaggccaccgagaacucagacuacagcagcgaugcuucguuugucacugcaguggaggacucucugcagcccgggcgcccugggggggcauuggagcuaguggcuggcuuguggguaacccguggggcugugucagcugggaagggagcacccaacugccagccgcagguccugacauugacugcaagggacacggacaaacccguacugccuggugauggggaucugggggcuuugcacccccacaguucggugccccccaugucggaucugcagcuccuccaggcccugcgggcgcugggcuauagcccuggacccgucacaccuuucaccagaggacacuaucuacggcggcugcaggaagcccaggcuagccguggugaguccuuagguggugguauucagagucuggcuacacuccaggaauccugccuuggcuguuagauaaaccacccucaccagcuuuuguccuccacccugaauccguuuccccuccccagcugauguagggcauagccaagaacuggcggaggcacuaaggacaggcaccaucccugacugccagguggaugaggaagcccuggcucagugcuuucagcggcuggaucccuugaagaaguggcgggaaggcauuacaaagucuaguuuuacguaucuacuucucgaccccagguauggugacagaaaagccaggggcugaaauuagaggaugacugugcagagcaaaacuccgcucugcaaguuccuuucugguuggguaggggaagggcuaccccuugcugauaguuucugccuccaucucaugguuuauaagaucagacugugaucucaggucaggguuguaacaucaaacucaaaacaacaaaacaaaaaacccccaacaaacaguaggaauuugcucuugauucacuguguguaccuagggaagggauuagucuucucuguuugccaccuccuuuagaaauggugucuggggccgggcagugguggcgcaugccuuuaaucccagcacuugggaggcagaggcaggcagauuucugaguucgaggccagccuggugucuggggucaguucuagcugugaguacccauuuuaugguguccuggaaguggguacaguggccauucucccugucugccaucaucaccccuccuuuucacacuguauguucugugcaugugacugugugcaugugcucacacacuguggugcucauguagaggucagaggacagcucguggaagucuguucucuucugucaugugggucccacaugggcuacucuguaccccaggcugacgaaggaccugccggcccgagccucuucccucacacuggcugagugucugcaauguuucgugagagccaucuucuaugugggcaagggaacccgagcccgaccagaugcccaccucugggaagccuuuggcuaccaugaccagccaaggaaacagguggggcaugagagacaggguuggggugcaucagccacccuucaggccugggaggaagauagcuuaggaucccagcugauccucuacuaucccccaggucugucccaagguucgccggaucuuagacaucugggcuaguggccggggcaucaucucucugcacugcuuccagcaugugguggccauggaagcguacacucgggaagccugucuguuggaugcccuagguaggggucuggcuuguagaggucacaugaaagguauccgagcuaugaaucccuuugcucucucccucgcuguccacucaugaacucauucacauguacaguuaccaaguaccaaaugugcuguuggauuggguggggcggaggucacuccuguuaccucaccucuuuugaccaggucuccagacacugaccaaccagaaacaagggcacuacuauggagugguugcccauuggccacccucucggcgucggcguuugggggugcaccugcuacagcgugcucugcuggucuuccuggcugagggggagagagagcugaggccucaggacauucaggcucgaggcugaaugcugaggaugugacaugaauccugagccaucaaggugucugagcaucuggcugguuccuaacuguucccagcucuagcuucagaggacaguguguuuucuuguguguguguguguguguguguguguguguguguguguguguguguguguguauguguguaugugugugugcgugcgcgcgugugugugcguguauguguguguuuuuaaauaugugacaguauuucuuaaucaagcugagugaacauugggauacauggugcuucuggaagaguagugagcuccccaucacgggaggaaaacaagccaaggagcagaagcuauucuggagcaccaccuuuaaucccagcauucaggaggcaauagcagacagagcucugugaguucaaggacagccugguuuauagaaaugaguuccagugcagccaggggauauacagagaaaccaugucccccaaaacaaaccaaaaaacaacaacaaagccaagaugguacucuggaaugcuacuuugucuccaugucucaucuucugaugcaaggaagagcucaagagagauaauccaggugcacugguagugaugguucaucaucccugccuuugggaagcugaggcaggaggauugcuaguuggaggccagccugggcaccucagaaugggaauugacauuuauguuaguggugacaguccuuuuccccauggcuauccauacuccagacagccugggauccccacugugcuccuaggagcgcaucuuagaucaaacagcacugaagaguuccaaacugacuguggggaaguggugggagagugcacacucacaugucgcuaguguccuugcacaccgacuguggugggagagugcacacucacaugucgcuaguguccuugcacacugacuguaguggaagagugcacacucacaugucgcuaguguccuugcacaccgacuguggugggagagugcacacucacaugucgcuaagugucccugcacacugacuguaguggaagagugcacacucacaugucgcuaguguccuugcacaccgacuguggugggagagugcacacucacaugucacuagugucccugcacugucuuuugaaagaugaaucauuuaauauaguguaaguagugcauua

SEQ ID NO: 4508 - RNA, 1547 nt, Mus musculus
ugcagguuucucuuucuuccacucuuucaacugagaugaagagaggaagccccacaaguuucaaagccuucaaagccuaacccgguuagagcgacccucucagcaggugguccagcccgugggcagccaugcagugcuccugaccccacaguccccaccccagcuugucucugcaccucccccgcucaaagcuuauuuguccagggcugcuguuucuguggaacccaaaacccgggcugcuguuuccuguggaacccaaaacccgucaagccaggauuccccgacuccaacuggaugggcacggccuuguagaggcagguaugccaacucccugugggcgugggucuguuaggucaaaaguugugugucucuggguagcaggccuuaaauuuggugugguauguagaaggaagcaugguuuucguguguguguguguguguguguguguguguauaugagugugggcauggguguggcccuggaugaguauguuuccugugggcguggcaucuagccuuugccuaagcaucuaggcacuuuggagagggacuguucuuucucaguggggcuuccagguagguguggcccaagacaagugggcagccuucuaggugagggcagagcuucccuggcauccuguggaggauguagggacccaacaaggcugcccagcacccuacaacacagaugaugcccucauaguaaugacccaaccccaagugucagcagagccaagguuaagaaguucugaucaucuuguaggcauugacugagugagggaauaccuuaugagcgugacagaccauccuaggcauccuccugggugggacugaaggguagacagcaaguaggacuugccaguguggcuacagauccugaugagcauuuccuugaaggucaagggagagcaugugucgagacuuuagggacuguauaauuauucaaaugaccucauaucuugcuucaauccugacauagcauuguaaugguuaggcuaagaaucuccugacguuugugaaaacaauucuuuuuuuuuuuuuuuuuuugguuuuucgagacagggcuucucuguauagcccuggcuguccuggaacucacucuauagaccaggcuggccucgaacucagaaauccaccugccucugccucccgagugcugggauuaaaggcgugcgccaccacgcccagcgugaaaacaauucuuagcacucauucugucuugucaauaaaugcugaucauccagaggcuggguagaagagagaauagaacagggguugcaggggaaggggaggcucagaucaguaaggaagagucuaagaagacacaccaugggaaaaacaucuggggcuggagagauggcucagaaguuaagaggacugacucuugaccucuuccagagguccugaguucaauucccagcaacuacauggugacucacaaccaucuguaaugggaucugaugccugcuucugguacauggagauagagcauuguauauacauaauaaauaaauuaaaaacaaaaccaaaccaaaaaaaaaaaauca

SEQ ID NO: 4509 - RNA, 6971 nt, Mus musculus
ggccaguuuggauugucuuuuuuauuauuauuauuuuauugacuuacaaguugccauaugcggggauuuguggcuccgaccccucccuccuugggugccuagcucccagucccaagcaauggggauggcgcgguagggucucccaggacaggauaggagcccuuccccaggauucuccuuagggcuucccagugcggaauggagcacagcggaggggaagaccgagugggauggcagcccgcgcgcugcagcuucagggacucggggaggcagggagggggcucuguacaaggucacacccuucggucgcgcguggaaagggcaccauagcugcccugggcacugagucuccaacacugacugugccugguucgcucuggggcaugcccaggccccgcccaucggcaugaggccccgcccagccagcccacgcccagucuaagagccucuacuacucaagauccaggagucccugcgccgcuggucacuucuccuccccuggagccggcucuggcugcagcagcuguggcuugggcuuuggcucgagcuuuggcucagccucggguucuggcucccacagcaggaacucguguaacagcguguugaccguuucaggacacuccagcaucaccauguggcugccuuccucgaugagcuugagaaaggccagcagcaggaucuacgggcacaccgagaaguuccuccuguuguuuacccuucagccccacccaagaggaugccagggaugaccugucacccuucuggacccucuccagguauucuuaacucagccaacacccauuaagcgccuuauaauaugcccgggguuggacuucucaaccucggcucugcugacucuugggguuggcucguugcuugggagcaucagcuguguuguagggugcugggcagccuccuuggucaaccucaggaguggaugcuagggaaguucucugcccuccuccccugcccacgaaugauucuagaugucuucaagauuugcccuuggugagcaugcuccugccuuuccugaacaguccuaagaaucacaaagccacagccauucagauaucuuacccaaaggaagcuacaugucaaagccugccacucaaagaccccgcccacccagagcugucagaaagccacacccaccgggaaaguucacacccacccagccuugcccccacuggcuccuuucuggaaaaccaagcuuucccacaggccaagccuacucagaacccaugcuggcaggauggaccacauacaccccuaagucacgcccaggcacaggcacaaggaguguguaucgggagugguguucuagagccacagauccuaccucagccaugcguugguccucuuccacuggcacaaauuugucgugcaugccgugcacuagcagcacggguaccgucagcuccgcgugguagaccucgucgccuucaggccaauacuggccacucaucauggcccgcagcacgaaggaggacacauugaacgcauugcccuccuucagcagcugcuuuucuuuggccccuuggcgggcaaagccggcccugggaugcgaagaugucauuugagccugaccacuaugggacacaccccagagccagccccuacagaucaguaaugcaaggucaccccuccccaugcccagaucccagggccagagaucuuacuugaggaaacuccaggccaggcaaggugacaggcagugcaggacacaugugggcauguugaagauggagcauaggcugggcuccagugccguggggcccccaccguugaucaugaucacuuuguguacaagaucuggguacucgugggccaggaaaguacagaaggagacacugggggcagggauggaagaauccgaguaagcaggacacagacagugcuuuccucccacccugaucacuaggcaggcccucagacaacaauuuccuguguacucauggaggggaacccagcuggcugaccgaggggugucccuccaggagcaggugugcagugcugaggauggagggagggagcccguggcuuuguucacacugggcaugcccggcccuuuggucuugaggcaagcucuuagcaagcccaugacagccucugcauagccagagcucauauccacccucaagugcuaggguuacagcauacacacccuguaaguuuugggguaguucuuguuagaaagaggaucucucgcuuuagcuuugaccagcuuggaaauugcuguguagaucaggcuggacuagaacuuccagagaugugccugccucccagguaugcuucugugugacuucuggcauggcugugaccacuaacacggugaccuuggcugucuuguuacuuugcugugugggaaugugcucccuugaguggaugcuugguaaccugcagacagcacugucccaucugagacucaccuaugguggccauaccuuucuaaacaguaucuagggagugcuauccacccuuauggcggcagcuagacucuggaaucuccucagggguucuccacugggagugcuuccgcccagcaucugaagacaggacgucauggcugccuuugugggcacggaaggcacucauggcuacaaucccuuagaagauguacucacuggguaccagguaacuacacagagaacuaccuacccccucccccuuucuaaaacagucucacucacucaauguauaguccucgcuggaauggacuucauggaaauccuccugccccaguucccggagcacuggauuuacaggcauguccaaccccauguggcuuuuauuuuuguuuuuguuaagacaccaagucucagugcucugcuguccaagcugaccuugaaauuccagggucaggggcuugcccugcucaccuacaucaccugguuaauagcuugaaggcuccaaauagaagggguggaagaggaaugggccugaccauuagaccacaccccccacacacacacauuacacacacauacauccacacacacacacauacacacacacagaguauguaauguugucccacaguaacccauagguuggcugauuauuacauguuuguaaaaaauaaacauuuuuucagacaggcuguguuauauagcccaggacaagcuugagagcauagcaaugaaugccccugccucacucucugaagugcugaaauuacaggcaugaccuaccaucaccagcuuuuaaaauuuacuuuuuaggcugggcauggcagcccacaccuuuuaucccaucacucaggaagcagaggcagguggaucgcugugaguucuaggucaccaugugaguuccaggacagccagggcuauguagacagaccugucuuaaaaguaaaaacaaccugccugaucuacagagugagcuccaggucagccagggcuacacagagaaacccugucucgaaaaacaaaacauaaucccaguacuugggaggcagaggcaggcggauuucugaguucaaggccagccuggucuacaaagugaguuccaggacagccagggcuacacagagaaacccugucuugaaaaaccgaaaaaaaaaaaaaguaaaaacaaaaacaaaauuaauuuuaaauguuuaaggauagaaaauauucuguuuauugacuuuuuuuuugagaugcaagggauugaagccaggccuugugcauaccagguacacaucucuacccccgagagauuucccagcuucgguguugagggauguggguccucauguauguuaaacuugucugggagcuguguagcugagagugaccauuacaucugauucugucucugccucccaaggguggggcgguagaugagggcugccaugccuggcuuucaaugcuguuuauugauuuuugagacaaagucucauccuauagcucugacuggucuuaaauucauagcaauccuccugccuuggucuuggaaguucugggguaucaugcccauacccuguaguuuguuuuuugguuguugcuguaguuguuguaguuguuguuguuuuuaacauagguuuuugcuauaaguguagcccugguuuggaaacgacuucauagccggggcccgccuuacauuuugagcuaucuuccaaugucagccuccuaaguauggugaugacacacuugcuaccacaggugaccagauacuaaugacuaggucagagcucuagugucaagcuacucccagccccucacugaaggauucuaggcagggcuccacacugagccacgccuccuguccuucacuaaaggauucuaggcaagguuucacccugacuaugccuccagcucccucaguggggcuuugagccacacgcccagcccaaucucauuuuccaaguaaagaaguuguugcgugggguagcauagaaggcuuuuauucuagucuuugggauguaaaugcaggaggaccagguguucaaguucagccucagcuacauaaugauuuuugaggcuagccugggguacacaaagcccugucucaaccuagcuccagggggaagggaaugguuugugagcaucccacucggaucuuacccguaagaauggccgaugagcacauugcgcuucuuggcauagcgugugaagauggcccucauauccucugccaaugcguaaaagguguaggcagcugccaccugcggcgcagagcuggcuccauggcccgccaggucaggugccaccaccucauagccgagucgcacaaagaagucuagcugcuccuuccagauggcgagugagccaccgacuccgugaaugaagaacagcaccacaucagccugcgcacccuugcagcuggugaugcgcugcucacagucgauguggaugguccucuucggacgccgugggcggcgccgucgcccgcugccuggguuggcccgggugucuccuccugcgggcucagccagcucaaccucgagugcagcaggcggguccccggagccacugcggccuugcaggucggcacgaggcgcucggcccagguucuccaccaccagccucccguugcgguacacugugauacggcgcuggcagcgcacaaggcccgucuugaccccuggaucaucuucaggagguggugguggcggcguggggaugggcgcgggccccgcaugcuuuacccgcagcacccggccuggcuugaccuccacgaauguguagccgucacuggacucgacacucuccaguggccgcacggcguuagggggaguccccagcaggcagcagaaaaagccaucugucaccccagucagcaugguguguucuggagagaggaacaguggcuagcucaguguugguggcucuggucuugcaucggguaagcaggaccuggaagccccuuccagguuuccccagacaccccaaugccagacaaguucucagggugucccuuaguacaauacugaagagagcaugggggaggggggcuuccagaaggagaaaacauuaaagcaagagcccauugcaaggagacccuugccccaccagcuggaguuuaucauuuauucacaaauccguaucuuuauguacaaauucauccacacacugauuuaugcaagcauggaugcaagcugguuugcaugcuuacuuuugagaaagaaacucauguagcccaggcuggcuuggaaauccucaugcugcccagacugaccuugcucugccuuccaccuccggaguuguagcagguugagcauacagguguuccuaagaccaaagggaaccucgaacucccacaguccuccugccucuaccuucccaaguguuggggugacagaugugcaucaacaugaugccauugguuuguuuuugaaacaaggucucauucugucguccugggcuguacacuggucucaaacuccuugcaauccuccugccuccaccucugccaguacuagaaugacuagugugaaccccgaucacugccaaccuuuuacacgggguuucauucuguaguccaugcuggccucaaccuugugcccaagcuccuggguggugagaugacagcccauaaagccuggcucuuauucuaaaaugucaaaguucuuagcucaggccucuaguguuaaucugacuagugacgaaugaggcgggggaaggauguuggccacuagaacucggguuguauccggcuccagguucagaagagagcuagagcugacuugcacaguaucgagaacugauggagguugcugcccucagcauccuguguucaaaggguacacaacccuaguggcagccaggaagauaaaggcagaaccugacugggggcucugggccuccauccgguucccuuggccaccccccccgguguccaugacaaccacaggcgguuacauaacuccaggggauaccggagcagcacacccccauugucugaggcauagggauggggccagcuucguuuuuccaucacggccugggcgccgcuggagugauggucauuaaauaccccgcucgugauagccccggaugcacuugaggggaaagcaggccuugcuccucauuucuaaggcuguggaaccccgacuguggcggcuucucuaaagcgcagcgccaguccuguuucccagcccgacccgcuuuucccuggaguucgucacccccgcgguggggucaaggcuaccgggguuccgcagcauccuagcaguacgaaugcggagcuuggcgguuauccacccccggcagcgacaccccccaccccucaguggaggccuggcagccuggugacuccucucucggggaacagagccagcucaccugaggucaucgaggggcccggggcccgaggcaggacgcaggggucccgggcggagaagccagcguccaccugcaggugccgcuuacaugguggugcgggguuggccgcauuagcgcggacaggcgcgggcccggacggucaacgcaggggcaucccgcagccgcguagcaaaccggcccuguaagucccacccagcgugggcg

SEQ ID NO: 4510 - RNA, 6971 nt, Mus musculus
cgcccacgcugggugggacuuacagggccgguuugcuacgcggcugcgggaugccccugcguugaccguccgggcccgcgccuguccgcgcuaaugcggccaaccccgcaccaccauguaagcggcaccugcagguggacgcuggcuucuccgcccgggaccccugcguccugccucgggccccgggccccucgaugaccucaggugagcuggcucuguuccccgagagaggagucaccaggcugccaggccuccacugagggguggggggugucgcugccggggguggauaaccgccaagcuccgcauucguacugcuaggaugcugcggaaccccgguagccuugaccccaccgcgggggugacgaacuccagggaaaagcgggucgggcugggaaacaggacuggcgcugcgcuuuagagaagccgccacagucgggguuccacagccuuagaaaugaggagcaaggccugcuuuccccucaagugcauccggggcuaucacgagcgggguauuuaaugaccaucacuccagcggcgcccaggccgugauggaaaaacgaagcuggccccaucccuaugccucagacaaugggggugugcugcuccgguauccccuggaguuauguaaccgccugugguugucauggacaccgggggggguggccaagggaaccggauggaggcccagagcccccagucagguucugccuuuaucuuccuggcugccacuaggguuguguacccuuugaacacaggaugcugagggcagcaaccuccaucaguucucgauacugugcaagucagcucuagcucucuucugaaccuggagccggauacaacccgaguucuaguggccaacauccuucccccgccucauucgucacuagucagauuaacacuagaggccugagcuaagaacuuugacauuuuagaauaagagccaggcuuuaugggcugucaucucaccacccaggagcuugggcacaagguugaggccagcauggacuacagaaugaaaccccguguaaaagguuggcagugaucgggguucacacuagucauucuaguacuggcagagguggaggcaggaggauugcaaggaguuugagaccaguguacagcccaggacgacagaaugagaccuuguuucaaaaacaaaccaauggcaucauguugaugcacaucugucaccccaacacuugggaagguagaggcaggaggacugugggaguucgagguucccuuuggucuuaggaacaccuguaugcucaaccugcuacaacuccggagguggaaggcagagcaaggucagucugggcagcaugaggauuuccaagccagccugggcuacaugaguuucuuucucaaaaguaagcaugcaaaccagcuugcauccaugcuugcauaaaucaguguguggaugaauuuguacauaaagauacggauuugugaauaaaugauaaacuccagcugguggggcaagggucuccuugcaaugggcucuugcuuuaauguuuucuccuucuggaagccccccucccccaugcucucuucaguauuguacuaagggacacccugagaacuugucuggcauuggggugucuggggaaaccuggaaggggcuuccagguccugcuuacccgaugcaagaccagagccaccaacacugagcuagccacuguuccucucuccagaacacaccaugcugacuggggugacagauggcuuuuucugcugccugcuggggacucccccuaacgccgugcggccacuggagagugucgaguccagugacggcuacacauucguggaggucaagccaggccgggugcugcggguaaagcaugcggggcccgcgcccauccccacgccgccaccaccaccuccugaagaugauccaggggucaagacgggccuugugcgcugccagcgccguaucacaguguaccgcaacgggaggcuggugguggagaaccugggccgagcgccucgugccgaccugcaaggccgcaguggcuccggggacccgccugcugcacucgagguugagcuggcugagcccgcaggaggagacacccgggccaacccaggcagcgggcgacggcgccgcccacggcguccgaagaggaccauccacaucgacugugagcagcgcaucaccagcugcaagggugcgcaggcugauguggugcuguucuucauucacggagucgguggcucacucgccaucuggaaggagcagcuagacuucuuugugcgacucggcuaugaggugguggcaccugaccuggcgggccauggagccagcucugcgccgcagguggcagcugccuacaccuuuuacgcauuggcagaggauaugagggccaucuucacacgcuaugccaagaagcgcaaugugcucaucggccauucuuacggguaagauccgagugggaugcucacaaaccauucccuucccccuggagcuagguugagacagggcuuuguguaccccaggcuagccucaaaaaucauuauguagcugaggcugaacuugaacaccugguccuccugcauuuacaucccaaagacuagaauaaaagccuucuaugcuaccccacgcaacaacuucuuuacuuggaaaaugagauugggcugggcguguggcucaaagccccacugagggagcuggaggcauagucagggugaaaccuugccuagaauccuuuagugaaggacaggaggcguggcucaguguggagcccugccuagaauccuucagugaggggcugggaguagcuugacacuagagcucugaccuagucauuaguaucuggucaccugugguagcaagugugucaucaccauacuuaggaggcugacauuggaagauagcucaaaauguaaggcgggccccggcuaugaagucguuuccaaaccagggcuacacuuauagcaaaaaccuauguuaaaaacaacaacaacuacaacaacuacagcaacaaccaaaaaacaaacuacaggguaugggcaugauaccccagaacuuccaagaccaaggcaggaggauugcuaugaauuuaagaccagucagagcuauaggaugagacuuugucucaaaaaucaauaaacagcauugaaagccaggcauggcagcccucaucuaccgccccacccuugggaggcagagacagaaucagauguaauggucacucucagcuacacagcucccagacaaguuuaacauacaugaggacccacaucccucaacaccgaagcugggaaaucucucggggguagagauguguaccugguaugcacaaggccuggcuucaaucccuugcaucucaaaaaaaaagucaauaaacagaauauuuucuauccuuaaacauuuaaaauuaauuuuguuuuuguuuuuacuuuuuuuuuuuuucgguuuuucaagacaggguuucucuguguagcccuggcuguccuggaacucacuuuguagaccaggcuggccuugaacucagaaauccgccugccucugccucccaaguacugggauuauguuuuguuuuucgagacaggguuucucuguguagcccuggcugaccuggagcucacucuguagaucaggcagguuguuuuuacuuuuaagacaggucugucuacauagcccuggcuguccuggaacucacauggugaccuagaacucacagcgauccaccugccucugcuuccugagugaugggauaaaaggugugggcugccaugcccagccuaaaaaguaaauuuuaaaagcuggugaugguaggucaugccuguaauuucagcacuucagagagugaggcaggggcauucauugcuaugcucucaagcuuguccugggcuauauaacacagccugucugaaaaaauguuuauuuuuuacaaacauguaauaaucagccaaccuauggguuacugugggacaacauuacauacucuguguguguguauguguguguguguggauguauguguguguaaugugugugugugggggguguggucuaauggucaggcccauuccucuuccaccccuucuauuuggagccuucaagcuauuaaccaggugauguaggugagcagggcaagccccugacccuggaauuucaaggucagcuuggacagcagagcacugagacuuggugucuuaacaaaaacaaaaauaaaagccacaugggguuggacaugccuguaaauccagugcuccgggaacuggggcaggaggauuuccaugaaguccauuccagcgaggacuauacauugagugagugagacuguuuuagaaagggggaggggguagguaguucucuguguaguuaccugguacccagugaguacaucuucuaagggauuguagccaugagugccuuccgugcccacaaaggcagccaugacguccugucuucagaugcugggcggaagcacucccaguggagaaccccugaggagauuccagagucuagcugccgccauaaggguggauagcacucccuagauacuguuuagaaagguauggccaccauaggugagucucagaugggacagugcugucugcagguuaccaagcauccacucaagggagcacauucccacacagcaaaguaacaagacagccaaggucaccguguuaguggucacagccaugccagaagucacacagaagcauaccugggaggcaggcacaucucuggaaguucuaguccagccugaucuacacagcaauuuccaagcuggucaaagcuaaagcgagagauccucuuucuaacaagaacuaccccaaaacuuacaggguguguaugcuguaacccuagcacuugaggguggauaugagcucuggcuaugcagaggcugucaugggcuugcuaagagcuugccucaagaccaaagggccgggcaugcccagugugaacaaagccacgggcucccucccuccauccucagcacugcacaccugcuccuggagggacaccccucggucagccagcuggguuccccuccaugaguacacaggaaauuguugucugagggccugccuagugaucagggugggaggaaagcacugucuguguccugcuuacucggauucuuccaucccugcccccagugucuccuucuguacuuuccuggcccacgaguacccagaucuuguacacaaagugaucaugaucaacggugggggccccacggcacuggagcccagccuaugcuccaucuucaacaugcccacauguguccugcacugccugucaccuugccuggccuggaguuuccucaaguaagaucucuggcccugggaucugggcauggggaggggugaccuugcauuacugaucuguaggggcuggcucuggggugugucccauaguggucaggcucaaaugacaucuucgcaucccagggccggcuuugcccgccaaggggccaaagaaaagcagcugcugaaggagggcaaugcguucaauguguccuccuucgugcugcgggccaugaugaguggccaguauuggccugaaggcgacgaggucuaccacgcggagcugacgguacccgugcugcuagugcacggcaugcacgacaaauuugugccaguggaagaggaccaacgcauggcugagguaggaucuguggcucuagaacaccacucccgauacacacuccuugugccugugccugggcgugacuuagggguguaugugguccauccugccagcauggguucugaguaggcuuggccugugggaaagcuugguuuuccagaaaggagccagugggggcaaggcugggugggugugaacuuucccgguggguguggcuuucugacagcucugggugggcggggucuuugaguggcaggcuuugacauguagcuuccuuuggguaagauaucugaauggcuguggcuuugugauucuuaggacuguucaggaaaggcaggagcaugcucaccaagggcaaaucuugaagacaucuagaaucauucgugggcaggggaggagggcagagaacuucccuagcauccacuccugagguugaccaaggaggcugcccagcacccuacaacacagcugaugcucccaagcaacgagccaaccccaagagucagcagagccgagguugagaaguccaaccccgggcauauuauaaggcgcuuaauggguguuggcugaguuaagaauaccuggagaggguccagaagggugacaggucaucccuggcauccucuuggguggggcugaaggguaaacaacaggaggaacuucucggugugcccguagauccugcugcuggccuuucucaagcucaucgaggaaggcagccacauggugaugcuggaguguccugaaacggucaacacgcuguuacacgaguuccugcugugggagccagaacccgaggcugagccaaagcucgagccaaagcccaagccacagcugcugcagccagagccggcuccaggggaggagaagugaccagcggcgcagggacuccuggaucuugaguaguagaggcucuuagacugggcgugggcuggcugggcggggccucaugccgaugggcggggccugggcaugccccagagcgaaccaggcacagucaguguuggagacucagugcccagggcagcuauggugcccuuuccacgcgcgaccgaagggugugaccuuguacagagcccccucccugccuccccgagucccugaagcugcagcgcgcgggcugccaucccacucggucuuccccuccgcugugcuccauuccgcacugggaagcccuaaggagaauccuggggaagggcuccuauccuguccugggagacccuaccgcgccauccccauugcuugggacugggagcuaggcacccaaggagggaggggucggagccacaaauccccgcauauggcaacuuguaagucaauaaaauaauaauaauaaaaaagacaauccaaacuggcc

SEQ ID NO: 4511 - RNA, 843 nt, Mus musculus
cagaaggcauugucaaggagcccagaguguaggaacuggcauugacccggacgaccggaccauugacccgccgcuggauauggcuuuccuagcccggugcuuugggugccaggccugcagaucgguggcccuauugaguggcaggugaguguucagagauacccugcuccagaauggaaacaaggguggucucuauagacuaccaugcguacuuauguagcgccuuuuguaaacaagcucuuuuguugcccugcccauuacaaaggcggcucagaaagucauacagcguacauucucugagauucacgguuccucuggucccacagguaucuccaguccagagucuggauggggcucccggacuccuggccucuccucucccugcagcaggcucgcggccgcgcgcgcggaaacgaguaucagccgagcaacaucaagcgcaagcacaagcacggcuggguccgucggcugagcacgccugccggcgugcaggucauccuccgucgcaugcugaagggccgcaagucccugagccacugaggagcgcaacgucgcagggaauagacucagacgccgguagaguugcccgagggcgagaaguuggggcaagcugaaagugggggucugucccuucguagguuuuuagacgcaucccccgucgacggcugcuuaccaaccaccagcaccugcgauaccucauccauuucugugaauauauuugaaggcaucuuugcaagacggggucauuaaaacacagacaccaccccuacguuuccagccauuccaaaguauuaccgacuuaauaaauauucacguuucuugaaccacuacguauguauuaac

SEQ ID NO: 4512 - RNA, 843 nt, Mus musculus
guuaauacauacguagugguucaagaaacgugaauauuuauuaagucgguaauacuuuggaauggcuggaaacguagggguggugucuguguuuuaaugaccccgucuugcaaagaugccuucaaauauauucacagaaauggaugagguaucgcaggugcuggugguugguaagcagccgucgacgggggaugcgucuaaaaaccuacgaagggacagacccccacuuucagcuugccccaacuucucgcccucgggcaacucuaccggcgucugagucuauucccugcgacguugcgcuccucaguggcucagggacuugcggcccuucagcaugcgacggaggaugaccugcacgccggcaggcgugcucagccgacggacccagccgugcuugugcuugcgcuugauguugcucggcugauacucguuuccgcgcgcgcggccgcgagccugcugcagggagaggagaggccaggaguccgggagccccauccagacucuggacuggagauaccugugggaccagaggaaccgugaaucucagagaauguacgcuguaugacuuucugagccgccuuuguaaugggcagggcaacaaaagagcuuguuuacaaaaggcgcuacauaaguacgcaugguagucuauagagaccacccuuguuuccauucuggagcaggguaucucugaacacucaccugccacucaauagggccaccgaucugcaggccuggcacccaaagcaccgggcuaggaaagccauauccagcggcgggucaaugguccggucguccgggucaaugccaguuccuacacucugggcuccuugacaaugccuucug

SEQ ID NO: 4513 - RNA, 1178 nt, Mus musculus
ggcccaagguuuuaguccuaccucagggguccaaauuccaggucccucaggcuuccccccuauguuguaguuacccccuauccaaucccuccugcagacccaguccuuucuuccagcuggggcacacaccuuuaaucccagcauucagaauuugagaccagccuggacuacacagagaaaccuugucucaaagaaaagaaaaugucccacaggcuugccuacaacccaaucuuauggaaggauuuucuuaauugaugcucccuccuccaaggacucuagcuuguaucaaguugacauaaaaaauuauccaagagagucucagugagugaacuguuuauggugcaagcuugaagaccugaguuuauauccccauacucacaaaaggccagacauaucaguggcccaagcacuugggaaucagugguaggcagauccugggggcuugcuagccaaccagucuagccaaaaugguccaauuccagguucagugagagacccugucauaaaauauaaaugaaggggcugaggcuaugccucuggcagaacaguuggccagcauggaacaacccaaguuccauaccuagcaccccacacaccccggugaagcacacuugagauuccagggucucagaggcaggaugaucagaacaaaucauucuuagcaacauagcaagguaaggccaaccuggacuucaugaauuccuauuucuaagugaacgagggccagugggauagcucagcaugaaaaggcacuugccagucaagucuggugaccugaguugauacuggaacccaugugaagguggguaagagggguccucugcccccuacacauucaucacacacaacaacacaguguaaugaacaggccagucagugagguggggagccauagaagaagacagcacaauggaagccuuagcuucaugccacacagcgcuaguucagaacccauguaugaaaaguaaaguuuaaaagcugagugucagggggcuggugagauggcucaguggguaagagcacccaacugcucuuccgaaggucuggaguucaaaucccagcaaccacaugguggcucacaaccaucuguaacaagaucugacgcccucuucuggugugucugaagacagcuacaguguacuuacauauaauaaauaaaucuuaaaaaaaaaaaaaag

SEQ ID NO: 4514 - RNA, 14476 nt, Mus musculus
ccgcgcugagacuaggaagaagaauugagguuuggcuugggcggggacgacaagcaaguggagcgcagggacggcgggcugcgcgggcgggcgagagaggccuuugucuccuccuccggcgcgcucgguggugccacuccgguccucaugagcccguggccccccagcgcccgggcgucccgcggccccuaaccugcccuguccucgccauggccgaggcggcuucgggcgccggggacgugacccuggagggggagcggggcaagaggcccccucccgagggcgagccugcggcgccugcgucuggaguacuggguauguuugcugcggguggcaccgagacagguguacagggugcaggcaggggcugcaggagacgccguucagggucacacacccuagcguguggcccagaggcugcuccucguagugcugcagcugcggcgcagggcgcgggguuggucaaugggucugcaccggggguccccagugcaggaacguggacacgccccucugauggccccagccuggcccgugugagccucgccaccuggagacucccagcacagggaaacagggcgauuaggguccuggguucaaaucccauauuggcugggugaccuugagcucguggauagucucugggccucaguuuggugaccugugaaaugggaggaaggacugcacucugcgccugcuuuaaggaccguucuuucauaccaagaagcacucaaggcagcuugugggcaccccaccaauugugguuugggaggcaggguugggccucaaccaugaguaagauucuuaaggcaggaccuagggggaagggccuggcugaugcaggagagaagagagcaagcccaggcuaugggugccuagcccuugagagcucuaaugagggccgagucagucccugaaggggccugaucucagcccagccugccacgcugccccauagauaaacuauuugggaagaggcuccugcaggcuggccgcuaccuggugucccacaaggcauggaugaagacagugcccacugaggacugcgacgugcucaugaccuucccagguauccacaccugucugccaugggcccggaugcugccuuuaccgccucgguggaaauguggaggcccuugugggcaccucucgaggcaagacccauuggccccuaugccccuuggcagacaccacugaugaccacacgcugcuguggcugcugaaucacauccgggugggcauucccgagcugaucgugcaaguucgccaccaccgccacacgcgugccuaugccuucuuugucaccgccacauacgagaggcgaguccccugccucuaccucccucuggcccugucacccggcuccuugccccucugaagaccaacugugcuaacuauucguuuguccuaagauguggcucucgcacaguccuuagcuugggaaugguaagccaggagucccauggugagcccacuaugcccuguccugcccgcagccugcuccguggggccgaugagcugggucugcgcaaggccgugaaggccgaauuuggagggggcacccgcagcuucuccugcgaagaggacuucaucuacgagaauguggagagcgagcuacgcuucuucacaucgcaggugaccgcccugcgcccaugucucugcgccuacagcccucguaccuagcucacacucaucuccccacaggagcggcagagcaucauucgcuucugguugcagaaccuucgagccaagcagggggaggcucugcacaacgugcgcuucuuggaggaccagccaaucagugagcagggcgagcccgccauccaaucacuugcagagagcugggcgugucuguuagaaaaugggugcaaagggcguggcuuaauggcaaccaaucaguggcuaggaaaaauuugagcgcccaaugaacccagagaguguagccucuuucugauaccuagugcaagcaugggugaggugguccaggccaggcuuuuacauaggucucugagaaggugugggcaggaccauggacagcacccaugggcuagguggugaggcauacugggaaaccaggucucacaaguucagucucuacaacaaccugugucauuccuuagacauuuagauccagaaagggagggggcuguuaaacucuaaaauacacuugguagguagguggggacaugccugugauuuuccagucacaaucuguuaguucaagaccagccugggcuacauagaaagacucccaaccaucccugcccuucucaaauucaucuccagagaauguggguuaccacacccagcuuaugccauacuggggauggaacccagggcuuugagcaugcuaagcaaagcaaucuaccaaccaagucacauucccagucuuugaugggcuuaagagaagacagaaaaacuaugacuuugguuccagccaagguuuguugccaacucuggucagauaguacagggccagggaucacucacuccuccuccugcaguuccggagcuggcugcacgaggcaucauacagcagguguuuccaguucacgagcagcguauucugaaucgucucaugaaguccugggugcaggccgugugugaaaaccagccuuuagguguggcuuuguggcugaggagugggcugggguuccaggagacacuuagaggugacccagacucccuuuucuccuggcagaugauaucugugacuauuuuggggugaagauugccauguauuuugccuggcugggcuucuacacaucggcaaugguuuauccugcaguuuuuggcucuguucuguauacauucacugaggcugaucagguacuaggaagcgcugggccaggacuguggguggccuaggagaccuuccuccauaaucuggcuaugucgaugacuuggcuuucuucugcuaccuacagacaagccgggauguuuccuguguggucuucgcucucuucaaugugaucuggucaacacuguucuuggaggaguggaaacggaggggggcagagcuagccuacaagugggguacacuagacucaccuggggaggcuguggaggagccacguccccaguucagggucagucuggggcugaggcuugguuuucaacgagguuguaaaggaggaaugcuauguuggggaaggcauuugugugugugugugugugugguggaggggccgggaugaagggucucuaggccuaguuagguaacgucagagaaguuugugggccagggaggcuugugacaggaugggaggaagguggauuugagguuugagaagggugcauagaggaguguuucuugccagagaaaaggcauggcugaggaaaauugggcuccuaugaucaggaaguggguauggccccuggucucacugccuuuucugcuggcugccagggcauccggcgcaucagccccaucacccgggcugaggaguucuacuacccacccuggaagcgauugcuuuuccaacuacuugucagccugccucugugccuggccugucuuaucugugucuuuauacugaugcuuggcugcuuccagcugcaggugaugccucaccucuacucuccccuagccccucccaccaagcaccagguccagcuucacgcugcugauucuccuaccuuguucugucucuuuuaggagcuagucuugagugugaagggucugccccgccugguucgcuucuugcccaagguuaugcuagcccugcuggucagcgugagugcugagggcuacaagaaguuagcuguguggcuaaaugacauggguaugugcuggcaggggaggcccucaccauuccgaugauccccauaacccucuguuggggcaggguggccccucacucaccuccucggucccuagagaauuaccggcuagagagcaccuacgagaggcaccuuaucaucaaagucgucuugguaagugaacacgcaugugcaaagaggcuaggaggaugggagagagagggggcugggggaucagcggggcaggacugcaggaugacccuagcugccugccucccaguuccaguuugucaacucguacuugagucuguucuacaucggcuucuaccucaaagacauggaccgccuaaaagaggugagggccugugcaccgucccaggggcagcacccuggccccuuggggauggaccccuguaagggguccagggcucuccagccccucccuccuguucuccauccuucucuccuuuuuguccgucuguccauguguccuuucucugccugucguuccccucucccaucuguccguccaccuguccgguuggucccuccacagcuccugcuacuccugucccugacccagagccucgagcggcaguugcaggcggugcuggucccgcucgcggcccugcgguuccgccugcuccuccugucccuccggggucuccugcucguggcccgggccaaaguacgggcagguggcgagccuucccacggugugggcaguguggcuguacuggggguaggacguggcgagcauagggcgcaugcgcaaaaugggucuuagugcaggccuaguaagacccaccgaggcgcccaggguacuagacaaugccugggcagugugggagagaugcuuugagaaucuuggccuguccucaggucgucauguggcaguggcaguggcauuggggcugagcuguggccucacgaccaggguugucgaaggguugcaggagcaccgggaagggugugugugugugugugugugugcgcgcacgcgcggauugugacccucuggugcccagucccucccacaccgcgcggucucuuuucguuugcagaugcuggccacccuacucaucacccggcagcugcugcagaacgugcgcgaggugcugcagccgcaccuguaccgcaggcugggcagcggggagcugggcuugcgaaccauccuggagcuggcccgggcccugcuaggccugcugaaccccuugcgcccggauccccgacggcacuuggaggcccaggcugaugagggcggagcugggagccgcaggugccugggcgguggcugcggggcgccagaggaggagaaugaggaggaggaggaggcagcuguggagcggaggccagcaggggaaggaggggagguuccagaagggccucgggguggcaaggaggaggacgaggaggaggacgacgacgaagacgaggacgaggaauacgagggcgaggaaggaagccuccuagacugcgggcugcgccucaagaaggucagcuuugcugagcggggcgcagggcggcgcaggccaggccccagcccagacggccucuuggaggaggggagcccuaccaugguggagaaggggcuggagccugguguguuuacucuggccgaagaagacgaugagccugaggggccuccaggcagucccgggccagagccccagacugucuugcuucgucgggcgaggggcgagggccgugaccaagguccugauggagaccgagauacggagacuggcucuggcgacgcggcuggaagacagaaaagacauaacagguccucguggaucgacccgccagaggaggagcauucaccgcagcucacgcaggcagagcuagagagcugcaugaagaaguaugaggugagaugggcagagccaccuuggcgucuggagguggaggcaggaaaccagccuggucaacaggaaacuccaaagagaaucaaauaggguuguguugauaguuuaacugcuaugaacuuguagcucaguugguagaaugucuagcaugcaggaaguccuggcuuccauucccagcaccauauaaaccaggcaugguaaaacacagcugucuucccagcacuaggaaauggaggcagaaagaccagaaaaucaaggucauccuuuauuauauagugcauucuggguaagccugggcuacagaaaccgugccuuaaaaaauaaauaggagacugggcgguagugugcacacuugauaccagcacucaggaggcagagaaucucuuuaucaguacgaagccagccuagucuacagagugaguuccaggagagucagggcuacacagagaaacccugucucuaaauaaauaaauaaauaaauaguacuggagugcuggcucagcagguaugagacugcuacucgggaaaauuggauguccgaaacucaagaucccagggaucucacaccccuucuagcuucuggacacucgugcacacacacaaaugcacaggaauuaaauaaguaaagagaaaaggaaaaaaacaacaacaaaaaaccaaacccuugggaccccaugguaguagagaacagacuaccaaaaguuguauucugauaucugcacauguacuaugaaugcuuuucaaaaagacaagguggagaaugacugagaaaagacauccacauuaaaccucucgccucaacacaaacucaugcacacccugcucacacaaugugccugugcagaccaugcaaccccccacaacccuuauucucaaagcacaugaucaggagugcaugagaauguggaugcagguucucagccuacagauggagugguggggugacuaugggaucauuggugagagcaagagccuaucuggagacaaguggcccuuggacuuguucaggaugggggagagagucugggucuagugggaugaaucaggggaggggcagugccagccaggucugaugggaccccccgucuguccucaggacaccuuccaggacuaccaggagauguucgugcaguuuggcuauguagugcucuucuccucugccuucccacuggccgcccugugcgcccucgucaacaaccugauugagauccgaagugaugccuucaagcucugcacuggccugcagaggcccuuuggccggcguguggagagcauuggccaguggcaggugggccagucagggaggcccagaggggguggagccuuggggaugguggucccuggcugggccuguccuugacccuccuuccuccccugcagaaggucauggaggcgaugggugugcuggccaucgugguaaacugcuaccucauuggccaguguggccagcugcagcgccuguuccccuggcugagcccagaggcggccauuguaucugugguggugcuagaggugggccugggggcccugaggguagggguucuggggguggggugggaaggcuaggcauuccugagccugcagccccugcugucugucccccacagcacuuggcucuucuagucaaguaccucauccauguagccaucccugacauccccggcuggguagcugaggagauggccaaacuggaguaccagcgacgggaagcuuucaagguaugaggcuggggucaaguugauguggucucaggaggaaauaaagucagggcuaaagucuuagugagagcccccaggcugcagagugggcagcaucccuacccccauccccagguucugcacuuaaggauuauaucaacuuggauggaaaguuucagaaagcucauggcauacauagggugugcuggggcauagcugucauuccagcaccuagaaggucgggcaggaggaucaguacuucaagcccauccuuagaugcauaggauggguuucaaggccagccuagacuacauacugugcucucaaaauaaccaaacaaacaaagccagauuugugucuguacugacuauguacaggucuacugcguuuuccuucucuguguggagaagguacuaugguucuacauagcucauuucugccucagccuucugaggacaggcauguacuaccacaccugguuuuuguuuuuuguuuuuuguuuuuuuuaaaaauuuuuccuuaagauuuauuuauuuauuacauguaaguacacuguagcugucuucagacacacaggaagagggcaucagaucucauuaaggaugguugugagccaccaugugguugcuggguuuugaacugaggaccuucgggagaacagucagugcucuuaaccgcugagccauuucuccagcccuguuuucuuuucuuuucuuuuuaaaauucuuuauguuuggugugagugagucuuaguguacaguccaagcuugggccugcuucugugaacaguccuccauucgcagccucucaguuagcugggaccucaacuacgggacacggugccuccgcagagcagcucccauauggcauucccagcgacucaucccaagacuuucuuguuugcauuuauuuaacuuuacgggaugcgucuuuugcuugcaugugugcaugugcacuguguuuauacagugcccuuggagaccaguagagggcgucggauccccuggaacggaaguuacagauggcugugagcugccauguggguccuggcaaggaaaccgggcuccucuuaaccacugagccaucucuucagcccccaggagggugugagcgagcguauagaaaagcaggaugccacuguagaagggaccagagcauccaugcuuguggguccaggacccaaccccuauggauacuaagggaugacuguagcuugcgcucaccgcaguggguguugucuugauucuugacgccacaagcucuuaagaauguucauucuucagcuugccaguccgccucuaacaaacuccucugcaaaccgcaugaagggccaaggaacugcaccuucuagggaagacuuaggaaaguguccaaccaggagacaggauuuuaggcugucagucuaccugagucacauccccacuccuucagggcgggauucuaggcuguggcuccacugcugguccucaucaguuccaaacugaauuuuaguuaauuuauaaugagugguggcucaugucugugaucccagcacuggggagggugaggcuggaagauucagaauuugggcuacaccgugaaacccugucucaaaaacaaagaaagggaaagggguggguagauucuccugagaaagccccagcaggucuaauagccuccccauccccuucucucugagcagcagccccgaguuuccuugucuucucucaguuccucaggcacuggggggggggggggggggaugggguggggcggcuggucagggguucggagccuggucguagucggcucucagcccgccugucucccccaauacgcagcggcacgagcggcaggcgcagcagcgcuuucagcagcagcagcggcggcggcgcgaggaggaggagcggcagcggcacgcggagcagcaggcgcggcgggagcgcgacacgggaggccgcgaggaggcgcgcgcggaggcgccggguccugaccccguggcggagcggggcgcugccaaggccaagggcagcgagcggccccgacggcccggagcgcugcugccacccggaccugugcugcggcugaagcagaucaucccguugcagacucggccgcccgcgcccaccgggugcgcgcccccgccgcgcucgcccgcggacacgcgccugcccgccuuccucagccugcgcuuccucaaggcuccggagcgaggcccguccccgccgcggcccgggaagcuguucgcauucucggcgcgcgagcccucagccaacggggcccccgggggcggcgcgcgcgcucacaggagcgccggggacgagcccgcggccgccgagcccgaaccgcggccggaggacgcaggucacaggccuuaaccggggcgcgcgucgcgagggcagugggcgccguggggcccugcgaaccgcgcucucccuccgcaggguccgccucgccuccugcuggcuguuggcgcugggacgcgcccuggggcugcggcgacaacccgccccguguccccgcggaugucccagcggaugccccugcacagccugccugcuggcccacagcccgccacuagccccgccgcgccccugccguucucccgaccaggaugggggccucgagcagaccccccacaauacagaaaaauacacaggaugggcgguuauuuauuuguuuuuaauuuauuuugucauauuuuuguaaaacggcagaaaugcaauaaaaugucuauuucaacagugcucgaggucagagcagugaaggggccuugccagauccguggcuggaggcugagcacccuaguucucccagaaugaggccucuaggagguccagguccucucuggucuggguccagauacacauggcacuccacaccucagccagaugugacaugguucacucauaggggugcccaggacagagguucugcaccgggagcagccugcugagccuagacucaggucauauggcccaccugcaggaaccugggugguccaggugacucccaagaaugcacaguaguagcacagcaaaaggcaaucauaggaaggcaguuggaauucagaccaagaccugagagugggagaaacuucugccuguaucugaaaggggagaggccuucagaggcagacacagggagcagcuccaggaacgguaccguggaggauucuggccagggcaucccaggguuuaauagggcacggcggcaguugccaagucacagcaugaggcugagaugcuacuagggccauaccaggcccaggucaguagggccacagccaaauaauaauggcccccagugaacacagacaccguuagccuucacaaguaugcaggguccucagaaccccauccuugcagugaguaccaugcuacagcugagggugcacagccacucuaccaguccagguaguucccccauaucccaaugauaauguggccaccucagcccugcaauguucucgaguggccagauggauaccagugcuggagguuggcgggccuugcacaugauacccagugguggguggcuguugguuagccccgugguacuauccugggcucagucucccaggggaccuggccccaaggaccccaggcagggguugguuccuacaggucccaguggcuccggccaaaguuugcggagcaaagacgccguguggaguaggaaagguccuuuuauugggguggacguggagcacgggcuaguccaugauaaaugauguaaaagaaagauccagaggagccagcucuuuccugcccuggcacgggcucagagugaggccugggcacaggaggacccggaggaccugcaauccggccaggccuguggguaggaaggagcgaaaggccgcucgguguguugggggaccagcccgcccugggcucuagacucuggcgaggucucgcuguggguggccggguggggggcaccacugugcuuuaaaaagcauguacugauaccucgcggcugggccuggugucccuuuaaccaaugcuugacacgaguuacagcauaaauaaaaacucaaggaaaauaaauacauggauccuaugcgguuggagggcgcgggcuggauguaggaggcgggccgcgcuuacacacgcgggugggaguggacagagcugacagaugaggggagaugcacaggaccuagguguccuccggcaugucggggcugucgguccgggccaccuugcgagguggcgcugagcucucgcccuccgccuccaccugcucuuggucucucuucuuggcagcauucuggaggugggggaaggggagagagucuaagggugaggacagcauccgggcagccaguggcaugggucuuccccccaccuuuuugagacagagucucuacauagcguuggugucccaaaacuauguagaucaggcuagccucaaacucagagaaccuccuuuuagcaucuggagugcugggauuaaaguugugcaucucugucaaagaccucuucucaaaggccuagagggagucaucagccagccaccugggggcacccugcaagguacccaggcaggguggauggauauguuuuuuuacacaauaucuaaauuggcugugguggcauaggucuauagacuaccaccuggaagucaagaggcaggaggaucacucuaauaaguaugaggacauccugggcucagugagacuugugucaaaaacaaaaaaaaaccaaauucaugguuucauguacuucaagcugacucaaaacccugccucucggcuuccugagugcuggggugacagucauguaccaggugggcaggacccaggcugugcagugcagaauccugucucuuacauacccacuguccuggucaccuaaagaacuccuacucaacccucaaggcucccacucaaauauccccaguccccagaaagaaccuugccuuuuuaucccauugcuggugcagguaccgcagaaguauguucgucuuuucugucacaaugacugagaagcaaagagagagagugagucuaagaccugcaccuuggccuccuggccugccuugccagaaauggagcucaaauucagcacuacuaucuuagaaaugucuaaagauuggcauuucucuucugaguacagagcuccaacucugccucagccuccacugcccugagaacccccauuaggcucugaggcuaggacagccuguuuggaacauggccucaguaccaaagauggagcccaggcuccaggacacaggcuagcacucggcugagguuaccuccugucugcuucuguauucucccaggguccauccaagguggugagacaccagggaagaaauucgaggcaacagcgagguuuggguacuggggacagaacccguggccucacccacggcagggaacuauauuaugcaugagccuugcccucuuuccugguuccuaaaaagauccauuuuguuuuuaagaauugauuuugauuauuuuaaauuuguguguguguguuuggggggggggguguugugcaugucccaggaggccacaagagggcguuguauccucuggagcgagagagagauacaggguguucaugaggcacagcaagaugcuggggucuggacuuggguccccugcugcugcagcagcaauaagugcuaacccugagcacauagauggcccuugcugggcuagguggggguacacacugggggagcugucucucuccucuacuaggagacugaaucagccuggugguggacaucuauaccuccugagccgucuccuggacaucagacuaugugguuuauuuuuuugagaccagguaucacucuugcuguccucaagcucacucuauaaaccaggccggccucaaacucacagaaacccaccagccucugccucccuagugcugggcuuagagguaugcaccaccaagccuggcuuccagauucuuucuugacaguuaaaaccaccagccccuuuucuccuacgccacagcacaggaccuggacaacacugcccacaggccaagcagaaucauggcccucaccauuuccgugcuuuuugagcauccauguggguacacaugugccucggacuguguguguggggggcagagaucaaccuugguacuagcccucaccuuugccuuguugaugagccuucauucuuugcugcacaggcuggcugguccuagacugcugauucccauuacagacugcagcugaggcaccuggcucucacaugagaucuaaacucauauuuaaacuucugauccugcugccucagcaucuagagcgcugggauagcaggugggcucaucuugccuguuucaugugcugcuaugcugggguggagccccgguuuaugguuuugauaugcagacagcaggagagagcagggcagucaaggcugaggagagccagugucugcugcuccuaggcacagugggcuguuguccccaggauaaccccuuaccccuccacaggcccuuccuagcugugcggagggcaaagcccuacaguacucacucuguucugacggguacucucgggucggcagguauacugagggacggcgguucuguggauggggagcgguggguuagcuggcaacccucauccucaggacagugacgccacccccagccccacacucaccgaggccuugcacacagaguccgcguggaaccugcugaaguugcucuuguuguagacgggcaagccuuucagaaagucugccuggagacagggguggcugugagaccuccagugcagaccaggguacacccaucuggugcuauguauguuugugugagggacgguguauggguguugcuguuuguaugugugcgcgcgcaugugcgcacacgcucagaagacaagauauucaggucacuuuccccuuccaggugggucugucugucaccaggcauaacuguaaacacuuuaccugcucucuaucucacuagcccagaagcuguuuaaaguuauacuuccucugggcacagcagugccugccugccugccaucccaacauccaugagacuaagacagggggauuacuacaagucccaaaccugccugggcuacagagugagacccuaucucaaaacaacaacaaagcaauacugaagccaggcaguggugguaaaugccuucagucccagugcucaggagacagug

SEQ ID NO: 4515 - RNA, 3220 nt, Mus musculus
cguggccuggaaaggguuccugagcccucuaggaucgacggaucacauggcgcccucuuucuaucacuaucugcccgugcccauggaugagaugggggggaagcaaggauggggcagccaccggcaguggcugggggccgcgaucuuggugguccuguucgggguuaccuuagucauccugacaaucuacuucgccgucacagcgaacagcguggccuguagagacggguugcgagcgcaggcugagugccggaacaccacgcaccuguugcagcgccagcucacccgcacccaggacagucugcugcaggccgagacacaggcaaacuccugcaaccugaccgugguaagccuggaauccguccccuccaguggcuuugaaacagccaagcaagucccccacccccaccucgaaggccagcuacuaaagacugaaauccugggagaccuuagaacucccuacagcucugcaaucaggggccucaguauccucccuuccuuuggugacucuccaaacuuuguguagagugcuugaguuggagagcucgaaccugacuuagggaccagcauuuggcuucacugggauaucacucagcccugauugaauuuuuugaaacagggucuccuaaauugcuccggcuguccuaaaagucacucuguagaccaggcuggccucaaaugcugccuuucaagugcuaguauuaaaaacaugagccaccacaccuagcaaauuauugaaacuuuuaauaugucucugagagaccuugucugggaagcccgguucugcuguguguuuguguaggagaauaucuggaacuuucuacuagggguuaacuacgaagaguuuucaaacuccuaugugggcacuuaaaauugccguuuuggagauuacaccuugguaggacuggguggauacggagaguguuggaggggaaccugaaaggggcuuugcuugagaaggucucagaugccuuugccuggaaguuuccuaggggccaggacaacagccaacccauguuugugccgcuuuucugaucaggugacccuucaggagucccuggagaagaaggugucucaagcccuggagcagcaggcccgcaucaaggagcuugagagugagaggggggcagggggagggggagguccaguggagcugggagggaauagcuuaggccuccagguugggacuuggggagaggugcugacccacaugaagggguggcagggucaugagcccacugcuuggaaguuugguuucuucccagagacagacagagugccagggaugaaggaauaaagcuuggggaguggaaguagggguuuaugucagcagagagcagaggguggguaggaagaacguugucaggaggguggaggccacagaucugcuggguuucccaaguguucucuaaacuggugcuucuacagcccugcagaaggccuuaggcuggccuuccuuugauuccuuucuccuuauuaccccacccccacccccucugccugaccacacuggcugcuguguggccuuggugguuagaugcaucccagguguucccuuggggugcucuggcuguccccgcccucucccccuucuggcugcucacuuagcagcaguauaccgaccagcccucugcuugugucaucgcagaugaagucacgaagcugaaccaggagcuggagaaucugagguuagagacagcucucccugcccaccgccacccacuccccuccagacugcacuuccuucaaaagcugggcuccacuuggcucacacagucuacagcucaggugugagcugugaagaaggccuaaucaggaaagccuacaccaccaccgugggguguugaggaccugaggcugaauacccagcacccacuuacagauuggcuggaauuauaugauuggagcuccauucuggaggacagacagaaauauccuggagcucacugccuagccugguuagcccaaacagugagcuucauguucagggagcaacgcugaacaucucuggccuacacaugcaccuacacaaaugaacacauaacagcuuguacacacaacaccccuacacacacacacacacacacacaaagaaagcccaucaugugucugagugaagaguuucagagggccgggcggugguagugcacaaacgcauuuaaucccagcacuugggaggcagaggcagggggaucucuaugaguuugaggccuucuuggucuacaaagcgaguuccaggacggccagagcugucagacagacagagagacccugucuagaaaaacaacagcagcagcaacagaaagaauacaaaucagagcaggcagaagaggcgacucagugccuagagcacucgcagagcaagccaacagcuagaguuugauccccagaaccgacgugcauaccucugacuccauccacaugccacacaucgcacacaaaguaaaauaaaauuuaaaaagaauaaaaauugaagcaaagaaaacaugaauuucaaagacuaauaguagggcuaaggaccugguaggacuccugcauagaauccucagagaggggcuaggggcauggcucagggguggaguucaugucuagaaucccccaguuucaucccaguccaggaacauauaaaaaggaagcagaucagcuagacucaggugaccucugccacucucucuacccaggauccaaaaggagacuucuagcacagugcaggugaacucuggcagcuccaugguggucuccagccuacuggugcucaaagugucacuguuccugcucuuuugaggacucauuaguuggcaggugagggacccaguccaggggaacuugugaggaccccagacccacgggggcagggggguuggggauggggugaagaggcuaugcaugugggauauacuugggcccagaguggcccagcucagggaggaggcauggcuugagguggcgggggcaggguggcaguuaaccuuugaaccuucccuuuuucccaggucacaguuguuugaagucacuaugggucauagugacucuggagagguccuggcagcccugaggauguggaaaccacuagggggcuccagauugggucuuccuccgcagaacuuuaggacuggggaguggggagggaguucugcuuuauugcuuuugcaguuauuggggggggucacauauuucuggugucuuugaccuggaaaaauaaaguaauuuaaaaagaaag

SEQ ID NO: 4516 - RNA, 13928 nt, Mus musculus
cuucagugaaaaccaauaagaauuuaauacaaacaugagcaaguuaccaagaccugagcaggcaagcagucaucccaagaagaugguacccacuguccaguugacagucaauuugguuuugaagggacagcaacacccuggccugcugguaaacacacugcucaggccaagaggagcaccccaauacaggugggcaccucaaggccccaaacauaugagcagccaagggacaccugagauacaagggcagagagaagcucuggaaguaaggggugggcaagggagccccagcccagggacacggggggugggggacuugcaaggucaugaguauccuugaaccuagcagucaaccaagggaaggagagcaaugcucccuucuagacaagggaagcccaguguccuccggcagacagguuggaggguggcuauuucucaaccaacugggagucaaaggccugauacucuaggugcucaauaaaugcuuguuacauucuguuuagacucugucauugugcucagcguguagccuagcacacagggucaauaagacuguuuccaccguaagcauaucaugcccacuacaaggauaagcaccacugggacauccaucuccagcaccuacugagugacacauaguagacacuuaacucaucagugcuuccuaagaccuggcacauagcagcugcuugguauauuuugcuugauuuuuuuuucuuauuucaguauucccagagcuaagaaugguaccuaauauacaguaagcccucaauaaauacucaaacggauuuuaaaaaugaguauguaucccuaauaccugacucagucugaacaauaaaagacugaugaucaguucaucacugauaagggggaaucaugccucuuucauugcucuaacaagagaacuuccuucaugguggacccaacugacugugcuuguuccugaccaaucucuugguggucagcccuauuucuggcauacaguaaguacuccauaaaugcugccuguguguaaguggcugcuaaacaggaagacauggagaccucugugcuuguagagcucucuguugucugccugaguggcccuauagucccaggcaagcacaugaaguuuagguguguagcaguggcuuuggcuguuugccaguugccucaaagcucaucacgggcagugcuguccaguggagacuggagcacaucugaguucuuggccucacggcucagugcuugcuguucccgcaucuucugggacuuggcucggucccagucagucuuaaccugcucauuauuccacacaacugaggucucugugucacucacauagccaucauccccuguguaguguguaggguagauaaggaggggcuccacagagaaggcacgcagguugcggggagagaagugacucuuguauucugaccuaugggagauagcagagacauaggggagauggagaccaaugauccagaaaaagacuuuccuuugaguccacuaggauucaccccaccaugccuagccagagcccaacacuccccugcccugaucuuccaagacucaaagacccgagccugccacccaaacccccucaaauacccaccccuucauagccuucuuacauugggugcuugucaaacaugacaggcagaaacucaucaacagguagcauuuuggccaguggcuuggcagcaagcaacuucugagcaccuugcagggagauuacauaggcuagcguccaguaggaguaaucagccucuaccagguuccuuacauggggcacagccuuuucagggugcuccaccugcaugcgcuuccggcccacguagcuggggugcagaauaagagacuuguuacaugucccccaccugccagagaaugcuacacagagacaaggcauaaggcuuggcacagggaaauugaacagaacccaagucaacccaacagacagcagagcucugacguccuccagguucuagccuuacuuuguccuuaagcuccaggcucugccccugagcccuggucaugccugggcuaguacccgaggcuggugucccauccccaacccuuccaucaaucuccacucacaugaggucccaguccagccccucacgcuccacaucccgcaugagguucaucagacgucucuugaagaagaucucaaaacgcagaucauccucaaacacuagugauuucuguaguccccggucaaccaccugagggaaggagccacuccaagucaaggagacccagccccagaacugcuugcuaggaaggaaauaugcaucccaaccuuccacauccagcuauuugcccaccaugccacucuucugccugucuaccugggcuuuucuugccuagggccucugccuguguuuagccugugauacuaagaagccuuccucuuggcaacaggcaggcuccucuuacccuuccuccuuggugcaaugcccccagucuaggaggcuucacuauaaacuaaugaagcuaacggaaugcccgugaggaacuuuaggaaagaaggguggcucacauaagcacccaucaucuugaacaguuagaugcucuacuuccuguaccuuaucaucuggagccaacaccccacccauccagccccauuugcagguuccaaaccugguucuugugugacaucauggcacaucaccagcuguuguccaguggcauuaaagccagaagccaucacuucaauaaacagugagcagagucagguugcaaggcaagcaguucucacuugggaaucacagcuuuagacuuuaccugaggccccuuuauuccccagguccacuuucugcaucuuggcaaugccaaggcaguggcugcccuacucugguguaucagggcuaaugugaagacaguucaugcaacagacaccaaaauguagucacagauucugccacugguagcauggggaccauaauuccucccugggacucuggaccugaccuaaucugugaagagaacaagaacuguggaucaggccucccucaucccagacaccuaccuccuuccagauguuguaguggcugagaaagcagcccagcucucccuuggugaguggccgcccaugguaggggucccgguagccaggcagcaucuggaugcccauggcuuccaccuggcugguguucauggcucuguggggaugcaagagggaagaagauguuagcaaaaagaggaggacaagauggugagcaaggaggagagcaaggaggauggggaggauggugaagagagcgaggacagggaggauggagaggauggugaggagagcaaagaggauggggaggauggggaggagagugagaaggauggggaggacggagaggauggggaggacggagaggauggggaggagagugaggaggauggggaggauggagagaaugggggacagggcaaggaugaggagaaaagcaauggggauugggaggaaaacagggggauaggaggagaauacggaguagggaaaaaggagaggggauaggaaagagguugaagaucaggaggagggagaguggcaugaaagaaggaugaagagaagaaugggagaagggaggugauagggggcagauggaaagaggugagguaagacaaaagaagcaguccugccuacugaugaaccucugcaauccugagaauggccucacccucugggucuuccccucacccccaccccaccccaccccaccacuuuguacaagagcauggcagauuaucccaggaugagaaccuucuuguucccuggcuguggacuuauucauuucucuaccacaucuguacugagugaggucugcgagagcuagcuccauuccuucuaugcuucccagaagguuguguguacaagcacacgugcaugcagacacaugcauacacaagcacacacacagguagcugcacucacauaggacgcacacacaucggcauacacaugaacacacacacauaggcauacacaugcacacacacacaugugcgcgugcacacacacacaugugcacgugcacacacacacauacacacacggacacacacacaguacucacuugccaucuacagccuccaccagcuggcagucaaucuccugcucauguagugcccgcagcaugcguucucgccggucccgccuccgcuucagguugaucaugaagaccuguagccagagccucagugaggcagggucagguuggcugccucccccgacccaggaggccccagcccaccucaucgaagcccaucuugucagaagucuuccugggugcugagaugaaucgggagagcugcacugguggauguuucacugagaguaagaaaggaggggucaaugcucccuucucccagcucccaguauaaccaggguaugccccaggaccuucaccccugccacguuccugcccagagcaacucagaucucagcugugacagcccagccagugggagccuccaggccucucugaccggucaggcucuucuggcccaagugucaggcuuuggccaucaggacacuaucccugcuuuucuaacuccaucucuaacauccugggagggcugugggaucugucuacacacauugcaugcccagagcccaacagugccugguaaacagcaggcacucaauagaugcauagggauuaucccagcagugcaugugugauaacuucagugaaacucucagaagcuuuacacaaaugcagugagguucacacuggcugcugucccuccaaaugcgacccccuaaaagcgacacagguauaccaacccucaggaacagaauaacuuugcugcaaaacaagagcagucuuuuuggcuauggucucaagcuauagcccaggaugcagggccucagccucagccuccagacugccaaguuggcaggcaugugccacagacagcagcucauguuucaguuuucucagugguguggggacaccaaagggcacaggcacacaagaguauggcagcaucugccaggaugacagcugacccugugacuacuguagaacucccuaguggcagggacuauggucucccucagucacacaccacacacaggaacugccacccaacaguacccaauuaguucuugagaugcaugcaugauaaugaggccagggcccaaggagacucacccaugaccuccagcugcacgugcaugaagcucucugcuucguccugcaggcugcugugcgcacgcaguggcacgggcaggaagccguacaccuccuuauugcacacguacauuugcaccucugagggugggcacaagaggcaagucagugcugugcacucucaagauggcggcugggguguggugagcugcaggcuagccugggcugcacgauaccuaucucaggcaaacaagcacuggucuucacuccagauuuuggucauucuucacaaaugugaaaacagggugcucaaaagcacaagugaggccgggcgugguggcacaggccuuuaaucccagcacuugggaggcagaggcaggaagauuucugaguucaaggccagccuggucuacagagugauuuccaggacagccaggacuacacagagaaacccugucuggggagguggggggggggggggggagaaggcggaacacaagugaggucagaucucaccagucaguguacuuaacucugguuuggaaaaacuuacagguaagccagguuucuuucuuucuuuguuugguuuugugugugugugugugugcgcgcgggcgcgcgcgcguguguguuuguuuuuuuuguuuuuuguuuguuuaguugguugguugguuuugagacagguuucucuguguagcccaggcuauccuggaacucacucuguagaccaggcuggccucaaacucaaaaauccgccugccucugccuccaagugcugagauuacagguaagcacaccaugcucugcgaguucuuuuccacccgcccugccgccucccgccucccucuuacuccaucuuccuuuuucuuuggcuuuaguuccauguaguaaauggagaacacuaaaugcaaacuccauggccagugagaugauucaggagauaaagguacuuguuaccaagccuaaagaccugaguucaauccccaggacccacagcagaagggaaggccugacuccugcaaaguauccucuguaggaguuuucaugagugugccuuggugugugcacaaguaagugaguaaauaugcugcagaggaggaggacaccugauuacgaccucuggucucuacucacccacaggcgaacaagcucauacccacgcaugcacaugcacgcacacaacacucuugagaguagacauacugggagaugugauauccaucauaccccuuguuguuauuugggaucucacccugugugucauaaacuuaccauccugccucagcgucccaggaucacaggugugaacuaccauacuugaugaucaacaggucuuaaggagcuuuagaguaaggcugauaaggcagccaugcuacagacaucgagucccaggagcacagccaaaccucccuaauacagcugagccugaggcccaucugcacucuguacgcuuguucucuaaacuuucucaguguggagcccacaccaccguccagcgcccggccucacucaccugccuguuuacaggagaaggcaaagacgaugaugucaucaaaagaccagguguagucuggguguguuggguaaaaggccagguuccuggaugcagccuuacgcaggucaaugaggaagguagagugcaccaugggaacugcaaagcagccccugcggucucguuuucggauggggauauaggcaggggugcgcuuguaguagcccugaaggaggauggggagguguggucagggggcgcugaagcucacagaggcaagaaugggguacccugugaugcuuccuugcauccagccacaacaggcaccccaagagccauggaguagacauggcugguugacugggaucacuaccuuaugcuagaacaccuggaucaagccaugccugaagcaccaacucccccaccuuacacacaaacacacugcugcuuccugugugaauuugggccagauucucaccaccacccccucucccugcuucaagcucaguaaugaagggguugggaaugccuccagauccugccccgccauugucugaggauuguccugacagugucugucaggugcucaaucugccuguccaaguccccacuguaccugcgaagucaucccacaccagaaguuggaguaugccgcucgggaguccagcaugggggccaccacugucuuguucucagcgaugagcaggcucagagugucgggguuggugaucaaguugucgauguccaugaacugcaaaagguucacauguugucaaccugaccagcgcagguagagaggcauggcugucccacggagcccgaguucucucaaugccucugugguggcucaguaaaaagaauggggugaggaagcuggggcauggcucagugggauaaaguacugcagaacacgcauaggagcaggagccacaggcccagcaccaacaguaagcugugcccucagugucugccucccagcacuggaaauggagacaggagaugggccaguggguacaagugggugucagcuucagugagacccugacucagggaguaacucacaaauaaaaaaacauuuuuuaauauuauuuaaaaacaaaaccuugggggauuggagagauggcucagcaguuaagagcacugacugcucuuccgaugguccugaguucaaaucccagcaaccacauaguggcucacaaccauccguaauaagaucugaugcucuucuggggugucugaagacagcuacaguguacuuagauauaauaaauaaaucuuuaaaacaacaacaacaacuaccacccaccuuggccauuagggcuggggguguggcagagagccagucccggcucuaccccauuguacugucaccugauguacagcaaaugacaggggagucacaugucucacaacauacaugcaaauacuacaagccagaccccacauucuggacucagccugcaccagggacagcuguggcuuuccuguggcucuggccacugaucaaccuuccacugcccaugcacaaugucaaccgccauucgcaccucucugccacccagagccauggugacacagggccucucugucacccagggccauggugacacaaggccucucuaccacccagggccauggugacacagggccucucugucuccacggcuccauggugucuccagcugaggaggccgcacugccucuggggagcuuuggggugaagugcugacccugcaaacacuagaaucaugugugaguccagguagccuggcaacucacccgucccccaacccucacaguuagagaaagacacaaucuaacuuuccauccugggaaaugaaccucaaaauacugaaggcagggguucaaacacggcacccaucacaggaaccaaaaggaaaauguacaaaggcugccgagcagcgaaagggaggccaccauucgggacacugcucagccgcgacaacacacagaccucacaguggaugacaguagauggcacugagaagcuguguccuggcacacaggguguggcuccagggcaggaacagguugaaacaggcaaaugcaggcaggaggcaggaagacuggaagcugccagggacuggcgagggauggcagacugcaucccagagguagaauguucuaaagaggugacaguugcaugaacagugugauggcuaaauguugaagaaaugcgcauaugaaaagguugauuuggccaggcaguggugucgcacgccuuucaucccagcacuugggaggcagaggcagguggauuucugaguucgaggccagccuggucuacagaguaaguuccagggcagccagggcuauacagagaaacccugucgaaaaaaacaaaaaaagaaagauagauagauagauagccuggugugacaccgcaugccuguugucccagcacuugggagaaugaggcaggcaggaucucuauuuugaggcuagccuggucuacagagagaguuucaggcaaacuagggcuguauaauaauaauaauaauaauaauaauaauaauaauaauaauacauuaaaaaauuaagcugggcagugguggugcacgccuuuaaucccagcacuuaggaggcagaagcaggcagauuucugaguucgaggccagucuggucuacaaagugaguuccaggacagccagggcuacacagaaacccugucucaaaaaaacaacaacaacaaaaaaauuaaagcaccaaggaagugacuucauauuccaguguugugcuccuacguccccuaguaccaaaaaauauauaacuuucuauaggaguuaccaucagggugaccuccagacaggcuggccaaggggaaacugugaaaaaaguaaaagcaagcagaaaggguggggcagggugucugcucuacaaggcucuaaaaggcuccacaaaguuccaggugcuucuagaaacugacaaaacauuccagauccauaccacaucacuuuuccuaccaucggcaucaacuuucucaucugugaaaugggcuaaggagcaggacucaccuuccuccuucuggagucuccaugccuccccaggcuaaagucaccagacuccccaucccaggugagguguaguugggcacucagcaggaggcucugcugagccugauaauuggagcucaccccaggacuugcaggguggaagcugagaacagacuucccugaguuguucuccagucuccacaagauuaugacuacucgggacaacccauacauaaauguaaccgagaaacuaaaacaauguaacaccgcugcccauggcagggugagggguggcacugcagaaaaccaucaagccgacacagcccugcccugcacagagcucucuguuaaagcuaauggggccgugucugcauggcugggcgcuagccacccucuacauccccugagucccuccuguggugcuauccuggguuugacaccucccucacugugcugaaccugugcggccaaggacccugcagacacaugaggacagagcuagaacgccaccagcagcagagcaauccaacccugcccugcccaggacacaugagaccacaggcgaccuggguuccucuuagcacuugcacaaagauaaccauguuaaagugagugggcucaugacaagucaccucaguaccugagaggcugaggcaggaggaccauggguuccaggcuagcgaaagcuacacagccaggauuuauagcaagcugucagucaauggcucagcaaaggaaacugaggagaccuggagauccaccuguagucacccucagggccacagcaauagcuguggaccaugcugcaagucagacugacuccaccaacugaacaaagcagccuuaggcuguuuaggacaggacacagggaucccuggauacccagccugauguacacacgcgugcacacauacacacucuuaauucacuggggacuggagagauggcuuagcagucaacacuacuggcaguccuuguggaugaccuggguucuguucccagcacccacauggcagcucacaccaucugcaaccauaguuucagggcauccaaagcccuacucugaccucggcuggcaccaggcauucaugugguacacagauugucaugcaggcaaaacacccauaaacagaaaauuaaaauaaauaaaucuagcugggugugagggcuaucaccuguaauucuaaaauucagaaagcagguggaucucugaguuccaggucaggcuaaucuacauggggaguuccaagacagccagggcuacauagagaaacuuugccuccaaauacaagaauaaauaaaugaauuaauaaaaacaauaaauaagucaucuuuaauagaaaggaucucuuuaaacugcacugguggucacgccagcaccagcaugcggcugccgugccagcgcaggcuagaaaggacuucagcuucccuagggccuggguuacagaggguugugagcucauucuggguccucugcaagaacagccagcucuccagccccaucauaguuucaggacagucuugcagacuggcauauaauucuccauccuccugccucaggaguccuggagcuaggucaccuccgagcacugcagcugcuuccuccuuagaggccacugcaggccagaaacaggaaguggaggucaggcucagcagcaacuugucacuaacgcccaccuaagcuugugacccuugcugcucgaaaguaagccacaaaaauucaauccccagaaccccccugguggaaguagggaagugacuuguccucugacaagaagacagcuuguccucugaagucgcaugccccucacacacaaauaaauaacuuuguuuuaaaauagguauuuuaaaaagauacaaucuagugccuggcccuaagaggauacaaaggcccacuuguucuuauuugggagccuagguggaacccaaggccucaaguaugcucagcaagcacucuacacaaaguuguaaccacaacccucccuccuuuuuucuuccuggcuuuucaagacaagguuucuguguaguucugacugcccuggaacucacuguguacaacagacuggccucaaacucagagguccaccugcuucugccucccaaaggcugggauuaaagguguacuuaccaccuagcuuccccuuuccuuucugauccucaguuuaccuuucugaaaaauggguuacuacugguagcuccuagauccauccauucuauccucccuguggauaaugaagauuccccaacucagagacucaccagaauguagucagcccacaugucccuagcugacuucaaggcugcuuggcgcaguuucaugacaugcucguagcgggaaucggaccaguguuuggggccuucuucgucuggguaagagcugcaaaggaauagcuauggugugcacauuauagggcaccguggggacccagagagcacaguuacaggggaucauagaggacuucacagagguggcaggcaaguggaucugaagaccucuguguggagcaugggagggggacaggacacaggggccuaaaugccagcccagcaugugcaaggguccagaggcacaaaagcuacuggcaagcugaaacccaaggaaagcucugcauggcuggggagagccuggggccaccguagugccucugagaacaggagcgugagcaugcacacacauuauugcacacuguccuacagguucugagccugaugcaguagugcugggugauucuagcacucaggagacugagacaggaggcuggcaacugccucagucugaacuacacaauaagacaggcuggcaacuggccucagucugaacuauacaguaagacaggcuuaucaggaaguuaaacaggagaguggaugcuggcaagacccuagacacagcaguagguagccaccagacacaaaggaauucagccacaaagguguggcagcuguguccaaaguugcacaauggagugaaggacaacgggacaaaggucugcugagaggauagggaccugguggggaagcugacgauagaacuggagcauucuagauccuaccuucccaagcuucaguacuccagucggggauuugaggcucaccuggguuccucugccggucgccacuccacagagugguauaaacccuucacugccaccagccacucucgaaguauggcugaaguguugucaguguugugaucuguggccacccugugagcacagacaggacaagaugauggcacuggggguuucccaaccuggcucagacccaucagcuauaacacccuggauaaaacucgcuacacuccaagccuguugcccauccaucggugacaggggaguaaagaugacacccagcucacuaguacacaacugaacagaaccugcugguuuggaaagcacauuggugugagacccugucacaaagauaaguucauuaacuuuguuagcguggaaugcuggcccgagccucaggaaucuuaucuggaagucccggaguucgcuauaagggucuggaagcaccagccuggcccauucuaaggagucagagguucuaggaugguagcucgcugugagggcuggcagcaaaucagaacagauuccuaaguaccugaggggaggaggcagcagcuuggggucccaagccgcaguggggacgagcccgggcacuauggauauagagccgagcccccucaagugcguaaucccugggguacauaacucagguccucagaaagaggaccgagucuccgcagcgcacagccgagcccaagugcauagcaaccucccuccgguagagacuugagucccgccuagucccggugcaccgcgcaagggcccgcagcucaccacagcgccgugcgcucccguggguggcgcagcugcuccagggcgcccagcguggcgggcagcgcgggugccgcguuccgcgccagcagcgcgaugagcacgcgcggcgccuguagcggggacucggggcuccagcgcuccucuggaaaguagccguccgcgccgcgcgggccgcccagcggcggcagcaguaggagcaguggcagcagcggcagcccgcgugacccgcguggcaacgccgccaucgcgccacgcgucgccuuuaagcagcuuuucugccgggggacgagggccgcgccuuaaaggagucggcggcgggaaggacacauccaggucccaccccugacacgcuccuuaaagggaaguggcccgcgggucauacugugaguccuggagagaggcaugacaaggcuacgccuuuaaaagcuuccacugcuuuccgccgaccgcaauaacccgg

SEQ ID NO: 4517 - RNA, 14205 nt, Mus musculus
caguguucuccuaacagccuucagaugaagaugcagaacucucagcuccuccugcaccaugccugccuggaugcugcugccaugcucccaccuugaugguaauggacugaaccucugaaccuguaagccugccccaauuaaauguuguccuuauaagacuugccuugaucaugaugucuguucacagcaguaaaacccuaacuaagacacuggcccaucugauaagugcugagaacauggcaccuccugguggcuuuaauuugcucuccuugggguacaggaaggcagggcagcuuugaaaacacaggaguccuuuuucucuggccuggcuucccucaccaggccucccagagccagggagauaggugcuuaucucaggagggugagucccagcagcuggggcagagccuugggugggguguccuugccuguuuauaaugccauugccguuuucaccgaagugacuccaaaaccucaacuaugcagugagugaacauuugucaggcagguccaggcugagucaccugcauucugagcaggagccagaagagguguuuucuguggcagggagcuggagugaguggcaguuaacauggcccccggcagccuuaccugcugcauugccagaacaugguugcccccacaagaucaucccucccgccccugaccugcuccuugucuguggauuuuucugccgugugacacaggugggacguuuguacuagcugcugucacucaacagcagggccucuucaaucauuuuuaugguucacuaauaucccagugcccgugaauagggcugcugugaccucugggugcacucagggaaggauuaccacgucaagggacaauccuggagcucugcccacuguguacugguccagggagccagugucaggaggacucaguuuccgguuuaggagcuuacuucucccuccagcaggcuacuagggccugggacucagaguuaagaccaccaaguuuuugagguaacuucugaggaagggcgugguuggggacgcuccuaggagauuuacaccugauccuggcauuuaggaguuggagggccuaccaacagguuuuaagguccugggaucuucuaagucucugagcucacucuccuccaggcugaauguuuccucaggagaagagggaggagggggggcagcugcagcauuggcugagcuggggggcugggagggaggcaagaggcuacagcaggggcugaaaugaggaaggagggcggagguugaagccugggcugagcugugggagaggcgcugcaguaggggacagacagacagacuugcucaggacaggggagcuccugcucccucucguggcguggaagaggaagauggggcucuaaaugaaggagggguuggagggaguuagacucccaggggagggguaggacuggaggaggaagaggucagguugggaauagagguccacuggaggagguggggguuagggauaaaagugaaugggcauggccaagaaagagggaaggaggguggagacguggaccuucucggguaaaucuggacgcaggguggcgccuagagggaggggaagggccaaaguccagguagaaagacagguggggaagaacaugaccacagugaagaacaggacggggaggggcaagggaaaggaacuagacggggggggggggggggugagggcggaaggagggagacuuucuccuuggcuacuaggaagcucgacucacuggagggaggagcgggaaagggagaacagggaagaagcggaggaaggcgaguagccaagagccagcucaaggcggucgcccagguaaacaguguggccuccgggguugucuggagcccgcgaucgcagugagugccagggucucgggugggguggugcgaaguugaaaucuguggcgcuuucuagcugcaccgugcugaagaugcuccgcagccccggccauacuccugggcuccgggucucuuagacgccgcgaaguagccccgcuacuuuccaggaucagaagcccgcguuuuccccagugucugcacagccggguggccucggcucugacucgguuuccccuguucgaguuugugaaacuuucccuguaugggaguuaggcuguggugaaguaaacugcgaggcguggugguggcagcauaguuaaauugauagucuguauugcuaaccgagguucugacgcuuugggguaaauuucccauucuuuucuuuuuucuccuuuuuuuucugagacugucuuugaacagucuaccuuccuccugagugcuuggucucggguccccacuuucacuuucucauccuggccugucacacucuguggagucaggaggagaaggugcggccgcuuaggggacauuaguuggugcccaucuggucaguguuugcgcagccagcccaggccggaucccuuccccugggcguggcguuuccccucaauagcugagauugcgaagauccuguaggggccccaggagacuacucugcugcccccuccgaggucuggaaccccgcggacuuuuguucccuguccugcguggaggggcgcuggaggcagaagugggugccugguccaagucccugugcuaagcugauccccugccucggguccccucaggaggcgcuaacagcccagcaaggguggggcuggggccggcguguuuacuuuacucuugauuacagggaucuugugucugugacauuuuaucuugauuguaaaaauuaaagagguuauuguaauccugguguaaacgucaccggaagagggacgagagaaugggacccgcuuagaggguagggaucuagggugaccccagacgccaggccuaugaggcugcucugcuaauuggaagggcaaggaaauggccagcaccuucccagccuccguuuccuugucugggaagugggccgggcugggcuuucuuucccgguuggggguggggggcugggggacgcuguguagccucggagaagcugugugaaggcagggcguuaccuccggaaagcuggggugugaaagcagggccaucaagaccugggccuccgaagcuuuaucuuuauaggaacucucuuuuugucgguaaaauuccaaguuccucguaaaaagaaaauugcccaggguuaaggagcuaguacaaaccugaacggagcugccauggggucaguugaucagcucguccuacccagcuaagcgcugggugaccccgggcucagggucacagggacaaacaccaaccuggggaccccacguccagcugggacgcacagaaggaacugucccugaagcacccagcauccuccgcaucccucacucugggagaaugauccagaacgucugagcgugucaguauccacccugaugccucuuugagcacgugucauuccucuaccucaguagccuucugaaggccgcugccaagucagggccaagggcacaagaccguuuccacccagggcagggggagccagggcucaugaauauucauaaagaaauaaccaagcccaucauuaagacucaguguuugaaccacacauaguaaugagcauucuaugggucauuaauaucaagaugaaucucauuaauauuuagcuaaagucauuaauauuccgaugaaguucauuaauagucacagcagcagcgcuaugaaccucggucugugagccaaaagucaggucauuggccaucgaccugugcgugcaugucgacugaugaggcauccaguucaacuuugacacauugauuagccagugccucuucaguauccaauguguccuuccuaugcaauggcucaucaauaugcagugaauaauuaauacgcaacgucucauuaagaagcaacauuuucuuuucuuuucuuucuuuuuuuugugguuuugugugugugugugugugugugugugugugugguuuuuuucgagacagaguuucucuguguagccuuggcuguccuggaacuaucucuguagaccaggcuggucucaaacucagaaauccgccugccucugccucccaagugcugggauuaaaggcaugcgccaccacucccggcagaagaagcaacauuuucuuauguucuguggcucauuaacauuugguuaguuuguuguaauuaaugaccgaauucagcaauauuaacuggucaauaauuaauuguguagccagugucugggaacuguguuuuucagggcaauauugucuaugacaugggucauggcccuuuuccagccuagcacccaggaagaagguuuugugagcaguucucaaacuguuuauuuuuugcuucuuggacaagauagcacagcagcugugagucuugggggcuuaggaacuauucaaauauucaggaauuagucauugggucucugggcacacacccauggcuuuuuaugcuuuuugaguuuugguuuuuguuugucuuuguuuuuuuugggaacaggguuucuuuguguagcccuggcuguccuggaauucacucuauaggccaggcuggccacacagucauagagauccuccugccucugccugcugggacuaaagguauucacuaccaaugcagugggugaggggcaguaagcccagugccuagcacagcucggcaggagcuccaccccugagccaccuccgagccccucacuacaggauucccuuugcccucuuuagccccaucucuccagcagacacuggugauaugaugucuccuugguguaauucccauugccaaugcaggcagcagccaucgcuguacugaugcuggaagcacaaggaaaggccugcuuccucugucuuauuucaacuuccggaacugggaggaagcagcucaaauugcuuccugguacaaacagcccugggcagaacuugucugacagucaggggcagagcagaaucacucugaauccucacaucuguaaccuuguguuucuugacaccaugucccacagugcccugcugauggucggggcauccaggccagcagcauucacucacaggcuacaccccacccacccacacagguucccuccccagugucccuauacaaagccccagagguuucucaucuccccauacauauucuucaagguccccagccaggccagccaccucccucuccuguauguauaacuacuuuauugggguuuuguauaccacucucccaucccugauuccuuccaacacaccaacuccagauaggggagaaagaagguuucaggaaaaagggguguuguucucuuuagacuacuuccugcugaauaggugcaaguccaauucauuuugucaggauaucucaaacuucuuuucaaacugcaacaauagcaaccaggaggaguguucuccuccuccucccccuccuccuccuccuccuccuccuccuccuccucccccuccuccuccuccuccuccuccuccuccuccuccuccaaaccuccaccucucuuucaagcucucuugccccucucuggccucuggcauuuauacccucccccgaguccucagaauugaacuaucugcagcuggcaggaucacgccccugcuggaacacacauaaggcaaauggucagcuuccauggagucugaagcagccccacaucccacccaggauuuaaagaaaaacauguuuucauaacauaacuggguuauuuaagaaaccagacccuaacuacagacuuccacauuggggugugugugugugugugugugugugugugugugugugugugugugugugugugugugagagagagagagagagagagagagagagagagagagagagagagagagagagaagggaucgcucucugcuucccagcaagaggucuagccuaggccuuagguggucucacaggcaaagaagaggucuagccuagguguuaggucaagccuagauaggaggagucucuucccugccuguagcuauuccuuccuuccuuccuuccuuccuuccuuccuuccuuccuuccuugaaagauguguguguguguguguguguacaccauugcuaucuucagacaccccaaaagagggcaucagaucccauuacagaugguugugagccaccaugugguugcugggaauugaacucaggaccucuggaagagcagucagugcucuuaagcacuaagccaucucucuacccccccccuuucuucuuucucucuuuucucucuuuuguccucuuucuuuauuuucaggugcuuuuuguggguuuccccuggguucuccucacaauguuuucucuggcucagcucagcucagcuucuccugacacaauugucaccaacugucuucucuucuuggucugcuagcccucugcccuaucagcugucuucaucucucccucucagucuuucuucucacagcaauguccuucucugauccuacccuccucucagccuuggcuggcauuuuuauuuuuacgcucccuguucccagaauuccaagaggcagucaacauugaaggccauaggguccuuuaaagggccaggcacacaaaauaaaucagcuaaagcugcucaaacuucagaaaaaccugagaguccaauauguacuuaucaagugaaugaaugaaugaaugaaugaaugaacuaaugaaaguauuuccaauccauagcaagggguguggcucauagaaucuguccauagccugggcaaacugugcagcuuaugaaauguuuccuaugcaagguguaguaagacuuuuggaguuuugguuucuuugaaaaacacagaaauauuauauguuuuucauuuuaaucccaggugugggauauagugcuacuucggacuguccacagcagcugacuaugauuugcuucaugcucuagcagaaguguaauuuugcuaguugcagaugauuucugcaauugugugacuacuggaauuguggggacuuuucagaaggugugugucuuaggguuuccauugcugugaagagacaccaugaccacugcaucucucucucucuguguauauauguguauauguguguguguguguguguguguguguauuuuaauagcaaacuuacaggaacagcacagaagauagacacuaaaaacauguacuuguauguaggacaacccaguuagaaaaguacagugaacggauggaaucuacugugugauaaaaaugcuacagacuccauuuaguugcugucaauaagaaguucacuuauuuuuuaaaaaacuaaaugcuggcauuguccagaaaauuuuagcagguuuauuuauaauuguuauagaguagaacuguugaaauguguucacugaagcauuuugcuugcauuaaugcuuuacaucuugcauuuauauuaaaaauucacacacaaaugaacauggagaaacugcuaauaccugauucuguccccuguguuuccacucgcaaucauauacuuagguaccuuugaccccauggaaaaaauaucuaacauucagaacuacugauaacaggaaggagaggaaacaaaauuuuuuugagaaugaaauguuuccccucauaguggacucuuaagcacguucuccgcguaugcggcugugcuagcuggaucucuuuugguguaauuguuacacauuuggcauggauagcacacagauugguaucuucaaaaaagcuaaccagauaggccucacuugacuccuguaaagcaccaauagcugcacucuggaagcgcagaucuguuuugaaguccugagcaauuucuugcaccagacgcugaaaggggagcuuucggaucagaaguucaguggacuucugauagcgucugauuucagagugccacaguaccaggccuguaacgaugagguuucuccaccccuccaguagagggcgcacucuugcgagcggcuuuuguagccaguuguuuccugggugcuuuaccaccgguggauuugagggcaaucugcuuuguacgagccaugguaugggcaccuccuuaguuaccccauuucuccuucggcuggagcuuggcaagcgagagguggugcuggcauuagagagcccacagcaacucuuauaaagggcauuuaauuggggcuggcuuacgguuucagagguuuagucuccaggcagcauccaggcagauguggguccaaaggcagaaaggaaaagacuggcacucaugugguuaggaggagggucccacaaggcuacacuuccuaauaguguuggaccaagcauauucaaaccuccauaguauauaaaugcuuagacccagagaggugggggauggguggugguuguuacuuguuuguuaaguagucgcaagcaaagaagaaauuagcuucuccugauggugaaaaucaaacuugcccccaaggaacuagucacuuuuaagcaucagaaagucuuguaaugauaacaccaccacuuuccccuuucucuuuucuucucugcuaucuaguacuaggggguugaaaggguggagaagguuggaacaaaaacucucacaauguagcaaaaagacagcuacagugaaggauuuuuacaaaucuguaacagucugugcuaagguccuguggcaggagaucgcuggugcuuuugcauaggguucaucuuguuauaccuggagguucagagagguuaagccacugugucagagucacacagcagaacccauggcaaagaaccaggaaaccagccucugugcaggcacuagcgccauggguuugcuugaugccuacagucucaaggacacuuguuaauggcgcacaggguucuagguaccacucaggacagcggauaccccaaaacaaacugagguaagggggaagguucgauagucuuucaacaaacacuuugugugcuaugacuuagggguggcauggugucccugcauuccugcagacaagauugucagugcauguggggcacauagccaggauggggggacaacucugggucccaggggugaaggugugcuccugagugccaacaguguuugaugaaggaguaagaguuugaucuaacacuuguaugcugcagcaacacccuuuaggacuagaacacaccacagacaacacaggccauacacaggaggcugggagccggggagggggggguugcagcucuggggagggcuaacaucagacaagagagccaggccuaaugaaagcucucaucccagcucucaggaccugaggacagcucagguccauccucaucuccagagcaaguuugaggucagccugggcuuccuaaaaucgagaucauuagagcugggagcugacagauuuguaagaguuuaucacaaacaucaaguucugucugccucugccucugugcccaacucaugcugggagaggccacaaugggaccugacgggucaaggcggggcgggggugggguggggcgugaaugagggaagccuggaaaaaacgaucauccaaaauggguuuugagggaggaauaaaaguuuccuggugggacaggcauucacaucuuuagccccagcacucaggggguagaggcaggaggaucucucugaguuugaagaaaacuucgguggggucgaagggccguggggaccagggguggguucaaguucagcgccagucaaugccggcuucggggaggggagcgaggaggcugggucggcgggaacucacagaucugugaccuugcucuaggcuccgcccccacgccaugcggcugccaaggcagagccccuacgagauccuccuccuggucuuggucgccuugcuggugcugcugcugcuccugaccagcaagucaccgcccagcugcucugccccugagagguccaaggagccugaagacaaccccgggugggccacgggccacccacgcacacaccccgcccggugccgagcuaaucuauccguguccucgcaccccgacuucgcggggcugcccuuacacgugcgcgacuucuuguucuaccgccacugccgcgacuucccagugcuccgagagccgcggguuaccaagugcgcggagcccguguuccugcugcucgccaucaaguccucgccugcaaacuaugggcgccgccagaugcugcgcacgacgugggcgcgcgagagacgggugcguggggcgccacugcgccgccucuuccuugugggcucagaccgcgacccacaacaagcacgcaaauacaaccgacugcuggagcuggaagcgcagaaauacggcgacauucuccagugggauuuccaugacuccuucuuuaaccugacgcuuaagcaggugggugagacgugggggaaggcacgggacgugggguuuugaaguaugcauacgagacccacguagagauaucgggagaggggaggguuuacaacagggaggacuucuggugcuuugccagcccacaaacccgcuccugcccccaccccuuccauccguagguccuuuuccuggaguggcagcuaaccuacuguaccaacgccagcuucgugcucaauggggacgacgauguguucgcacacacggacaacauggucaccuaccugcaggaccacgacccggaccaacaccucuucguggggcaccugauccagaacgugggucccauccgggugcccuggagcaaguacuucauccccgcucuggugauggcggaggacagauacccgcccuacugugguggcggcggcuuccugcugucgcguuuuaccguggccgcccuacgucgcgccgcgcgcguccuccccauguucccaaucgacgacguguuccugggcaugugucugcagcagcagggucuggcucccgggacgcacagcggagugcgcacugcggggguuuuccccccuagcccacgugugucauccuucgaccccugcuucuaccgcgaccugcuccucgugcaccgcuuccugcccuucgagaugcugcugaugugggaugcgcugaaccagccccagcuccucugcggcaggcagagccccgccuacugagagguuugggggaguugacauccccuagcucauguccugccucauccacgugcaaagggcuggcuucaaggagaaguucaaagugaggggcagaaaggugggucugaggaguucauagggcaaacuccuaaguacgcuuggaaacccucuugguacuguucacagcaggaacucugagucuagccaacucugaguggcucuaaguggccgcuaagcaaaaacugcuguggacagagcccauggguuuuaggcucugggccuuggccucucucaggcccccaaggaauugggcagaggaacaagguggauuuuaaacugaggugcucagagaucuugacuugacccccacuagugucucccaagaacuuggagaaccacaggggcaggagggguccugugucccacagaccgggcuggcaggaaauaaaguccauagaagguugaacgugauuguagggggaagguuaagauaaaacucagggcucugccacguuuuaauuuuaucuauuuaggaagggagccagguccugucuuccucucuguuuggguccugggacuugaacucaaaucuucaggcuuggcagcaagugccuccauuaacugagucaucucgccagugccuuuuuaguuuucagcacuacucauguuuuaacaccggcugcucuaccccaccucucuuugaccuucaauauuaacucauugcaacauguucacaucuacagcauggcuguauguggcuccugccuccccuugcucccuucccuguagcuacuuuguggguucuuuuucuuccaaaauugcaaccccuccccaacaccagacaggagagaaaaaaguauagaggaaagaaaagagauuacccaauaaagucucagcgcuuggaaaggugguaauguuacuuuuagaccugcuguuacuguuaauccugcugauuccuuggggcaaguuuugaucuucccugucaaaauaucuaguuuuuucuuguccuuguuucuucuucgaggaugacuacuuagcaaaccuccacuaacaagaacaacccacccucugggucccuagcauuuauaaacccucuaaugaguccccagaauuccaaacaucacacaauugcagaagcugcaaaaucgcaucugcuauagcacaaagcaaugcauagucaggugcuggggacuggcagaagcauucccacaccccauaccugggaucaaaaugagaacacuuuccuauaagauuucugguuacuuguuuguuuguuuuuguuuauucaagacaugguuucucuguguagcccuggcugucuuggaacucacuuuguagaccaggcuggccuugaacucaaaaauccaccugccucugccuccugaguacugggauuaaaaguguacaccaccaccgcccgguaauauuucuguuuuuuaaaagaaacccgaauucucauuaugcucccccauucacuuuugagguucuuucccaaaagacaugguggauaccuuguagugaaucucagcgcaucucugcucuccccagcccagcucucgcacccuucauagcuccugaaaccucagcuguagaacagggaaccuuccagaccaaucuggucuccccaccuggcugccucagcccugguugagcucaguucugauccuacacugccuaccaccuuguaguuauuuuguuuguuuguuuuucuuuagacacagggucucauuuguccaggcuggccuugauagccaaggcugacccuuagagccaagaaugaucuuaaacuccuaauccccuugccuccaccucaccagccuaggauaacauuguacaacauaccugguguguuuggugcuucaggagugcuuguacugucuauugugcaccuacuguguacuucacagccuuguaaagagcuccugacacgccuugguugccccaguagauccugguggugccuccggucuggucugugugugaccagagcagagucacauccuccugccccccccuccuuguugcuuuucccaggggggaaaaaaaguaugaaguugcuuuuuuauuuagacuuuuugggacacagggaggaggugggcacaggucaugauggggcuucuuggggacagggccugugguccuugcuuacugcgaucuaugaauaaacuagggauccuccaaggcaaacuggauuguugcaaugacauagccaggagguggggagcaauuaaggacgcaccgccugagcccugugccccuucaguggggacacagacccaacaggucuugcugggugcagccaguaagacagcagcggugcacagcguugguggcggcacugcggcgcuggcgcugagaagccuggagaggaagcugcgggucuagcgcuggguccacgucggccaccagcgcgugcaggagaugucucugcucuagccacugcagcagcuccccuggaacagaagucagcuuaagucccucccccacaccggccagagacauaggagcacacauagagcgccugcugaauaccauguaacucucaccuggugccacacucaccucccaacugcgugugcccauauaccuccugugcaccccaguuuguggccauggaagggugagagucccuagaacugcacgcagucccggguucgcccugugaaccccuggacggcacucucuguuucaggaggggaccauacauuccuacaaucgccacccacggcugugcacagggacacagggaccucuguccucuuccguccucugggccuggagguagaguuccugcccagaauccccagaaagggccauaucccagugaccccagaacugccgaggcaggaggauuccgcgacuuugaaaugacuuuagguugacucuaauaagagucugucuuuaauaaauaauaaaccgagugguggcuuauaaaccgagugguggcuuaugccagucagcuaaguacucaagccuaaguaaggcaaacagcucagcuugacuacauuguaaguuugaauccagccugguccacaugagacccccgucccaaaaauccaaaaauagggaaaaauuaaaaucuaaaaauccaugaggacuccagucuuugcuaucaggagggggcgccaccgugccagcgucucccccucgguuauccacgcguguccaaccgccccgcuuguccccacucacggucccgggucuccacaggcugcguggccucgggcgaccagcgugggccgccgcacacccgcaccagcgugcgcaccaggugguggccgcagagcuuggcgc

SEQ ID NO: 4518 - RNA, 945 nt, Mus musculus
aaaaacauguacuuguauguaggacaacccaguuagaaaaguacagugaacggauggaaucuacugugugauaaaaaugcuacagacuccauuuaguugcugucaauaagaaguucacuuauuuuuuaaaaaacuaaaugcuggcauuguccagaaaauuuuagcagguuuauuuauaauuguuauagaguagaacuguugaaauguguucacugaagcauuuugcuugcauuaaugcuuuacaucuugcauuuauauuaaaaauucacacacaaaugaacauggagaaacugcuaauaccugauucuguccccuguguuuccacucgcaaucauauacuuagguaccuuugaccccauggaaaaaauaucuaacauucagaacuacugauaacaggaaggagaggaaacaaaauuuuuuugagaaugaaauguuuccccucauaguggacucuuaagcacguucuccgcguaugcggcugugcuagcuggaucucuuuugguguaauuguuacacauuuggcauggauagcacacagauugguaucuucaaaaaagcuaaccagauaggccucacuugacuccuguaaagcaccaauagcugcacucuggaagcgcagaucuguuuugaaguccugagcaauuucuugcaccagacgcugaaaggggagcuuucggaucagaaguucaguggacuucugauagcgucugauuucagagugccacaguaccaggccuguaacgaugagguuucuccaccccuccaguagagggcgcacucuugcgagcggcuuuuguagccaguuguuuccugggugcuuuaccaccgguggauuugagggcaaucugcuuuguacgagccaugguaugggcaccuccuuaguuaccccauuucuccuucggcuggagcuuggcaagcgagagguggugcuggcauuagagagcc

SEQ ID NO: 4519 - RNA, 17332 nt, Mus musculus
cauggcggggccagcagcgcgcuccgcagcgcgcggggagggcggggcgcgggucuggagcgcgcagguagcgccgcgagaggcggugaguguccccggcgcggggcuccggugcggggugcggggugcaggacgcgggggcggggugcggggcggggacgcagccuccauccugacccggcccgagcgcaggugccgucugcagaaggcggggcgccacucuauggcaucucucaauccugggcugggaggcugagaccccccccaggacccccaaucccucuuccgggucucuagccuggcccuaagcugggggccgccucccucgcugccccucuuccucgccugggaacgagggucuccuccuuuccuuugcacccgcucuaggguugguaggcugguggggguucuguagggcgagugugguggaauugcgggguaucuggaguauggagcgcgggauccccucccgggggaacggggccuggagaggccuggagccugcaccagggacucccgcgcccuguuaggggggcagccggcaucugcuccaagggacagaauuagucuaggugaaugaggauggggugcagagaaggucggggauggccgccccuccacuugcccucagcgucgcaggaccugcuucauggugaccuugggcaggugacagcaccucccugauccuuagucuccuccucagaauauagagguugaggaagccagacuaucugucucaaauucccaacaccugugccccauuuucuccagauggggaccacaaucuuuagucaaauguuagggcacucugguuuuggcacuuuaaaagggguugagccugguguggucauuacaauccucugguggcugaggcuggaagaucugcagcuugaggccagccugggcuacauucacagacucugccucauuaaaaaagcauaaacaaaacaaaccaugauuuugauugauggauacagucuagccuggggcggagcagcgagaccuaaggccagcagaggacaguuucuaucugaccauaagauggacgggccuccaaucaagacccagacuuugucacuguggucccacccauguggcugcccaggucacacccugacccacauaccaucaccuacaauaggguuccuaggcugguuccugggcggggucccaaguggaaggucaggucuuagucccugccucuugcaggauaguagggugagucccaggcaggaagccugacacccccaaauuugugugcccagacuggacuuaaacugagccuucugugaaguggacugaaagucuguaggaagaucagaggugguugugggagugacagcgcgccguaaacacccacuccuaugauaguaauuaugauauugcauucauuaaauggggucacagccaaggaggcagugagaugucuuugaagggugugaccagugucacuagcaccccaaggacuuggguacacaguggugcucaaaguaugugugacaaaugaaaugacucaguggaaggcuugcacaguggccucaguuucccuguagauuucuggcuggugugggaggggaggcagugagggucacacuagggaucaauggcugugggcacagccagccuguauccaacccccagagugcagcucuggucuagucuugccuggcucaguucccuggugcuguucacccaccuaagccucagguuuuggggacucggugucaggagauggggugcuugcucugugccucugagcagugucugucccuggaccuuauucuaguauuguagagcccagaaagccccagguuacauuagguaaacugucuuaggcuaaaacauuuucagaggccucuauugguguuuuaacuucuuuccaaaucacacgguuuaaaaacacaaaacgaaaccccaagaacaaggggcugagagacgccuuguaguacuuaauauuuacaccacaccaucacccuagcacccagaggaggagacaggaggaucaaaaaugugaggccauccucugcuacauagugaauuuugaggccagccucagcuacuugagaccauuucuaaaaacaaacuuuaaucuguugauccuaaaguaauuguaagaauauuugaguuucccuuucugagggugaggcuucaccugucuucaagccucgguuuccacucaugggcauacugaccuagcgcaggccaagguagacacuuguggcugucugucucucugguaaugaucaugucgccuccagucugcucccucaccucccccauuuguguggcugcccugugacuauggggaggucccagggaugcugggcggggaggugacgguuggguggcaggcagggcgggccaggcuuccuguccucccccagacacagaggccuccaguuagugcuggcggaagugucaggggucauagccucccggugccuaccccauccuucaggggccccaacucucagugcccaucggugaguuugaccccaaucuuugucuccucagagcaggaaguuaucccacagccguggcuccgggucuggggccaacggucggucugucacuuccuggccagguggcagccucugggccuauccuuggcccuacucuucaggcgggaggcccugaucugggugcagguuguggcccaucaagggcugcuggguagagccagauggguggucauggcccugauagcugguaucuagccaggugggguagggaacagcaugaaguaugcccccuaagaguggcuuuuauguuaggguggcgggaagcagggugcugucuaacaugagcucuggggacauugauggcuuccgggagacuguugcccaagaugacgaagacaacugucaucuacccagcguggcccccaggcaugugugcaggagggcuugguucacaggggacauggauuuuacuuauauaaagaucaagcugccacauugguguaggguccuggucccucgggacacuuuaggggguucagauaggcugccugguccuagcuagacaccaggauaagcagggaaagguggguguaaugcuccaaccugucaccccaauacuugggagacugaggcaggaggaugacccugaguuagcagucagccugggauacaggguauggcucugcuuaaaaaaauaaucaaacaaaaaccucccaauauggacauuugcuguuuuccacccuagaguaucagccagucuuacacaagagaggcaugguccaagccaaggcuggaggguguccauuggaaaaugaaaucaucauuugcccaaugcacucauaaucugcugaaggaccccagcugccagaucccuccuguuggaccuaaaauccccagcauccuuccuguaucugggacacauugccucucuaggcuggcccaggggagccugugcccagguccccugcuccccaucagcuccagucaggugcagugacaugcaguugagucccugcagaggcugaggcaggaggacccagaguucuagaccagguugggcuacagagaaaaaaaggggggcagcuaauuucaauguuagguaaacugaagcuaaggguuaagugaguacccucccaguggggcccgggugguccgguccugugguccuguggucaacugccccgucucaucugucgcugggccuccugggcuccagcugucaccacacagcccagcagcucaugaaguauggaugagaacagacaggcuccuaugacagcgagccucccugugcccaggauucuacacauccuucugcugcugcuuggccccaccccuauacaaagugaccugaagucucuagcuaaaccuucucuggguguucugucuccuacagauggagaaacugaggcacagagcugagugaauuggagccaggugagcaguggccucugagcagugguugguauuccuggggccccugaugugggaacugaccgugaugcccaaggggacccugcccucccaggcucaucaugcugagacuguucccacagaaaccaccccauuguuucagucgcaaaauccacugucccuuccugccauuugaccuuggcaaguagcuucuccuuuugggguguaacucaguuucccuacaucugaaauggcccagaaccaucgucuauaauucaguucauccaauaccacucuggccccacaaauccaugcuuuaaaaccccaccugcucccuccccuccagcuccuguccccuucccccugucccaucccagccccauguguuccuguugccuagggcuacaggacuaaggcuggacuugcuccugaucugggcuuucacucccuuagucccuguaacagggaagguguuuggaguuucccuacucaggcccuuaguuauggcccaagcccuccacccuaccucucuuuucagacagacgcaggacagaggccaccaggauguccuauuuuggggaacauuuuuggguaagaccugcuguuucuucuguuuuguucuuugcuaucauuucugugggagcucacaaagggauagaaggacuuuuauggucaaggggagacuaggcagaugaaagacagagguuaaaucacggauugccuugacccuaagcaaggaacagauuaaugcacugagaacucagcccagagcagcauguguguucugagaaucacacaguacagcaguacaaagcuggguguggggguacacaccugggauugcggacugaggaaggcugaggcagaagaauggcagcuucaaaccugccugagcugcagaggaacauguuuccacgauaacaugucagcguaaccuggccucgaaccuggggucaaaucaaauuucccagaucaaggccaacccagccagggaaauuccguguuuauuuccaucuugggaauuugggguuuuuuuaaggaguaaauugacucccuccugaccucugcacccuuggccaucuagguccugcugcaaaccaggucugggaaugagagacucucacaaagcugcaucugagcucugagagagccacuuccauucuuggggaccuagagagccaaccugauccugcagcucaguccaucucagugcaaccuacagcccaguuuguugcagccccgaaggcuacuuuucaggaugugcaaaugccauuacaacaucaggaaauauccugaaucuaucugagaggugugacacuggguggcagucaaggaccgaggucuccuccggguuggucuggccagggaacuggagagccaccaaggauguaggagcagcauggagucagagagacaccaggcucaaaagccccuuccuccuugguaggcccacagcuugcaaagugguagcugguugcuaagcaacccguugccccuagcaacaauccccacucccuccccagcuggagcucuucuuaacuugccucugcuuucuuaaagggcccaccaucccuugccaccugcagggcucaggcuucucccuaagacucauauucucccauggccucugaauggcugagugucccccuggaggugucguccucuggucuacauggaaccucuguccugcagcagcagcccaagagacacccacauuuaggagggguggcaguagcaccucgguggauugucaguguuuuauauuccacgaggugugaaaaacgggggggcgggggagaggagaagucaaugagcaaagagaaaauagaagccaccccaacuucccucccaugcauaccccaagauagcauggcugaaaggggcucagaccguugauucaggaucccacuggcucagagguucucccuaggaaggggcuggccaaccagccucagugugccuaggacaggaaaugaaugaaaguugcaucuuugcacauaggucuguggcugauauauaggaauccuuuucugauuuugcucugcuggggauagaacucagggccucacauguaauagguaggggcucuaccccugagccacacccccagccccucacuggaggauucuaggcagggguuccacucaugagccacaugcccagcuccucacugagagcccaaugcugacugguauuggugugccccaguuccuuugagguaaguccaggucaaaagccuagagagcacugaggagcuacggcagauguguaagcaguagauaucaaaccguguuagaauguccuuuggcugucacccaggaguugugaucagagacacaggcccuagaagucccuccucagacccuugcugccugcccacucuguggagacagaaagugccgagggcuugccaggucugggaacugggccaguggguggcucuguguuagccccagauaaugcccugggcggcagugccuggugcagccucacccaggauccccagcagcagcagguaggcucagugggagcuguguguggagcccucauuauuacccagaaggccugugugucuagcagagugccagacacaucucacucauaaagccauuguguggcagcugcuaccaucaucgccucuauuuuucucacacgacagaauuaaggcucagagaggugcagccacugccccaaguggcccauugcacuucaguuggaagagagaaaauagggaguggaggaacagaccaugaccugucgggaggcuggagcucugcguagcuauggagcuguggaauggucuguagggaagcuggggcggaggggguugggggaggcagaaauacccuaaggacuuuuggggcagcuaauggacaguaggagcuacugauuacaaugacucuaaagugaggaauggugggcuguggcugggacauuugggccugagguugacauggguuugucccucucuuggcuuugguaggaaaagugcuugucauugcuguggcugggacauuugggccugaggcugacauggguuugucccucucuuggcuuugguaggaaaagugcuuguuauugcaagcaucaggauuucauuuuuagaccccagcagccaaguuaaaagcuggcgauaaccccaggacuggggaguuggagggagacggaucucuggggcuuuaauuacggguuucugguucaguaagagacucugacucagaaaaugagauggaggacgauggaggaagacacauuaaguggaccucuggccacacagagacccaggaaguggaggucucaaggaugcuucccucaagccaguggggaaaugcagccugcugauugguuaggucucuccuccaucucuacagucauuuggcuccuuggucuccaaggcuggucuguguugcuaggcaaccuaaaugcccuucucugacuucuacaucuccucucaucccuuacagggcgacaaaaaccauggcuuugagguccucuaccauugugugaagcaggguccuguggccaccaaggagcuggcugacuucauuagggaaaggugagccacacccacucggagacugggugcugggacacgcccaccagagcucucccucaaagcaccuucccugggacuccaggaagggucaagggggcagaucuucugggguucugggaaucaaaugaccuguucaucccaguuccuccaaucccgcaggcccacuucugccuugagaugccuuuguuuaucuuuauuuuacuuucuauuuugaucuuaucuguguagagggucugugugcauggggcaugugaugggcagaggaccugguucucugcuuccaucguguguguucugggguuugaacucaugucacugggcuuggcugcaagcaccuucauccauugagccauugcacugggcugcaugccccuuuuaaaucaugccccaggggucugaugucuccucuacugaaaugaagaucacuacucauagggagaguuaugauucugagugcuagcaucagaagugaaaauauauauauugcuggcacuggggguaguugaagccagagaauuaccaugaguuugaggcccaucuaggccacacacauggccaguuccugugucaaaguaaaauaaaauaaacaacaacaaaaaacagcuaaauaaaauaaaaauauuacuuaaggaaauacaaaauuacccaaaggaaauaauuauccagucaacuuggaacucuuuuuugagagcaagcuguagagaugggaaaacugaggcaggaaaaugccuuucucaggguacuguaaucugcucuuugccccuucucugacccagggccaacaucgaggagacauacucgaaggccauggccaaacucuccaagcuagccagcaacgggacccccaugggguaagugcagcuggaugggugagggacacucaagugaccuuggccugggaccagauggacacaacugccaaguaccauaucagcaaugacggcaguguugugugugaggggccccugggguaucagaugagcuggacucugccuguccccaggaccuuugccccgcucugggaggucuuccguguguccucggacaaacuggcacugugccaccuggagcuuacucggaagcugcacgaucuccuuaaggaugugcugcgcuacggcgaggagcagcucaagacccacaagaagguaaugggcugccccagcagguaugcagggucauuggggcucccgggaccccagaugagcuuguguacacaucuguaacuuaguguguauggaugggcccagaagagcaugcaugagagccacaacccagccucuccggagguuggggggaaauccuaggcaggguuccacccccaagccacacuccuucccugcuugccuccucaucccaccacaguguaaggaggaaguucuaggcacuguggaugcagugcagauguugucaggcgucgggcagcuccugccaaagucucgcgagaauuacuugagccgcuguauggaccuggagaggcugcguagagagaacaccagccagaaggagauggacaagguuuguuagucucgugaccagagagagagagcaagcaugccacaaagugauaggcacuacacuggcagggugguaaagccaccugacugucccccaucuaugguuucuaggcagaaaccaaaagcaagaaggcugccgacagccugcggcgcucuguggauaaauacaacucagcccgagccgacuuugagaucaagaugcuugauucagcccuggugagaagcccgcuccgcucuguagaucucacagucccugcuggggcuccccauccuuggaggagcugucucucagcuguaggagcuuuagagucaugggcugggaagccaagcuauggcuaugguaacacacaccuguuaccuagcaguuaggacucaaggcaagaggaucaggcguucaagauuuuauauauauauauauauauacauacauacacacacacauauguauguauguguguauauauauguauauauauauacacacguauauauacauauauauauauuacaaauguguauauacguguguguguguguaugugugugugugagugugaauuuaagguuagccugggcauucugagaaagaaaguagaaguccuuguuuaaacggauuauauauauggguuuacuaaagugaaaacauccuugaucaaugagugcaguggcaucaggcuggauccaggcauuccaauggugucauuaguuaagaugucaucucugccauuggucacugcuuucuaggaacuccuagccugacagaggauguacugggagguuugugugugugaagcguagaauaucucuaauccagcacggugauuuuucuuuucgugagacaggucucacuauguaggccaggcuguuccaugaacucauaaagacugugacuugcaucaaaaaugcuaagcuucucuaagccaggcagagcagacaggagcugggcugacuggauugguuagcuuggucacaugccccucccaccucagcguuuucaggccauggaggaggcacaucugcagcacaugaaggccuugcugggcuccuaugcgcacucuguggaggacacccaugugcaaauugggcaggugagaacgggccacaaauguaagcugggcaagcgagaggcuccgcccucaugucacaccaccggggccucacccccucaucccccgccccucacacuuuccccuacccaggugcaugaggaauuuaagcagaauguggaaaaugugacgguggacaugcuccucaggaaauuugcagagagcaagggcaccgggcgcgagaagccuggugagugacaucaggacuucucugauccucaguuucuucuuuacaaaaauaggguagugcaguucuaggucccccagaaggcgccugauggcugcucucacauauuggcuuccuagaccugauucccaagggggguuaugaaaggucagcucagagguuuggcuguuucuugccgccuccauaguguaagaaagccauugaaggcacugggcacaaacgucuuuguugagaguuuuauagccagguugggcuugcguccuuucucauuccuugcugugugaccuuagucgcauguccugacucaccugagccaguuccucuuugcugcaguggagaucacaacccccucccugcuggcacgcuguauccccugguccagguggccaggaaagccaagcgcuccuugcugucuuuacauugucagccccaggucugccaugccuaggacccuucucaccccuccauggcuuccauuguggagucugggugcugccgucccuagcagaccugguucuaccccucagacaucuccaucucccccuaccccagggccucuggacuucgaugcauacagcucagcugcccugcaggaaggcaaguacgucugggccuggaugcccaggcuagacccagggugugggagggggaacugaauagagagggaaagaaccauccagaguucagcuacccccuucugucaauagcaaugaaacgucuccguggagccaaggcuuuccgccuuccaggauugagccgucgggagccacgugcaucugugugaggaagugcuccacucuugcccaggcuaccccaaaaauggaaguccccuauaugacucugacccaguaucaucucugccuggguuacuccagaaaaaccugucccaggcuagcccaauaaugccauucuucaggcugaucuagaauucuuccucuaacccaggcugggccaaaagcugcuuggcccauuguagccuuaggcuggccaugaucccuugcauugucaagucuagcucccaccuguucuacuguuugaggcuaucucugacucagcucccucuagauguccgcuacagucucaaagaagccccaaggcccccacuuuauaggcuagcuugaaauaauacgauagagcacccuguaggggcucuggucacucaccccuguuccuuuguccccagugauuuccuggagucugacucaggggugaguacugguggggaggggcagcaggugggugggauuggucuucaaggcccagaaggaggggccaagaggggcccagugcggggcucagaaucaaaucucaccucuguggcccccaugugaagaacugagaacucugcugugccucaguuuucucccuuggauuugccuacauuccuggaauauauucuggguccugagugggcaagaugaagccugacccccaccucuccccaggugccuccagagguagaugacgaaggcuucacugugcgccccgauauaucucagaacaauauccuuuuuggcgacucuguguaccugagagggcuggguauaggcaccuguccugugugcuucaggaugguaaagauauggaggcugagagccggcagugguggugugucccuuaaucuagcauaggagacagaggcaggcagauuucugaaugugaucccagucugugaguuccaggccaaccagggcuauguagagagauucuauuucaaaauaaagacagacaggcaagacagauggacuuuucugggggaaaauccagggcagcauccuggaggaagggcaccaguguugugguuuagugguugggcauacuguacaggaccucugggugggaggaauguggucagauucaggguugguuccuugacagcaacccacauggggcugagcccccacgcuucuccucuagugacucugauuuugacgaugaggagccuagaaaguucuauguucacaucaagcccgcccccacccgcgccguggccugcagcucugaggcugcagcugcccagcucagggccacggcuggcagccucauccucccuccaggcccaggggugaggugggguuguuaacgugugggcacggggguacaacuggaugcagcugcgccuaguguugcuugauucuugauuuuguuccgcagggcaccaugaaacgucauucaucacgugaguagcuggcuggguuuggaagugccuuggagggaacugaguaauuccuugaauggcugugaguuagaguuaguuggagauggcugcugagcugcucgccuuuucuacaaagcagcaucauuacacaacgggaacuggacuggcagcagggccagaccuagagccaagcgggacucaggagcaggggcaggggcaggggcagaggcaggauuuuucagcuagccugggccacacagaugcacggagcuaccgccagcucagucccucugcugaccuugggccuguggcugacaaaugccagcuaugguccuagugggacagaaacucaaggcuuuguccauccuaggggacacuucugggaagccacagagaccucguucggccccacgcacuggcaggugggucucaccgggacaugauggagcaggcagaugggccccaaguccuugccucuagcucccucacccuggccuaagguccagcuauuggacacuuauuaagugccagcuguguacuugugcugugcuggcucugggaagccuguagacaagggucaaaauucuggaugcgcggaugagugggauguggccaugcugcauaggcaggguccugggggaagauguaacuacuaaacccgaaaggccuaggauuugcgggugaagucacgcgcugggaacaggaacagccugugggaagguagcaagcucgaacucgcuccugucgcuguucccaguugcgcagagaagccccuggccucggaggagccacuauccaagagccucuuugggccgccgcuggaguccgccuucgaccacgaugacuucacagguagagggggugugcacagcaggaggggcagaaggccauauuggguggggauuugguuggaaugggagucauggaggcucgacuagggggcagggacagaguggagggucugcggacauuggcggugacaacuaggcauggacuacggugaccucugacugugcccuccuuccuaggcuccagcagccugggcuucacauccagcccgucuccuuucucauccucaucuccggagaauguggaggacucgggccuggauucuccgucacaugcugccccugguccgucaccugaguccugggucccccggccaggcaccccgcagagcccacccaccugcagggcacagcacccugagcccaggggccuaaugccccgugcacccucaccaggucccugggggccugagggaggugcagguaagcuggaacccagcaggugucccaggcaagcugggcacagauggaggccuucauaggggguaccaucugaugaccaagcaaaggcccugaggcaggagggggauguuaaguugguccccaugaggagggggugagcuuaaacaccugugcuggagaaagugcggguggauccuguggccaccaauggauggagaugucauugaagcaggaagccaacucaggcagcuagcuggcaugcaagggaaagaaucugguuccugacagagcuaagggggugggacaucagaguuaccgacagaggcacagcugaugugggggacucugucacucugaagauguaggcuacugaaucaccagaucuguggcuuacccaccuccuaacccaucaguccuuccugguacagacccaguaacagcacccucccuuacccaucugagcacaucuggggccuaggguauuagccagaaacccuugaaacauugucucuucuugaggguuaauacucucaacuccugggagucucaguccagccguguccuuccucuagauucacugacgccggcugaccccaccagggagggccuagcugccacacugagaagaccacgguccaggaaaguguccugcccacucaccaggagcaauggggaccuggugggugauaggcugaugacuccagguugggaagaggccagaagcugccccugcagacagcuuuggguagcucacagccccauucucucuugucuuccagugccggucgcucagcccauccccacugggauccucugcccccaccaucccccccgaucggccuagcuucuccacccagaugggacaugguuuguggggaaccuuggagccucgggccccuucucugucugggauggugucugagugggugaggccugcccugcuucugacccuaaccuucccacaggcaucucccguggccccagcccagugguccugggaucucaggacgcccugcccguggccacagccuucacugaguauguccaugccuauuuccguggccacagccccagguaggcagugauggcaaguguggggucaaccagagggcuuuugugugaggcuagcaauccugaggccauucuaaggaguccaugggcacugagccaaagggacuuguaguagaaacaggucaagggugaacugggggcucugaagcuggcuugcccucccugggguugccauaugcaagaggagacauuagcauuaagccacaaagaagaguagaguguuagacucuacacccaaccuagggaugcucagaacacccaguugauucuagguugggacuccuaguggcccaggagaagaggaucuagggaugguacuuucauuaguacuuaaauguaggcuggguuggagaaauucaucuugccaggcagggaaggaagaguaagaaguuggggagacaaugcugagaauaaucagagccccacaggagcuuuggcugcaaguauaaccaggaggguccagugccaagcggagcccugaucccauacugucccugguuuccuaguugccuggcucgagucaccggggaguuaaccaugaccuucccugcgggcauugugcguguguucaguggcaccccaccaccaccuguccucagcuuccggcuggugaacacggccccuguagaacacuuccagcccaacgcugaccugaucuucaggugccuugcaugggccgugggagagggucccagaugucaguggagccaggggcccagggccuuaaaugccuauagcgcccccugcuaguugcuguguggcauggggcaaguggcuguuccucucuggaccuacuacugcacccacagcagcccagucuggaaugggagagcgucucccgaggggugaggauauucugucccugucucuacagugaccccucccagagugacccggagaccaaagacuucuggcugaauauggcggcgcugacggaggcccuacagcaccaggcugagcagaaccccaccgccuccuacuacaaccuggugcuauugcgguaccagguggggcugcgcgggggcggggcgagggcggguuacauaaauaaugcaaauaauagauagugcuguguccucugagcucuccugcucucugcuggccacucgcgguacugcguaugauacuggugguugcacauugcuuggacuaggcugggggcagcauagcccuugugaccggccguggcuaugucgcccagccaccucugucuuuucguuccuaaguucucccgcccuggaccugagucagugccccugcaaaugagcgcccacuggcagugcgggcccacacucacgcgggucucgguggaguacagcuaccgugcgggcgccacugcuguguccacgccacucacuaauguccagauccuccugcccgugggggagccggugaccagugugcggcugcagccugcggccaccugguaagccacccugcccagcugggaacauacaagccagccaacaagagcccugggauagcugugccacgacacaccccugcacggguggggagacugaggcuuggcugggcauggguuugcaaaggcuacacaguuaacugacugccagagaccucucugucgagucugacccagauuccuugccaccaggaacacagaggaaaagagguucacguggaagcuuccagaugugugugaggcagggggugagucacagcucugaugagggcugcugcgugggagaaaucgcgggugggcagauuguuaaaacuggacauaguucgugggaacugacgaauucuagaggaggguucucaggauacaggaccaccuguauccugagccugugacaaagagccugugacaggagcacauccuggacccguggucuaggcaagggguaugcgaggucugauuuagucgaggcugaccccucaccccguaggcucaggccaccugucagccaguuggcagccgcagucggggcccagcacucccagccccguggccgcacaauucaccagugagggcgccacgcugucuggccuggaccuggagcugcuaggugguggcuaccgcaugucccuggugaagcggagauucgcuacagguaguugcugcccuuuggggcuggagaagcagggugggguggguagucgggagggggagcucacgcaagcccccacgcuguuuuauccccacagggauguaccucgucagcugcugagguuccuagugcuggggacugccugcucuccugccucugccggcucccccaggcuggacuccguggacaggaacacccauuucagccuggcucagccaacuccuccguccacaagcaggcccuggccuuuaguauucuuuaaauaaacaguuuucuaacaaaauaaagaggaauccucuuuccgguucagaccgggaaggauggggaggggggaaggaggagcugauaccuacugugcgguucaucuccagggcugugugagcugccuauuccugcugacacacagcuaggcuacagggagggagaaguagaugaaccccuagaacacugcuucuccacccuccuaaugcugagacccuuuaauauacuuacucauguuguggugaccccccaaccauaaaauuauuucauuucuacuucaua

SEQ ID NO: 4520 - RNA, 42757 nt, Mus musculus
agguuucaauuuuauuaguguuuaaaaaucacauuaauuaauuaauuaacuaauuaauuacggugucuaugagugugguugccuguguguguagugcacacaucggggucagaggacaacuugagagaguagauuuucuccuuuuacauagaucucagggauuaaaaccaaguuuuuaggcuugguggcaagagccuuuaugcacucacuggucuuuuccuguauacacacuggagcauacucuuggaguaauguuuugcuucugacuucaaaggcaaacccuguucaacuccuguaucccagauucccacucauguccccagacauuuguagcacagagauaaaggacauugauggguugcugguuccuccaaccagguuaggacaggaggcuggcagccaggggugaugucacugguguggggacucugguaaaguacacaggugcaggugugcagugggcauggguguccagaagaaucaggggucuucagagacuguccuggguuagaugcaggagcccuuaaaacuggugccauuuggugucuugccuuguuuucaggaugaacauggaaaggcucugucugaugaggacauccgagcggaggcugacaccuucauguuuggagguaagugaguguuccugugaacugugacagagagggcagaugucuaggcauccuggccacaagguugaagacccgggauccuucuauuucuucccuucuguguccuuccugguggggugggaguggggugagucaccucagugcuguccauuuguuggugcugaagcagccuagagaccccagggagcccgucugccuuucaggccaugacaccacggccaguggacuuuccuggauccuguacaaccuggcaagacacccagaauaccaggagcgcugccggcaggaggugcgggagcuccugagggaccgcgagccugaggagauugaaugguaagucaggugcuagagugcuucugagcuccuuuccugcucuuuucucuagugaaaagaugcagaggaaaggagagacgagcagguaugcauuugcaugggguacaaaggcuuugagagaaggaggugaagagggaggagaggaaaugagggagugggagacagaaagaaugugugcaugugugcgugugccugcgugugagcgugcaugugugcauacuuguacaugcgugugugcacuccaguuccugugguggggcugugaugaaucaagauggcagcaacugaggccaguggcaauugacuggaaaagugauguuagugacuuugauuuuaacacaaggguaaucaggagccaggggaaguguucgagcaaaggagaggcaggucaguuguguguaucauaaagguccuuguaggauucuucaagguucuccuuaaucuuucacuuccauauuggccuaacuguacaagucuucagucuuccagaaaaucuuuaacuuaguuuuuuggaguuucuuagacaucaggcaagcuaugugucuuggggaguaccuuuagucccuuuacuugagaaguugagauuaaaaagaucccuugaagcaagacccugcccaucucaaaacacacacacacacacacacacacacacacacacacacacacacacacacacacacauggaagaauggcucuguccuuaagaaugcacagagcccuugcagaggauccugcuuuaguucccagaacccauguugaguuguucacaauugccuauaacucuagcucccaaggauucgauguuaccugcuuccuugggccccugcacagaaauauguguacacauguauauacucacacacacaggcacacauacacaauuuaaaacuuguaaaaaccaaaacaaucaaagaggcauccguagggggugucuuaaaggguuuuacuacuaugaacagauaucauguccaaggcaacucuuauaaggacaacauuuaauuggggcuggcuuacaucuucagagguuuaauccauuaucaucaaggcaggcguggcacaggagaggcugagaguucuacaucuucaucugaagguugcuagaagaauacuggcuuccaggcagcuaggaugagggucuuaaagcccacacccacaaaugacacaccuccaacagggccacaccuucaaauagugccccucccugggucgagcauagacaaaccaucacagagggauacauaaacaaagaaacaaaaagcuagcagcuaggcagucuuuaggaagaugugaugcugggucaucagagugagugguguguucuggaguuuuucagcugcagauuuagcagcaucagguccuaaaauuuuaaauaaucacaacauaccaaaagaagacagauuaaagcuacaucauucacucauuaguuauuaauguuuucccaucgauucugccuagggcuguauauguggcuuggugguagacuacucaccuagaauauacaaggccacaggcuagaucuuuaguaccacaaaaccaaacuaaacugugguaguuugaauaugcuuggcccagagaguggcacucuuagcagguguggccucguuggaggaagugugucauuguaggcaugggcuuuaagacccuugucccagcuuccuacuagcugccuucagaaugagagguagaacucucagcuccuccagugccauagugucuggaugcugccaugcuuccugccauaaugauaacagacugaaccuaugaagcuguaagcaagccccagugaaauguuguccuuauaaguguugccuuagucauggugucucuucacagcaguaaaacccuaacuaagacacaaaccagaaccaaaaccaccaccugcaaugccucucucuguugaaauggcacauucacccuuacaccacaagcggcauuccuuccuuccuuugccucaccuuggcuaguugcauuucuaguguuucuagugcagugaugacaaaaucaaagcuuuagaucucgcuaucuucuuucuacuguuuuguauuuugguuucuuucucuuuuuuuuuucccagaaugaauaauuuuuaugcaacuuguuaaauuaacauuuauuuuuauuuuaaaauuauauauguguaugugugggaguauuuguaugugagugcagagucugcagaggucggaagagugagucagagccuauagaguuaguguacggggcaguugugagcugccuguaguuucugggaauugaacucggguccucuuaaacacugagccagcuguccugaccauuuguuaacuuuuauaccauuggcauuacauuuuuguuuccucaggauaaacauuuuaaagucgccuggcuaaccuuucuuugguacucuuaauuaucugauuuaaaaagcuuucgauuaauuaauaaguuagucauuaagaaugacacaauuaaacuauuagucaguaagcuaaccaacuauuaauuaauaaugaauuuuuuuuuuucagacaagaguaccauuguggcuggacuggaacucauaauccuccugucucugucuuuccauuguugggaauucuguuucuguuuuuguuuuuaaauuacauuaauuaauuaauuaauuaauuaauuaauuaaugucucucuuggagauugaacucauuuucagacuuacugacagcugauuuuccucucugaaccauuuggucagccuguguuuuuccaauucucauguacuucauccaucuuagcacuuaaaacagggagguuucacugggucacagaggaguugaaguucucucauuuuugaucugguuaacuauuccccccccccucagggacgaccuggcccagcugccauuccucaccaugugcauuaaggagagccuacggcugcauccucccgucacugcaaucucccgaugcugcacucaggacauugugcucccagauggucgggucaucccuaaaggugcccgaaacaucagggaggagggaagguucugggcagacaguggauccagguugcagcaguucuucauugcuucauuucccccacaggugucauaagccgaauaaguauuuucgggacacaucacaauccagcuguguggccagacccggaggugcugucccucuuaauucuuuguuauaggcugggauucucaagaggacggucuuuuuguuuguuuguuggcuaaggucucauguagcucaggcuggcuucaacuuaaccuguagccaaggauaaccauaaacuucugauccuccugcuuccacccccucaguguugggaugagaggugugcagaaccacgccugguuuauguggugccugggaugggauccagggcuuugugccugcuagguaauugcucuuucaacuuagcuaccuccccagccccagucauggguuuuaugaagcagggugucagguaucccaggcuagccuggaaguccuuacacaggaguugacccagaacccuugauccuccugccuccugcugcugacagguuugcagccaucaguuuuaugcuggugcugggauggaauccaggguuuacgacuacuccucauugcaucccaggagguagauaaaucaacucugaccuuccaugcacacugaggacucugcucuuggcuacgcuggcaauugguucucacccgccaugauuccauguccccugcaggucuaugaccccuuccgcuuugaugccgacaacgucaagggcaggucaccccuggcuuuuauucccuucucggcugggcccaggugaggcuaggacugaggggcaggggccucgggcugacugugaggacgggggaguugggguuuuuuggagguuagcguuuccucccuaccucccugcacagaauugugcaaagguuugggaaccagggaggggaaggugaagaguccucugugcucagaaucccgcccuggccuuuucggcuauugaucaaggcuuggcucugaggaugucuacguccuugcguggucccagaaaccucagacucgggccagguucuagugcuguguugguccuggguagggucuugggcacagucagaguucccaccccgcccuccugcaggaacugcauaggacagacuuucgccaugagcgagaugaaaguagcucuggcgcugacucugcugcgcuuccgcguucugccggaugacaaggagccccgcaggaagccggagcugauccugcgcgcagaaggcgggcuguggcugaaaguggagccgcucagcgcaggcgcgcagugaucucugagcuggcgugggacucuccuauccauccacccaccugugccuuuccaggaauaaaauuuucuugucaccuugucugagccucaccaaacauccagguuacaugccucaugugagccacagggagccaugaaagguguuugagugguagagggauuuaagggacaugaaaauuaauauugucauucaggaggcaagguacaccugugagcgauaaucuggauaaaucaacugaaguggaaugaucaguccuaauccuuacuguagguggcgccauuacuagguuuggguucuggguugaauuaaaaaaaaaaaaaaaaaaaaaaaagacaagaaagcguggcucagauuagagguggcucuucccaccucaaauguucuaaucaagaaaauugccuuagagaugugccaaacagcuuggguuuuaguuaauuacagauguagucaaaugaaaaccaagaauggccaccauagcuagacuacuaacccuucccaaacauuuccaccaaaugugagagcaaggacaugagcuuaggggucauccucauucaaaucgccacagucccuuaccuuuugaggauguagcauuacagcaacugggcaugcgaauuagucaggauucucuaaagccacaaaacaaugggaugucucuauauauuaagaggauuuauuggaaugacuuacagucuguaguccugagaggccaaaucuuuuaaguuuagacuccauuuuagagaaccugaccuaaguuucaacucaggucaacugacaggcugguaccuagcauuaguuuccaagcugccaccaacaaaacccgagccuagcuccagucucuaggcugauccccacaagaccagcgucuccagguuauucucccaacaaaccuacaaccccagguuacaagcccacucccugcucaaugaucaccaaugcagagggaagcagaaauuagguuuauaauauaguucccaacaccagccaauuguguuaaaggcuacagcagcuuuccaauuagaugcuugcacacuccacccccuugcugcuuacuauuaagccuugccccgauagauauucaaggcuccuccaccaccaaaaccuuccugagugacaauggugcauuggaggggccugagcuagcucgaauagaauaaagacccugcugugaucggcuuaugucuguguuuugggaguucaacccuucccuggcacaacaguccaacuaaccuaacaaugggcagcugugaaugggaagucuaguuguugcucagucccacaaggcuagguguuucagcuggucuucucuauaagcuggagucaugaaguacacuccaacagaugugcuggcaaguaagugcaggcaggcaaagaaggaacgcaggcauaaauauuugcaaccuauuuuuaauaaggguuuaaccucuccuuuagcccaccacccagcauagggagugaaagagaaaaguuacuagaauauggggaaguggaccuguucagcaauaguucuuugggggcaagcuuaaucuucuugggcagcaguucaguccaguagcaaacaccaaauaugacccagcagcagcugcagaccaguccucucggcaggcagacaccaggcacaaaccaccagcuacaguccagcccuuucagcaagcagacaccaggcagcuguaguuuaauccuaaagaaaucgccaggcuugccaacuggcuuaagguaaggccacagaagcaccaagcugccacaggaaccucaggagcgguucuuuggugaguuucucucaauggcagugucaccacaagcugagcucaacaaugcuauguaaagugaacaugugugucuuuggcaaagaacagugaggcagagcaaaccgaaucaaagcucagugcucaucucgcacugucuguggggucauaauuauacuccgucaucaaguguccuuucaugugacugcuauagccaaacauccuuucaccugugugccccagcaaaacaucauuuggcauaacugacuuucuaaagaacuagaaguuuccacuucaaaggaagccucacuuuuccccauuguucuuaugcagacuuccagcagaaggugaggcccagauuaaaggaguguaccaccauaccuggaccuaaauuguucuuuacuuggaauuugcccugucccagggugaccuugaacucagagauaugcuugccuuugucuucagggauuaaaagcaugugccaccuugccugggccuaaacuuuucacggcuucaagauucagaucaaaagucuguguuuucuagccucgagaucuggaucacaggugugcccuccauuucuugauuguaguucauuccagauguagucaaggugacaaugaggaauagccaucgcagcacauaaccaaggaaaagggcaugucaaagccucugcauuagacaggaaagcucacaagggcucaucugggguucauuugcccccaggacagagggcuuuggccaguccagacuguagaggacagauggccccuuccagcucuugcugucccuuuguuggcuccucucaguucuaucugugauuccuucugcccucagagaccugcccauuuccucccugggucucugauguuacaugcuggccaggcauggcugacagcucucauuguaugcccagggccuucaugaaugucaugagggugugccccccacccccccuagcuucaggauucucugucuucaucucuacacagagcauccaggacaaucuugggguagaauggggggggucagagucauuccauuugacuccugagauuuaaaacuagacuacugggaagaaaaauaucaccucugaagagccagggaccuggaagaugcuggcugcaagcauaaacucugcugugugacuggggaagguuaaucccccucucuguucuucagguuccuaaucacauaacaggggguaauagaacacaaucuugaugaguaagcauuuggagcugugccugguacauaguaagcgcucaacaaacagagcuguuguugcuuccacucuugggaagcuuagguggccaucauaagccugacucugcacuuaauaaccucaaaggcaggaucuagcauuugugcuugcugacucagcuaccuugguggcucugcauauagcacacaguuuguaagucaauuuauugcuauuaguauuuuauacaauuauuauucauuuuauuucauuugggagauaguaauuuaacugcuugguauuuuguaauauaaaauauuuuuauaugcauucucauauauuuauguguagggauaaucuuuuugugcacuguguaaaugcugucuuugcuuuauucaaaugcugaaaucuauagcugcaaagaguugauugacuaccauccagauuuugguaacguuauuuuuaugaagcaucaccugccucaguguuucaugaacauucuuuuccauugccuucugauuggucaguaaagagcugaucagccaguuacuggucagaagagaauagggagggacuucugauucuaguggggaggggucccagagagaccagaggagaggagguagagcaggagggagaagggcgagguggccaugaggcagagaauccaggaggaguugugaugaacaggucgccaaggcauucaccaugaggauacacauggagcauaggaagccagggggagacucaaacugcaaguaccauggggccugcggcugggacauaaauagcuuagaggauuacaguaguucagaaccugcccagcuuaggucuccagcuuguuaauaaaaauaccauagccaaacaguagauggagcuuggggacucuuauuaggaggaaggauuucaggcucuuaagggguuaggaauuccacaggaagacuagcagauucaaauaaccuggacccuuggagcucucagagacugaaccaccaaccaaagaacauacacgggcuagcccucaguauaccuacacauguguaacaggugugcagcuuggucuucacaugguucccaaagaacuggaacaggggcuaucucaaaagcuguugccuguaugugggacauguuuuucuagcuaggcugccuuguuuggccucagugggagaggaagcaccuagcccuacagagacuuggugugccagaguggaggaauacacuucucucagaggagaaggggaggagagauguauugugggaagacugaccaggaggcgggcagugaguggauuguaaagugaguaaguaaaacaaaacaaaaugggcuagagagauagcucagugguuaagagcaccgacggcucuuccgaagguccugaguucaaauuccagcaaccacaugguggcucacaaccaucaguaaugagaucugacgcccucuucuggugugucugaagacagcuacaguguacuuauguauaauaauaaauaaaaucuuuaggccagagggucaaucggugcgagcagagguccuaaauucaauucccagcaaccacaugauggcucauaaccaccuguacagcuacaguguaaucauauauauaaaauaaauaaauaaaccuuuaaaacaaaacaaaacaggucucugugucaguuauucccaaccuaaaacagaaaaccuccaaggaauugcauuuacauuuauguauuauaaauacauaauaagguauuauauauuaguauaugucauauaggacuagaauaacaaaaagccuauuacuaaaauuucacaaaaauaagauauauuaaaauaauuguauuuuugagucaucccccaaauaauaguuugcuuacaucuccuaacauccuacuguaggcauuuucuuuuauugaaaauauauuuuucucauacaauauauccugauuacaguuucuccuaccccagcuccuacugguuucucccuaccuccucucccauucggauccaacccauuucuaucucucauuagaaaacaaaugggccaggccgggcagugguggcgcacgccuuuaaucccagcaccugggaggcagaggcagguagauuucugaguuagaggccagccuggucuacaaaguguaguuuccaggauagccagggcuauacagagaaacccugucucgaaaaaccaaaaaaaaaaaaaaaaaaacaaaaaaaaaaaaaagaaagaaagaaagaaagaaagaaagaaagaaagaaagaaagaaaauaaaugggcuguuaagggauaauaauaagauaaaauauaagaagauaaaacaaaaccaauacuuuggaauaggacaaaacaaacagacagaaggaaaagagcccaagaaaggugugagaaacagauauagacucgagagauccacucgcucacacauucaggaauccuguaaaaaccccaaaccagaagccugcaaaaccuguaggcugaaaauaaauaaauaaauaaauaaauaggcagacagacagacagauagauagauaaaaccaauaaaauacaauuuuaaaaagcccugacaugaccucaugagacaaggaaccucuaaagaugccauugaguuugcuuucuguuagccaucuacugcugggcaugcagacuauccauaagagaaguuuguuucccuagugagaagcccuuggagaaaacuaaguuuccacuuacaagugacuaucaauuggagaacagcuucuggguuagggaugggggcauguguacacuucuccucucagcucuaggaccccuucuggugcagaguccugcaggcugugaguccauacgucaaucagaccugccaugcuuagaggacuccaugucguuccuguucuccauucccucugguucuuauacucuuccugucuccucuucagcaggugccuuaagugccugggcuguuuggcuguuggucacucaagcaauguuggguauggguucaaucuuaugaggucggccuuaaaucaaauuugauauugguugguuauugccacaaacuuuuggccaccauuucccuagcauaucuugcaggcaggacagcacuguagaucaaaggguuugcagcugacuugguguuuaugugucucccuugguagcuacagaguaccuucugguaccaagaacacuagccaguaggggugaaggcucuagguaggcaccagguuacuucauuuucaaugaguuaaauagguguuaauuucagcaauagggccuuuuugucaaguugcugcagcuaugggguuugugugugcgugugugcauguguacaguguccaagugccacauauugaaugugauaauuagagggaaacuuucaggagucaauucuuuccuuccacugcggcugaggaauugaaugcagguucucccguuguggcuguguuccuuguugaacuuaagacucuguuuucacucauggaagcauugaauuuccggugcaguuucucucaagacuaggacguuugcccaugcagugcuguugguuaagugacaauuuauacggauuuuugcaugaaauauccaguaagacauaguaauuuuauugaaauuagugccauguaguuaaccuguuaaaacugacuuguugucugccuuugauaucagugauguguuggaagcuuaccaauaagcaauauggcuaggcaugugacaugaaugcuguuaaccaaagggcaaaucacaagcaaaaugccaaaagcaaacuuaauuaaaaaucuaauuauguuugaaauauuguaucauuauuuaucuugugguaauuuaguaaguuuuuuuuaaagaaaacaauuuuuguaacuugauaaauuauaguuuuguuuuuuagaaaaguugcuucuccauguguaacuaggcaacaaacgguguagauaguuuugcaaggcucccggauguuuccaugcagacauaccaucaucagaaacucggcugcuguucugcugccuccucccuuauuuuuuuacugugguaauuuccuaugcaaauaucagagcaugcagcugucuagcuggagaauuuuuugagggaaugagauguuuauauauuaacgacaauuuuuuuuuugaaaauaaaaagugccuaaaagauuaaaaaaaaaaaaaaaaaaaagaaugcagguccucagacuugagcaacaugcugcaaucacuucgaucucacuggucccaggcagcagguuuuguuaguuuguuuuucugagagugguaaguguaucuguaagagcaagauggcaagagagugacagaagccucagcugaguuguugacuuccuuuccuucucagugccccacugcacuccuuagcccuggcugaccuuuccccuccucccucuuuccauuuggcugcugcugcuggugguuaucuccuccuccuucucucuucuucuccuccccuccuccuucuuccucuuuuuccuccuguguuuaugugcguguuugcauguguguauguacaugggugugcaugugcacaggugugcagguuccugaaaaggucagaggaaggcaccagauugccuugggcuggaguuacagauggcugugaacugcaacgggugcuggaaaccaaacucagauugucuggaagaguaguaagugcucuuaaccacucagccacgucuccagcacucuagcaaccuuguuuguuaggauuuaucuccucacugaaccugaacuuuagcagggugacaggcuuccuggucagugguagucagcuuggcagaagugaguauguucuagagacucuuuggcuacaacuauuaaaacggaccccaggaaauugcaauuuucucaugcuggaggaaggcgagccugggacaggcagaggggguggucuucucuccucccagaaagauuuuaauuuuccaaagaugauaguagggcaaugaugggugggaccucaccaugcccaggacugcuuaggugcacaccaucugcccuuucucuacuccacuccagaagauggacuuggagaaguugcuggaucucuuugcuccucuuuccaaugcagccacauugacuaaaucucccuuucugcuuuuuacaguuaauuugacuuuucuaguuggcuuauugaggacagguggcugagcuuggcuuauugggacauaaugaagugagccccagggaucuguuaguuuuuuccugucuagggaugaacauagcugggaugacaagugugucucaccaugcccagccuguuuccugugaguccugggagcaucuagacucucucuccccagacaugucuuucuugcuuucuaacaggcucauugucaucuugccucaggaacuuuccauuugcuguuuccagacaauggcauuuuguacuccaaggcaggcucauauauccuaggcuagcccaaucuuauagcccaggaugaccuugaagucucaauaucccugucucuaccacccaauggcuggggugacaaguaugacucaccaugcagugcuagagauugaaccuagggcuuucugcaugcuagagaagcauucuaccaacugaucucuagaccuagucacuaaaauccauuuugcucauggaauauuggugcucagcugauguuuauuuccuaguuggccuccucuaaucaagacacaaguacuauaaaacaugggccugccugcuuccuucauuuuuguucuguuccuaguuguagccagaucuacagcaaugcccauguccuugugagcauggauacucaaucccugaaccucaaucccuccaaccaugauggcuugcuguguggcuugcugcucagccccugugcugccugagcugcucucaaucuuggaccuagaagccacuuuuugcagcaaguagucagucaauaaagagauggguagcugggcggugguggugcaugccuuuaauccaagcacuugggaggcagaggcaggcagauuucugaguucgaggccagccuggucuacaaagugaguuccaggacagccagggcugcacagagaaacccuguccaaaaaaaaaaaaaaaaaaaaagaaaagaaaagaaaagaaaagaaaagaaaagaaaagaaaagaaaagaaaagaaaagaaaaagagauggguaacugguucaagugcugagucuaagauugagugcucucccuaaacagaacaucugaaguaagccucccacugccagaccucagggcacauuucagaaaaggauaaagaaagaaugaaagagccagaggauggagaagagagcuguggaaugcuaucuuuuagacaggucauggccauugugacuaugcauguacaguagcuguucucaugauugagucaaugccaacauacucaugcguguacagaaauaaacuugauggguuauuaauaaaaaggaaagagauaauguugggaagaggagguguuguagcuguccagccgccacagagaacuggguaccugauagagaggcuggaaaugaaaaaggauaggugggugagagagaaggaugaagccacgacaaaguuuucugaucaaggcucaaaguuuaauauucaguucuguguuuauauagggaaaaaccccagacccauccuuuguuucagcuggauuauguugcaaagcaagcucugcaggcugucugcuucuguaggaaauugcaggugccccaaggcagaagaccuccaccuaaguuggaagacucuacccuaggucaguuaggucaauggaagaccaacuguggcaaacaauuaaggucuguuuagucugcuugaggcugggggaagggcacauuuuccccuuuuuuguuuuuuaaagaugagcugggugguguguguggggggcacaagauuuacuuguuuuccaugauccugucuagggaauagaguggcuaggcggccauaccugucuuaggccuguguuugcuccauuuuacucauccuggagaacacacacagcuuuuuggugucugucucugucuuaggucgauaagagcucaagagcacaguuucccaucucugacuauggaucuucaaaagcacacucuuuccuaagcagaccaaagccaugaaggacauaugaauaggcacucaaugcauuucuucauagcaaugaaugacugccauggugaauagcugagcuugcugaaagcaauccuguaagaagguaaccaaucuguuuaagauacaaaguccaaaaguuaaaagcaacaagauuaaaguuaucugggggaauuuuccagguauucaauuuagcugcuaauuggcaaagaucaaacacaguccggccgccagguauaugggguggggugaggguggcuuugagaauugauagaaaguacuugcucuccaguaagaguggagacuaugcuccagguuuacucagcuggcugauagggauuuugagccaucuucgucauugguaucauucauaaucauuagaaggcucaggaucugcauccgcuugacgaaccaaucuuucaggcagccaucgggcuccauuuucuuuuuugugaaaaaacauagacagaacccugcccccauaguaaaauaggggaggggccauuccauguacuaguuagggggucucaccauuuaaucauggcaucugagcuggaagcgacuggaugcagccaguggcugcagacugaccuuuaguauuagugugcaaaaaauuuaaaacaacacaaaagcaaggugugcuuuuggugaccuuggaggguauaacuccccgucuuuuguuuuuaaaagccaguuuuucagagugcgaugcgcaugcucaacaauuccuuguuccauuggguuauaaggaauuccaguuuuauguucaauaccaaauuccuaacaaaugauguaaaguuguuuccaguauaaacuggcccauuaucugucuugaugacuuuagguaaucccauagcauugaaagcuuguaagaaaugaucaauuacauuucuagaggcuucucccauaugcagagaagcaaaaaggaauccuaaacaagugucaauacagacauguauauauuucaauuuuccaaauccugcauaacgaguuacauccauuugccaaauacgauugggcuuaaggccucauggauuaaacuggagauaauguaaggcaguuagggcauuguuuuacaaucauucuagccugcuccuuagugaucuuaugucagagccuagacuagagagugugugacuagagagaugaaauuuguuaugaucaagucuagccaauguaacagaaucugaaacuaaggcuccuccuauuaaagcccugucagugccaucauugccugcagcuaaagguccaggaugaccagaaugagcguguauaugaccaauauaaaagggauuuuuuuuucagguaagaaugucuuguaguugagaaaacagagauccagcugguguauugaaaugaaauguaagacaacuuuccaauagaggaacagacugagccacauauagacuaucaguaaaaagaugagaaguaucauacacagacugaaaaacauucaguaccgcugucaguucugcuagcugagcugagagcccaggauucucuaugacuacuuguucauuauuuaugagauauccaacuaguccuuuagaggagccaucaguaaaaaucaaaagagcauuauacagaggcuguaaaaaugucauauuaggaaauaccaccuuauguacauuuaaauuuuaucaaccuaucuugaggauaaugauuaucuauaguuccuauacauccuauuugagcaagcaacaaauccaugcugugcugcuucagccaaguauuuugaucuacauuaaauaauguagaucagaauaaugaugucugguucuuugccaaaauaaaucagugccuacuucuuccaaguauaaucaugugggcuacugccucauaauauggcagauauuauguuuaggagauauuccugaauguauccacauaagaggagcuuuuugccauaauaauccuguagguguaugagucauaugaaaagucagcaaauguaaaggcaaagaaugaucuaaauaaguaacaaauuauuuuucaggagcucuuucuacuuguaaggccagcaguccuucagagguuaaauaaagaucaaggggaggaaggaucggcacucccuuuaagaauaucaaagaaguguuucaauucuccuguaguaagcuuuaaauagggguaaagccaauuaauugauaccaccuaacagcuuuugaaaaucauuuaaaguuuuaaaaccguaccuauggauaaguauuuuggggggauaaaugacuugaucugugagucuaaagccuaaauaauuauaaggauccugaguuuguaccuuuucuggagcuauuugcaguccuuuaucagcuaaggccuguuguaaaccucuauaacauaaaagcaaguccugaggaucuuuuuccugcuaacaagacaucaucuguguaaugcaugauguauauccuuggccauugcugucuuaugggcugaauggcuugugccacaaacuuuugacauaagauaggacuauuagccaugcccugaggaagaacuguccauugauaccuuuucauagauucuuuaaaauuaauagaacacugaaagcaaaucuuucacaauccugagggugcaaaggaauaguaaagaaacaaucuuucaaaucuacuacaauuuuauaauauccuuuagaaauggcuacugaagauggaagcccagguuguaaagcuuccauagguagaaugguuucauugaucuuucuuauaucuuguagcaaucuucauuuaccagauuuuuucuugauaacaaauacugcaguauuccaugaugacugagauucucuuauaugcccugccucuaguugcuccugcacaagugaagagguggcuucuaguuuuucuuuagguaaaggccacugaucaacccacacuggaauauuauuaagccauugaauuuuaucaacaugggaugcaggcaagauaguggccauuauggaaaauaccccaagcuucuaguguuagaguggggcuuaggccuuucaaaugucuuaauguuuuguccuuccuuuccuagccccugaccaggcaaaaauccuugucuuagcauuuguuuagucauuacuucauuaggacuacaccuugcaagacccaucugugacaagagaucucuuccccagaggguaauaggcaaauguggcgugacauaggguugaaucuguccugaauugcccuccucaucucuccagguuagaaguuuagaacuuuguuuuguguuuuugacauaaccaaucccuugaaggugagugagaguauuagauaaaggccaaguugauggccaaucuuguccucuaauaauuauuacaucagccccaguaucuauuaaucuuugaaaacuuuuuacuucaauuauuaauuuaagguuagaucucuuacuagaaauagacacacaucagggaaccaaagauacucuguccucuuucacucuuaaugaauuugcaagguagcagauacaugggaacuaaaauaaguugagcgauucuuuugucagcaaguacaguuauaaugccauggggggaagcagacauaauuuuaauuucucccucauaaucauuaucuguuaacaccugaauaaaucugcaauccuuuaauaauaaugcugcuuugaccuaagaguaauccccaggucccuggaggccaaaaacucuuguaggcagcguuugaacucccauuucuggggucaauacugagugggagguggaacugagguccaguccuacacuuccugggguugcucugauaaguuaaaaaaaaauggauuucccuggcuugacagcaagcuucauggccccauaagcugcuugguguggaugucugggguccugaggcuggccccucugcucguuucccaacgugggacagcccugaauaucuguuuuagaucuacauucccuggcccaaugauuauccuucuugcaucgaggacaaauuccuggggugugaccugauuguccgcucaugccccuguuccugggacaauaauuuuuaaaaugacccaaacuuccacauuuaaaacauccuguauucccucguuucugugaaagcaucucuugcacaguggucccuuguaaggcagcagccauagucagacccugauugucugaggguccgauuucugcacaaagaugaauguguccagaugagucugccugugcuuaguauggccugauagaggcuugacauaccacauuagcauucuuauaagccaacuguguaacaaaaggaacuccugcuugaggaacucaaaaaauucugccagcugcuuuuaggagccuauccacaaauuccugaaauaguucaucaggagcuuguuuuuguuuguuuguuuguuuuuguuguuguuuuguuuuucgagacaggguuucucuaugcaauccuggcuguccuggaacucacuuguuugacaccagauagauucccacugagauccccuuuugucgguaauugauuccaagcauggcaggcagacagugcaaucugugaguauacuccuacagguagcccaaucugauuagcauuagcuucauauugacccucuccuagaagcauguuaauaguccaaucugccugccugccugccagccaauguuaccugccugagcauucauuguagcaguucucuuacuugcuucacgccauucagaacuccaaaguaaguaaucuccuccugacaaaguagccuuacaaauaguuuuccucaccuugggacguuaaauuugucuccaucacaguauccaacaaagcuuguguaaagggagcuguaggcccauacugugccacagcuguuuuuaauucuuuuaucacuuugaacuccaacgucugauauuuucugacucuauugcccugcuggucaauuaucucaaucaacuacagggaaagauagcaagcacaucagauguaccuugcccuuccccucgagccugauccacagcucuuucuaguugugauugaguaucucagaaucguugcuuuuuccugccccugauacaugcuugagcuccuguagcucauuagucaacuuaauuccaacucuaacuuauauacuugcauauccaucugggcagcaucuccugcaguagaggucauaggcagagcagaagguauguaaggaggccaauccucaccauauuuggcagccccuuuuucuaaaugagcuuccuccucugaagcuagcucaucaucagugucucuguacuucucugauuuagaguugagagagccuuuuucugaggaagcucucugacaggcaguccuccugaaguucuucaagcaaucccugggaguuagcuaaugccucugaggucucuucaucaacagcaucuuuuauaagugcccagaggcagaggacgauagagucuuccugggugguucucagaacuuguccaauuuucccccagguuuccuuauccaaaguucuuucuucuuaaaaccaugggcagcaugaaucuaucugaucuaaaauguuuucuaacagcugucuuuaaacccugcuccucucaccugaagcagcucuuugaggcugcagacaaaugccuguuuagaauuccccuaucccaucuacacugccaaccccuaggugaauucaacacuucuucaaccuagccuguauccccuuauugcaccuccuacaacaggcuccaaaagaugaaauuuauggcuagcgcuagcauuaaugcuuuuguugcuuaccacugugcaggauucaauuacuucuauuuucuguggauccaucaagacagcguuucucaguugaaaucgccccccaccccaccccggugugcucaguccccucguuugggugccaccuguagcuguccagcagccaaggagaacugggugccugaaagggggcuggaaaugaaaaaggaugggugggugagagaggaugaagccaagacaaaguuuucugauucaaggcucaaaguuuaauacucagcuuuguguuuauauagggaaaacccacagacccaaccuuuguuucagcuggauuauguugcuuugcuucaacuggauuauguugcaaagcaagcucggcaggcaaucugcuucuauaggaaacugcaggugcuacaagguggaagaccuccaccuaggugggaagacuccacccugggucagcuaugccaauggaagaccaacuguggcaaacaauuaaggucuguuuagccugcucaaggcugggggaagggcauaagguguuacaggaauauggggagaguggaagagaggaaaugggagauaaaggucaauuccaucauuucauuguguacauguaugaaauuaucagaaauaaaggaaacauuuaugucacccugcuauuagggaaacagagacguguuggaagaaugaaaucuuucugguucuacuaaccaaugaugaugacaaugacagaagcuggucuguccaucucuccacaguuucagggaauccagucagugucauuccaacacugaccacuagaguguucccuaaaggugucuggauagucagugcuccauuguggaugaacagauuuuuuguuuuuaaaaaaaauuacacacacaaacacacacaccuccaugauguguguguguggagguuagaggacaauuugcuguauucaguucuugucuuucaguaggaguucaguuauugaauucucuuggcagcaagugagccaucuugcuggcuccugaaaaaagcuguccccuucuggguucuagcucuuguccuaagggagaacaucccccccaccccccuuucuggaacuguuuuccucaucugaaaaaaugggugggguguuuucgagccuucacagagugccuuuuccuggugcagaaggccauagcccaggucagaaaguggggauaaagaauccuggaagguucaaaaauaugcugcguaugucuuuccauauuauuuuuauuuuuuuauuuuuugguuuuucgagacaggguaucucugcguagcccagcuuguccuggaacucacuuuguagaccaggcuggccucgaacucagaaauccgccugccucugccucccgagugcugggauuaaaggcguacgccaccacgcccagcuuaugucuuaccauuuuaaagauggugcuggaggacuucauucagcugaagaacaaggcugcaccuaacagggccgcucccuauggggcaaauauuuaaacacaugaaucuauggaggcuauaccuauucaaaccaccccagaaagggaggaugccucccaccauguccugucuucuacgcacugccccccuucucucugcgugucacagagaugcagggacuggcagaugcccaacaugaccuagcuuuuauucccacacucccuacaaaaaucaugaaacagacuuuaagauuuauuggggaguguuggggguggggagcacaaaaggcugcuuccaagugaggaugggaaggagggaguguuggggaacuaaacccagggcuacuaaacuauugaaugacaccccagggaaagucaauuuucaaagcaacauucaugagcaaacagagcuccacacaguggcaguguuggagccaaggauaugcaucugaggcagcauuauagcuaagugaaagcauagcuaagugaaagcauuccccagacauggaugccaauggggcuggagagaggguccaacacuagcucuuacagagcgccuacuuuugguuuucagcacccaugucagguggcauaaagccaccucuaaguucagcuagaggggauccaaugcuauuuuucuggcacuugaacacacauacacucacucucccccauuauaacaaacauacuauuuguguauaaaugaguaaacuuugugcugaaaaaguaaaauuuauauuagaaaagaaacauggaauauauuaaaaugauaaagugcagccauaacuauccagugacaaaaucugguacaacuugcaggcuuucccaucuguguccaaauucccaaugacuuugggaauaaugauaaugacuuugaugagugauugccuaggcuauaauaggcuugggcuuguuccccaacuagcuuuggcuuaauuaacccauuuacuguguucuaaguccugccacauggcuaguucucgcuccucaguucaugugacugucucuaucaucuccuccuguaccugacucuaucccagaaucuacucucccugccacaacucucaccuacuuuuugccuaagcuaauaggccaacagcuuuuuaaauuuuauuuuggacaggugaugcuuccauacaauacauaagagucucuacaaacuggacaauuuucaaagucauuuuuauuuuaaaaaauuaaccacaaaaguacuuaaaauuaugauuaaaugucugcauauuugaacuauauuuuacacuuauuguauacacacgugccacggcacguguggaggucagaaggcaaccuaaagcaguugguccuuuucaccuuuucuaggacuugaacucaagucaucaggguaggcagcaagcuccuuaauccaccaagccaucuugccagcucuugaaauacauuucaauuuacuguaggaucuaacuuuguuaaggugcaauaaauaagaauuugucaacaaggaaaaacacucccauugaauacacacauagccugggaaucuugcagacagcuauggucccacuuagacuggagacugaaaguggaaccagguagguucagauaaacagauauuucagcaugacucacucugcccucaacaaauagauauuaaaaccaccgagaaacgauugcuuaaaacccauaaaugggauugaaagauguaggagcuauggacugggagugugcugcuugcuggacaagggggcagcuguuuuguucuucaacacacugaagcuuuggcuaagaaaaggggaugggguggggaaugcacaugaaggugggagggagaaauguugagugucuugggguagauauaaucaaggcaguaugcacauuugaaauuguagacuaaacaaaaccccaaaaauaccaaccgaauuaugacuaagaaucaaaaguccacaguauacugacacauuuagcacugagcaacugagagaagccacaggacacugucauguuucccaugguggcuggcuucuaggcagcacugggaccaacagguuuuauacuucuuagguucgugagauuuggaaacucauuucauggguuugaaaacauuuguuaacuugguaagaauccagcuauuccauuuacagaguuugggucuguggugguuugcauacguacuaaggcugcaccuuucuuaagacuuucucacacugcuaaaauccaaggugaaaugggagaggccaacagccauagauuuuucucucuucaccaggucuucccacguaugcuagcaaggauggucagaaagcuuucccaaggucucuauguggaaaucaucuucaguaagucuucagagcugaaaugcuuccugauagucuuucaacuuagagaguuuuggcacguccaacuguggcauguacugagacuuuggcacacauacugcauucauaggcucguuuuccagugugaaauuuuuuguuucuuaaugaggagcuagaauguguagagcucuuuuauauauuuaaauuauacuuaaaacuaucccucucuaauuaacuauguguagucaugugucuccgaagacuuuuggaauaugagaacaccuuaccacacuccuuacauucauaggacugccuuuuguguguucucaugugauuuugaauguaacuggaacaacuaaaggcuuucccacauuccuuacauucauagggcuucucuccagugugaguagucucgugguugcguaaggaagaaauguauuuaaaggcuuucccacauuguuuacauucauaaaguuuuucuucguugugacuuuuuuugugguuucgaagggaauagacguagggauaagcuuucccacacacuucacauuuguaaggccaggcuccacugugagucccuaaaugucuucuggcacaguggccagaagugaaugucuuuccgcacugcauacauucauaagguuucucuccagugugaauucgcuugugugcuugaacauggcuggaaugucugaagguuuucccacauugcuuacauucaaaagguuucuccccagugugaguccuuuuaugcaguugaaaagaacaguaucucaugaaugcuuucccgcaguguuuacauucauaaaguuuuucuguuguaugaagccuuuuaugcaugucuagggaacuggcaguccagaacauucuuccacauuccuuacauucagguaucucuccagagugaauuguuuuauguucccuaagggcaacagcauuagggaacgcuucucuacauaccacgcauuuaugccugucuacacugugaguuagcauaugccuuucagcacagugccgguaacugaaggcuuucucacaauacuuacauuuauaugguuucccuccagcgugggucuuuuuauguuuuuuaagggagccaaggcacguaaaggcuuuaucacauacuuuacauucauaguauuucuuuacauauuucugauagucacauggucuguauuuagaguuagauguagugugccucuucagggaugauugacuggcagugugacauucaggaagcuuuggcugggcaaccguuucuccacaugggucacuguuuuuaaggucacagucucucuuuaccaauuggacucuguaaaaauugagaaauacaaccuuaagaguuugcuuauuaaugauuuuauauuugugaguagauauuagauuuacauugggaccauucacaaggcaauauaggcuuuuaugcucugaagggugggcagaugaggaaguccagagugaauauguaaggaggggauaacauucuaagugaauguaugugcugauaugggcauggcugucugacgaauaagaauagcaaugccuugcucugucugaaugcaaauguugacugucuguacaagugaguacuaguguuuccagauaacuguagccuggacugcuaccuccagagacuagcucugugguguacauaacagaagugcucagguucuaguuguugcacagauggugccacuccaucagagugcacgcggcccgcccaccuccagcuuuccuuuacacagcuauccuuuccucaucugccugcggcccagccagggcuccugggcagagccauguagggcuugcuacugaagagaaguuuuaacguaaguggacuuaagggucugaaagacagcuagaccacagcuacuauuauuacuuuuuaagauuuaguuguauguguguguuuuaaaugaugugcauguguuaguuugagugagaaugaguaccagaggcucacauauuugaaugauuggucacuaguuggugcacuguuuaggaaggauuagguguggcuuuguuggagguaugcuacuucgaguagggagggggcuuugaaguuucaaagccugugccagacucagccucccuuucucuaccauguaccuguggaucagacauaagcuuucagcuacugcuuucugcaccaugccuaucugauggcugcugagcuccccacagugaggucauggacucaaccuguaaaacuaaagcaagaccucaaguagauguuuccuuuuuuuaaucaguucuuugauuguggugucuucauagccauaaaauguaacuaaggcagcaguugguaccagggacaggcacugcugugacaaaucugacucuggauuaggaaagugguugcagacuguaaguagggcuuaugaccauccuaguaggagguuggaagacagcugagagaaaguggacuauggaggaccagcucaagauguuucagacaaaacagagacuaagccagagaccauuuuagugauauuuuugcaaagaauaugucucuuuacaguaagugaaaaguaagucaguuuaugugugucuguacaugugugugcacaugcaacaaaggccacaagagggugcugugagcucugaaacuggaggcaguuguuaacugccugauguaggugcuggggaccaaacuugggcacucuuuaaaagcagcaaguaccaaugagcuaucucuagcuaccauggcuaguacugaagcaguauuuaucugaauuaucuuaaaucuuuuauacuuaaagguuucaagggaucaaaauaucuuaagaaaucuuuuauacuuaaagccuucagggaucaaaauuagguugccagguuugcaugguaucuuggccccagcuggaauguuguuccuacauaaaguauucuguagaucucaaauauccacagcacauauaagcauucauuuucagagcuuagaguuuaaaacaaacaaacaaaaaaggucugauuuugugcuauuuuuaauauuuuccugauauccaaugauucucuugagggacacaacuaccucuguggguauucauuaccucaaauuucucccuagacuucugaaauaagcuuccaaaucccagcauucccaguuuaugccuaaaauacagauacagaacaauuaaaaaaaaaaucaaugaacaagaaaaaaaaaguauaacaagauuauuagacguuuagugcaaccauuagauguuuagaggccaacccuggugcacucaucuucauuccaaaucagcacuuagcaacagugagugaagccaggguaucaggcucaccuacagaagucaaauuccuauagguuuccugcaucacaucuccauagagaaucuucugggaaggauccagcaaaguccacucuucuuggguaaagcgcacagccacauccucaaaggucaccgaggccugaaacaucccauacguuacuacagauaaggagacuggcagcagcugauauuucuucuccauugaucucaggcuuagaagauaaugcugacuucagucaguuccaggaccagguaaucagauguacugucugcacuuucucccauacugcaacugugauuuuaagcaacaaauagauuucuguugcucugauaacucugaccaaaagaaacuuaggugaggaaagaauguacaaugguucgaaugaaaauggaagaugugucacuaggaaagcauucacuuggggacuugcuuaaaguuccagaggagucguccauagccaucacuuggaaagccuaugccaguaccagugugcucugcuucaugcuuguggauaaauguaagcuuucagcuacuacuccaguguuaugucugccugccuggcugccugccaccaugcucccugaaaccauggccauggacucacucucugaaacuguaaccauguucccaauuaaucucuguaaguugccuugcucaugguaucucuucacagcaacagaaaaguaacuaagugguuuauuuggcuuacauuuccaggucacaguccaucagugagggaaaccugcacacagacugaagcagggauuuggaacagaaaccacagaggaacaguguuggcucacuugaaggcucauacucagcuagcuuuuuuacauagcccaggacuauuucuccagggaauguuauugcccacagugacaauuggggccuccuauaucaauuaccaaccaagacaauugcucacagacaugaccacaugccagucucaucugagcaaucccucaauugagacucccuuucagaugacuccauacuguaucaaguugacagucaaagcugagaagaacagguacacagaaggcaaugauguauacaguauguacugguaacacagaagcagaggucaggggaugcagggaaccacggaguuggucuagucuaguugcacuaagaagcauguaucguaaguuuuucagguuccaguccaugguuccugggguacaauagguuccaguccaugguuccugggguacaaugugccuucuaguuccugggagagagacauccauacucccucaagcagugaaccguucaggccaguuuguguuucucuguauguucccuuggaagucaaaguguaaaaagucugagggcucucaauaaaauugucacagccucaauguugcugugacccuucuaaucagcccggcuuaauuccucaagaccguaucaugugaccuuggccuuguaaguaagcaugaaugauuagaagaguacaauucacaggaagcaguucuguccuuuuaccacgugggccucagggaucaaacugagaugcuaaggcuuggcaacaagcacuuuugucugccugcacauccaccuggacuuuaacaucuacacaggggcugcagaacuugaccuaauacaaugcuauugucuagggugcugaaggaguuaauacaaauucccaagacaguccccgagcagccaguucaguguucaaccucugauggcaucugagauggcucagugggugauugcugccaagccuggugaccuaagcucaaucccucaaggacacaugguagaaggagagaaaugacuccuguaaauuguucucugaccuccacacaaauggcauggcuaacucccccaaacaaaugcacuuuuuaauaaauaacaaugcauuagcgcuacacaaccacuaugagauuaaguuuuaacuauugccaucauggaaagcuauacauaugaauuaauguauuaacuauucuacaguguaugcauauucccaaguaugcuuuagcuuauaacuauauucaaaugucaguucaaucuuauacaaacagccuccaucucuuggccuaccaccugaucucaaaauuauagaaauacuuuaaaauauaacuacaaaacaagaagaagagguagcucuugaauaagaacacuugaugcacuugcagaggacccaaguucagcccccagcauccauuucagauaauuuagagccacuuguaacuccauuccaggggauccaaugcccucuucugcccuccaaggccacuuguauacacauggcacacagaaacaaauaaaagccaaucauuucaaaggugauaagcuccuucaugauccugcagcuugcagcuguggcucucccaccaugaugaacuggaaauuggaacugagcugaaauaaacccccuuuccuuuaaaaaaaaaaaaaaagcaaggagaaacauguacuucuagcacuaacugcaaaggaggauggacuaccuaaauuaacugcagacuaaguaugcagaagcuugaggaaaacuacaagagaugaaacaaugcuaaggcaguuagcuguccaugaaauugcaaacccuuagggguacguuucuaaacaggguuaucuuaacaacacagcagagugguggguaacagugagcgggaauggcucugcuccuaagagcacuugcuguuuuuccagaggacgcaaggcaauuugcaguguucagacugggugggucacaaccucuuauaauuccaaaguaucuagcaucccuuucuggccuuccuaggcaaugcaccuacguauaaaacagacagacagacagacagacagacagacagacagacaggcacgcacacacacacacacacacacacacacacagggagagaauuaaaauaaaacuaaucuuuaaaaagaacucucccagauucuauaaacuauauagaccauggcagaugcaaaaccaggagaacaggaaacagaaggaaaauccuauucuuugaaaagauggaugagauuaauaaaauucaacuagucaaacuaaaaaaaugagagaagguggaugaaaaggcucagcagguaaaggugcuuacagccaagccugaugacuugaauucaaucccugcgacccauaguggaaaauaaaaacugauuucuaaauguucucugaccuccucguguacuccauggcauaugugcacacacagaugcacacacaaaaauaaaagacagucuagaaauaaccaauccaugauaaaagacaauccaguggacaugaucucauggaaauuaaaggaaccacaaaguaauauuaugaacaauuccaggcccacauauuuaauaacuugauuguaauuaaccaauccucagaaagaaacaauauacuaaaauugagauuaguagagguaauauuaauaggaugaaugaggcucaaagccagucaagguguaugaggccccuauuggcuccaguccuuacuauuuuucccaccaaagauccaaccaauaaaaccaaaauuuuacaucauaccacgaaauagaauggucuuauuuuagaggcaagguuucauuauguaauucaaguaguccuagaacuuacuaugugcccaggcuggccuuaaacccucaucucacccuucugaaugcugggauuacaggcauguucaaggccugacaaggauaacaaauucucaccugcugacuaaaacaaaaguucuacagaggaaauucacccaggaaagcagcuggugucacuuucaguucacaaaggagcccauauucugaagguuagaauaucuggccccacugguacuuggaaccccgcugaaagggucaugagagcaagccuggggacuuggugcuaccacagaugaaccugaggcaggugagagggcucagcagguaaagcugcugcuuaucacugucgcuccccgcccccugcagacaacaaauuaaggguguagguggguggagagagagcucagcaguuaaaagcacuuguucuuuuagguaaccuggguucgauucccagaacccaugugauggcucacgacuaccuccagcuccaggggauccauuggucuucagaacucugugagauuuaggcaugcaccugguguauguacaugcaugcauacagaccaaacacauaaaauagagauaagucuuaaagagauagaaaagaagggagggggaaagagaggaggaaggaggggagagagacuggcuggagagaugcuuagcaguuagcauucagaccucuugcaaaggaccuaugcuugguuucuggcaaccacauggcagcucacaacuaucuguaaguacaacuccaggggaucugaugugcuauucuggccuugggagacaccaggcauguaaaugaugccuauauauacaugcagacaaacauucauacacauaagaagaaaggggcuagagagaugguucggcacuugagagcacucuuguagaggacccaggucaguuuccagcacucauaacaggugccucacaacugccuguaauuucagcucuaaggguucuaacacccucuucuagacucugugggcaccucucaacuugguuuuuccuauaaaaagccuuccauaagaacagauugguacaauuaggcucuggaguccuuuuuuguggucuugaucgaucaggguguguguucgauacacuauuuuugcuuaacugagaucuguguguauaugguuugugugccaauuccugaacccuaacaacaaccaucaauaacuccaauuccaggggauccaauguccucuuuuggccuguugguaccagagugcaaguaugcacacaagcacaaccaguauguguguagcugacuuacuucagugcaggcuucccuuccuccaugccuuucaaguaaggucaagaccuccauucaucacuuuauuuucauauuuauuguuguuguuuugagacaguucucugaguagcccuggcuguccucgaacuuggaaauugacccucugcacucauccucgcuccuccaccagugcuuggauuaaaggcuuguaccaccacugcccagcuuaucuaucuaucuaucuaucuaucuaucuaucuaucuaucuaucuaucuaucuaucuaucuaccuaccuaccuaccuaccuaccuaccuaccuaccuaccuaccuaccuaccuaguuguuauugagacaauuuccauguaacucagacugguccuaagcagccaaaggguggcuuuggacuccugacccuccugcuucuacuuccuaguagugagaucacacucaggccaugccuuuccccuguguuuugcuggccaaggucucauguaacccagggugcccuugaacuucaucuguuggccucugcuuccccaaugcacucuuccccuuuuacuuuaacaaauuuuacauguauggguguuuugccugcacaugucuucuaugugucauaugcaugcuugguaccugcagaugccagaaagaguuacagacaguugugagccaccauauaucaauguguaauuugaagauggugccuuauguagcuaaugcucagucuggccuugaauucuugaucuuucugccuuuacuucccaaagugcugggaucauagaccuaagcuaccaugccugccacucacauacaaaagaagacaaggagagacuggagagaagagcuggcacaucagauaagagcauuuacagcucuuacacaucccaguucccacaccgagugguucaaaacugucucuaaugccagauccaagggaaucugacacccuuggccucuacaggcacuugcacucaugugcacagagagacauucaaacucauacacauaauuacaauaaaauaaugacagcaaggaugugaagggauuucuugaggagaagagggauggagagaagagggugacuauaaugauggagugggagagaugccucagaagguaggaggacuucugcuacguaauuauuggaacaggaguuuggacccaacaaaagcuaaacaagaaaauguuucuuaaauuccggugugcaccuccacuggaaccuguggcauauaggugagauggcuucccucccccuggccuccacagacuacccguuucucaggaggucugccauaaccaggaacacaaggaaacaggaagacugcccuaaccaaagacagcacuaccuaccucucaggaggucugcuccaguccaaaccauccaggccaauuaacuccagagauaaccagauggcaaaaggcaagugagagaauauaauuuggcacuaucagaacccaguucuccuacuaaagcaagcccuggauacccuaacacauuugaagagcaugauucuaaccuaaaaaucucaucucaugaaaaugauagacaccuuuaaggaagauaugaauaacucucuuaaagaaauacaggaaaacacaggcaaacagaagaccuuaaagaggaaacaaauaaaucccuuaaaaaauacaggaaaauguaauuaaacugaugaaagaauugaacaaaacugucugauaccuaaaaaauagaaacaauaaagaaaucacaaauggaggcaacccuggagauggaaaaucuacaaaagagaucaggaguuacagauguaagcaucacaacauaauauaagagauagaagagagaaucucaggcauggaagauaccauagaagauauugacacaauugucaaagaaaauacaaaguccaaaaaacucguaacucaaaacauccaggaaauucaggacaugaugaaaagaucaaaccugagaauaauaggaacagaagagggugaagauucccagcuuaaagggccagaaaacaucuucaacaaaaccauagaagaaaacuucccuaaccuaaaaagagggccauaaacauaaaagaagccuacagaacaccaaacagauuggcccagaaaagaaaauccuccugccauauaauaauaaaaccacuaaauguacagaacaaagaaagaauauuaaaaucuguaagggaaaaaggccaaguaaaauauaaagacagaccuaucagaaucacacaagacuuuuuuuuuuauauuggcuauuuuauuauuaacaauucaaauaugauccccuuucccaguuuauccuccagaacccccuauaccauacacccucccccugcuucuauauaagagugcuaccccacacacccacccacucccaccucacugcccuggcauuccccuacacuggggaaucgagccuucacaggaccaagggucuuuccucccacugacuccagacaaugccauccucugcuacauauguggcuagagccaugggucccuccauguguacucuuugguuaguauuuuagucccugggagcucuggggggucugguugguugauauuguuguuuuuucuauaggguugcaaaccucuucagcuccuuuagcccuuucucuaacuccuccacuggggucuccaugcucaguccaaugguuggcugugagcaucugccccuguauuugucagguucuggcagaaccucucaggaaacaguuguaacaggcuccugucaacaagcacuucuuggcaucugcaauagugucugaguuugguauaugggauggauccccaggugagguggggcagucucuggauggccuuuccuucagucucugcuccacauuuugcccccauauuuccuuuagacaggagcaauucuggguuaaaaaauuggagaugaguggguggccccauccccccagcugggggccuugacuaaccucuggauauggucucuacagguucucccucaccagacuucuaaagagagaugcuaaaagccagaagaucugggacagaugucaugcagacccuaagagauggcauaugccagcccaggguauuauacccaggaaaacucucagucaccaaagauggagaaaccaagauauuccaugacaaaaccaaauuuaaacaauaucuuucuacuaauccagccauacaccagauacuagaaggaaaacuucaacauaaggaggguaauuacacccaaggaaacacaagaaauuaaucauuucacaacaacaaaaaaagaagagacucacauacccauaauaucaccuccaacaacaaaaauaacaggaacuaaccaucacuggucuuuaguaucucucaacaucaauggacucaauucuccaauaaagagacacaggauaacagacuggauaugcaaacaggauucauuacuuugcugcaucaaaaaaaaaaaaaaaaaaaaaaaaaaacauuucugccacaaagacagacacuaccucaaauuaaaagccuggaaaaaaguuuuccaagaaauguucccaagaaacaagcuggaguugccauuuuaauacccaauaaaauagccuugaaccaaaagagauagggaaggacacuucauauuuaaaguaaaaauccaccgggaugaacucucaacucugaacaucuauaccgacaaaugcaagggcacucacagucauaaaagaaacuuuacuaaagcucaaaacacacauugaaccucacacaauaauagugggggauuucaauaacccacucucaccaauggagagaucacugaaacagaaacuaaacagagccgggcacuugggaggcagaggcaggcggauuucugaguuugaggccagccuggucuacagagugaguuccaggacagccagggcuacacagagaaacccuaucuugaaaaaccaaaaaaaaaaaaaaaaaaaaaaaaaaaaaaaaaaaaaagaaaagaaaagaaacuaaacagagaaacuucagugaaacuaacagaaguuaugaaccaaauggauuuaacagauaucuaccgaacaguucaccccaaaacaaaagaauacaccuucuucucuguaccucauggaaccuuuucuaaaacugaccauauaauuggacacaaaacaagccucaacaaauacaagaagauugaaauaaucccaugcauccuaucagaucaccauggacuaaggcuguaucaauuacaacaaaaacaacagaaaguccucagaugcauggaaacugaacaacuuuuuacucaaacucugggucagggaagaaauaaagaaagaaaugaaauacuuucuagaaauuaaugaaaaugaaggcacagcauauccaaacucauggaacacaaugaaaacagugcuaagaggaaaauucauaguacuaagcaccuaccuaaagaaauugggaagauccuauacuagcaacuuaacagcacaccugaaaguccuagaacaaaaagaagcaagcacauccaagaggaggagaaguuaaccaauuagaaacaaagaaaacaauaaaaagaaucaacaaaacugcuucuuggaaaugaugauuuucuagacagauacuacauaccaagguuaaaucaagaucagguaaacuaaacaaccccacaaccccuaaggaaauagaagucauuaaaaccucccaacaaaaaaaagcccaggaccagaugguuuuaguacagaauucuaccagaacuucaaagaagagcuaauacuaauacuccucaaauuauuccacaaacuagaaacagaaggaccacuaccuaaaucauucuaugaagccacaauuacucugauacuuaaaccacacaaagacccaacaaaggaagagacuuucagacuaauuucacuuaugaauauugaugcaaaaauacucaauaaaauucuagcaaacugaacccaagaacacaucaaaaaaaucauuauucaccaugcucaaguaggcuucauccuagggaugcagggauaguucaauauaaaaagaaaauccaugaacguaauccacuauauaaacaaacucaaagaaaauaauugcaugaucaucucaugagaugcugaaaaagccuuugacaaaauacaacaccccuucauguuuaaagucuuggagagaucaggaauucauugcacauaccuagacauaauaaaagcaauauacagcaacagccaacaucaaauuaaauggagagaaacuugaagcaagcccacuaaaaucagggacaaggauggccacucucccccuaucuauucaauauaguacuugaaauucuagcuagagcaauuagaaaacaaaaggauaucaaggggauacaaauuggaaaggaagaagucaagguuucacuauuugugaaugauaugauaguauacauaugugacccccaaaauucuaccagagaauuucuauacugauaaccaacuucggcaaaguggcuagauauaaaauuaacucuaacaaaucagcagcauuucuuucauacaaacaagcugagaaagaaauuagggaaacaacauccuucacaauagccaaaauaauaaaaaauaucuugguaguauaaauucuugcuuguaggacaagaacuucaaguuccugaagaagucaaagacucagaagauggaaagagcuuccaugcucauggaucaguaggauuaacauagugaaaauagucaucuuaucaaaaguaaucuacacggacaaugcaaugcuccaucaaacuucaacccaauucuucagacauggaaaaagcaauucucaacuucauauggaaaaccaaaaaacccaggauagccaaagcaauucucaacaauuaaagagcuucuaggggaaucacuaccccugaccucaagcuguacuauagagcaauacugauaaaaaccacauggugcuuguacagagauagacaggccaaucaauggaauagaacugaagaaucagaaauaaacccacauaccuacggucaccugaucuuuaacaaagaagccaaaaccaaacaguggaaaaaggaaagcacauuaucaaauggugcuggucuaacugguggugugcacguagaagaaugcaaauagacucauauuuaucacuuuacacaaagcucaaguccaaguguaucaaggaccuccacauaaaacccgauacauugaaucuaauagaagagaaagugggaaauagacucaaacacauuggcacagggggaaauuuccugaacggcacaccaaaggcucacaccaaaggcucgggcucuaagaauaacaauugacaaaugcaaccucaugaaucuaaaaagcgccgggugucggugcacgccuuuaaucccagcacuugggaggcagaggcagggggauuucugagucugaggccaggcuggucuacagagugagcuccaggacagccagggauacacagagaaacccugucucgaaaaacaucgacaacaacaaaaacaaaaaaacaaaacauaaugaaucuaaacagcuucuguaaggcaaaggacacugucaauaggacaaaucagcaaccuacagauugggaaaaaaaaucuucaguaacccuucaucugauagagggcuaauaucuaaaauauauaaagaacucaagaaguuagacuacaaaaaaacaaauaacccaguuaaaaauugggguauaaagcuaaacagaauucucaacagaggauucucaaauggccgagaagcacuuaaagaaauguucaacauucuuagugaucagggaaaugcaaaucaaagcgauccugagauuccaccuuacacugaucaguauggcuaagaucaaaacucagaugacaauacaugcuggagaguacauggagaaagagguauacuccuccauugcuggugggaccgcaaucugguacauuuggaauguaaauaaauacaauaauuuaauaaaaaaaauauuuaaaaaagaacauuuuuuuaaauugaagguucugagaacuuuaacccagccccaggcugaggucacauauagccccuauuuuauagguacccuaagaucagagaaugaggugauuagggcucaccagcuuucagucuagcagagaaagugugagccccagauacugccuguugccaagugcuugaguagaagcccagugcugggcaccuggggaucuaaggaggccuggaauuuucuaggguucagguaccagcuuucugguaauuccagagaacuaaaguucccaagaggaagaggagcgggagggaaggagggagagggaagaggagagggggagagggggagagggggagagggggagagggggagagggggcgagggagggaaggagggaaggagggagggagggagggagggagggagagagagagggagggagggagggagggagagagagagggagagaggaagagagggggagagggagggagggagggagggagagaggacaggaaucuauguuaaggauuuuugaggccaaaaugacugcuuaccuugaagaucauugacuacaccuuuaacacuggcaccugggagucagaggaaggagaaucucugaagucccaggcuagucugcucuacgaguucugaaagacccacaaugugaggacucccccacguucugacucaggagaaacagucuugcugcaaacugcaagaggacuuuuaauucaagagugcucucgggcccacggucauacaccauacauggguagaggaccguggcgccccccaaguagcuggguaaggggguauuuaaaggaagaaaccacaacucaaggagaugcggagggcguuguuggaaaauaccaaaaauacuaguuaagagucacaagggaguacaaaguuacaagucacgaggaauaccugguaauugugcgaguuauuucucaagacaguuucuaagagccccuaacaauagcacauuugcauagccgguuccagcaggucagggugggucaggaugacuuucuuugaaugaacacuccuugaacccaggaagcggguggauggaggaaugucguuaucuguuuuaugauuagcauaccuuggagcauugagucacagaggucgcauucucaagccugggccuaaaggucuagaauuuugcuuuugaguuauacuuuuucaguucuagggccacauagugagaccaucuuaaggggcuggagagaugacucagugguuaagagcgcacguuacuuuucuagagguccucgguucaguucccauguccccacauggguccacucaaaagauuauggagaguuuaaauuauugagggcuguuuuuuggccccuugaaauuauuaaaaaauccuacaauucuuagucaaccacuagcuuacaucaaacccagaauaucugagaauguuacauacagcaucagaaaacuccaggacugaguucacacuugcuuuaaaccugaggcccacugacaccuuugauaaacacuuccugacucuuguuccuuuuuuuuuuuuuuuuaaaguauuuucaaggugggguuucucuguguaacccuagcuguucuggaacucacucuguagacuaggcuggccucacaaucaguaucugucugcuucugccucuuuagugcugggauuaaaggccuccaccaccacucauguguccacagcgagacauagaggguuguuuggggguuccagucauggccacucaauaaacuaugccugucuuccuuguugagcuguguuuuuucugcuaauaugcucuguauuauuuauucuucgauugcucucaaagugucacuucuguugugggacuggguccuuguuucuguccacaagcaagacagcuguuacaggguccagacacaaguuaugaaguaguacuggucaguuggggguuacagugggccucuuacccccaccucuucuguuugugguguaccaggaaaaggagaaaccuacaguaacugaagguaaauuuuuccaagaagaugugauuuuuuuuuguuguuguugggggacaaaagcucauauauauguugcuuuucucgaauccuagaaacacauggucccaccagguuugugcccuucccccagccuugagcaggcuaaagcagaccuuguuugccacugcuggcuagcccaacugggguagggucuucugaccuaggugaagcugcagcugcagcuuccugcaagaagccacuaccagcugagccuguuuuccugaugagauccuggcaaagugggggauggguuuccucccuuuaaaaaccagacucaagaauuaaacacugggccuugcucagaaacucugucuuuguuucauuccucucucgucuguccuucgcauccagccccagcuuucuuuucaggaacccaguucuccgcggcugcugguggcuauacaggguugggaauauucacauaggaaaugcaauuuuauaaaaaguaguaaaggaaaaagaaagaaggggcuagugggaugguucagcugaaaaggcgcuugcugccaagccuuagacuggcguucuccagguuccacaagguggaaggagagaccagacucagauuacugccccaugggcaccucgauaaauaaguguaaauuuaaaacaucaaaaagaacacaagccgggcgugguggcgcacgccuuuaaucccagcacuugggaggcagaggcaggcggauuucugaguucgaggccagccuggucuacaaagugaguuccaggacagccagggcuacacagagaaacccugucucgaaaaaacaaaacaaacaaacaaaaaaaaaaaacaccccacaaaaccagcccaaagagcaaauuaacuccguggggacccuacauaguccuuuccauuuuaccccugaacacaagcauacaugauccccuuuuacauugcgguucggcugcgggcucuggaaaagggcaccagagucgguuugcaaacucucggcaagucccgagcuuccgacugcgcagagcccgccacuccucugcccuccgcucccacccgcgucucugagaugcacucaccauggugcacucucgucuugccugagcugcgcuguggcgggugucacugccgcguaccuugcgcauugcuaagccgccaaggacagcgccgaaaauggcggcgcccggccuccgagaggcuucc

SEQ ID NO: 4521 - RNA, 17916 nt, Mus musculus
acauuauuuaugcaaaaauuuauuugaccaaaauguagaaaaagugauacuauuacguaugauacaauagcaagaacauaaagaacagaguagauuuuaucaauugcaguuugcucaaaguucaucucccugguagugugaugcuuaauaaauaggagugaggggcaggguucagauaagcuagaagcagggugacuuucagucaggacuguaaacuugaguuggccccgcacugcuggggaauguggaauguuucagugugagauguuaacugagaaaggaaaacuacaaagccaaaaaaugugcagccuacagagcacuccacauccaguucaaucaggaggucuuggucuuuuauuagugucauucccgaaggaauucaagucuuggcaaagucaagcuuccauuuguuguucccugaacaauggagaugaaguuaagccaauuucuuuuucuaucacuacuuugcugcuggagagaccuuuuguugcccaacacuugguauuaguacaaugcucaauguauugaaggcaacuaagccuuuuuauuauuugagacagaguuucgccguauagcccuggcugaaaaggguuggacucugccauauucccugcuggguauaucauuagaccacagcagaaaaguccuggaauaagacgcuugcuccucagagaacaauucuggagugaaggaaagauguaacauggaacagcauuaaagcucagucagaaggcacaugggcaacaaugaucaccccagcauucucgcuuggaaugcuuaaagacaaucuguucugcacagggccguguggagcagacucaguaugaucaggcuaaucuaguugugcuuuauaacuucccauaggagacuuaauuuuugcucuggguggaaaauuuccacauauuuucuugugacaaccccuagccucacaaaacuuccccaacagcaaccagcuaagauuagauacuugagccugugcuucaaaguguggggcugacuaauucccaagaaccaaaugcccucagacuuaagcaacuauacucagugugaaauucccugccuauuuuaggaauaaaugcaauuuaagaauaagaauaaucagagaagcuggugccauuugaauggaaaaggaaagaauuaaacuuaacuggugcucaaagcuugucuaacacaaaauauuuggucaugaauucauuaucugcuuggcauuuccugcaagguggaaaccugguaauaagcggaacuucuuacaaaagaggaagacagggcacacucucuggaguggaguugguguuaaaacaguacucuucugguuuaguuuauauacaguuaaguucguuuagugucugguccagugucugauguaagcccacauucucuucuuuggccugggcaaguuuuucugguaaagauuaagacaggaaaaaugaauuaauaagcaucuuuguuaagggaagggaaagggggcacuucaagcugugacaaugagagccacagcuaagaaucacacagaauaccacagaguaauagggaucaaagagcaaacgagauagcuauaggauauuaggcugggagugcuggugcauuauuuuaauccuagcacucaggagggaggugaccagccuggucuacccaguaaguuccuggacuacccagcaaguucuagguuagccagaccugugaucucaccagaucaugucucaaaaacaacaacaaaaaacccaaguguccagaaacagccuggcuuuguggugcauacuugacacuccagcaccuggauggaggcaggaagaucaggaggcagaggucauccugggcuauggucaauucaaggccaaucugggcuguaugugaucuugucucaauacuaucuucaacccaaagaaaaauccuggggcugguuucucaucaagaaaaggcacuugcaggccgggugugguggcgcacgucuuuaaucccagcacucgggaggcagaggcaggcggauuucugaguucgagaccagccuggucuacaaagugaguuccaggacagccagggcuacacagagaaacccuggcucgaaaaacaaacaaacaaacaaagaaaaggcacuugcuaccuggcuugauaaucaguuuuaucccugggacucacauagugggaagagaacagacuccuacaaccuauuuucugaccuccacacaugagucauggcacaugugcaccuccucaacaaacauaaacuacaaauaaaaauuuaacaucuugggcuggagagaugguucagcggguaagcacugucugcucuuccaaaggucaugaguucaaaucccagcaaccacaugguagcucacaaccauccuuaauaagaucugaugcccucuucuagugugucugaagacagcuacaguguacuuagauauaauaauaaauaaaucuuuuuaaaaaauuuaacaucucaaauggugcauaaaauguacuauacaaaaguaaacuuuucugggcuggagacauggcucaaugguuaagagcacuuacugaucuuccagaggucccgaguuuaaaucccagcacccacaugguggcucacaaccaucuguaaugagaucugacucccucuucuggaaugucugaagacagcuacagugugcuuacauauaauaaauaaaucuuaaaaauaaaaaaccaacuuuucugccuuggugaaacuugauuuauuguccuguuuuccuuuuccagauaaauccagcaaucugugagccagaacacuuggacuaaagcccuaaaguguaucauuagagugagccauucaagcuuucuaggucuuaagucugccuaucuguccaccagugugugugauugauagaugccucaugagaacugagacaggauucagaauucagaugauguacacauaaaagacuuugcuacuagauacagaugacuuaguacaucuguuaggacaauguaaaacuguguaacccauuuuuccuuuggaguaccuguggguggcuauuguaauuccaggcauacaguauucacugucagggugccccuggcaauggaguaaauaacuccagguaaauaacagagacugcaaccuaagacugcaggaaaacuauucaguaauucugcugauuaaguaaaauuuuaaaaaaggaaauaggucaguuuguaagauggcccaucaggucaagguuccugcugccaagccugaagaccugaguuccauccccaggacccaugugguagaaggagaaacuugaucccuucgaguuauccuaacccccacaucugugcacuguagcacaugugugcucugcaccaccaaauaaguaaaauacaguaauuuuaaaaagccauugagagcucugcaugaccagccugagggaagacugguuugugugagugacagcugauaaaagacaaggccaggagucauuaaaauccugggagaaagcaaaaagccucauaaacuaugauaagaucaaccuggaaauuuucaggaaaacaaaacacuuuuagacugcagaagacagccgucucucuauagccacagaagccuucauguaacaaacuacugugaccuggcugugugaagacuuguuaacuggaugcuuuugugagccagcugcuccauguucuuaggcuccauguucuuaguucuccugguaacccagacugcacuuuuguuuuacagaaaagcuaagugacacacucaguguuguauaguuccaguaguagaggugagaugcaacccagguuuucuacuaccaauccuggccucucuagcauguuuuguuaauuaggucugaaaugaaagagccucaccccaaaguauucccuguccuugagacucucaacacagcucagacacaauaggagaggguugaacucuuguagggcucuaguagaaugauuagagaggcaggaagggauggugguuauuucaaaggguggaggcuauucgugucuggaaauuucucagggaaauacugagcaaacaacaaaagcacccuccaccccccaaagccagugaucugucccagggcauaugcaaaacaagguguauagggcaggguuuacaaaaggcccacccccucauccccagcacuuuuccauagcaauguccucuguagaucaggcuguuuuugaacucagauccaccugccccugccucccaaguguugggauuaaaggcauguacaaccacugcccagcuaacaaaauggguuaggguaaaugucacauaagaaugcaagcaaccggggcuggugagauggcucaguggguaagaccucuuccgaagguccagaguucaaaucccagcaaccacaugguggcucacaaccaucuguaaugagaucugacucccucuucuggaaugucugaagacagcuacaguguacuuacauauaauauauauaauauauauauauucuggaaugucugaagacagcuacaguguacuuacauauaauauauauaauauauauauuacaguguacuuacauauaauauaauauauauaaauuacauguaauuuacauauaauaaauaaauaaaucuuaaaauguaaguacaguguacuuacauauaauaaauaaaaauuuaaaaaucuuaaaauuaaaaaauaaaaaaucuuaaaaaaaaaaaaaagaaugcaagcaaccacuggaauucauagccuagaccccaaucaagagggccuccuuuuauuugcugacacaaauucagacacucuccauuaagaaauggugacugcgcugccauccugguuagcuagugcuguguuugaggaaucaugccagauaggcuuuuguuuccuuauuuucagaaaagggccauguggaccucauuuuuccauugguaaagaggauuuaaucugugagagacagccaacugcccaccuucauccuggucauggccaaaggcaccggacuccagcucaaagaugagguggcaagaacagaagaugaagauggccuguugucauuucagucagaguuagacacauggggaaaaggcuaaaguuuacaccagaagguggguucccuagagcuccuaagcaccagagccaguucaccuagagauggcuaggagccaaggugacaccuacaguccucagagaaaggucuugucacugagggaugguucacauccuugcugauagcuauuuaccugaacuuuugggcacucuugucuagagggugguaucuccaggaaggggguugaagaaauaggauggaggguugagauagaagagcauagacaaacagugugaacgaagacaaaguugagccccaugucaaacaaacaggucugggcuucugaacaggaguagccuagauaagcccuugaaauaauggugagcugggcgugguagcacacaccuuuaaucccagaacuuggaaggcagaggcaagacuagccugguuuacacuauaagacccuaucucaagauaacccccacuacaaucacccuugggccaaagauaacuucugauggcuuaaucacccagcuauaggagcauuuucccuuauauggauaaagauuucgugaagaaugagucucccuuccuggaagaucccaaccccaagugucuggaauuuccgugcucuaucauggagaauaacauagucacuucaagaaaugcugaguuguguccccuggggaacugaggcccugcagucuccuuuuuccucuuugcucacacuaagauaaaccuugccucugggagaaaggacagcaagagcuggaggcauuuaaaauaugcaaagcaucucugugagaauucugaagacuucacucuggaaaaaaagcccagcucuguuccuccacagaccuacucacucaacuuugauaugucacuuagggaaguggagauuccuaccuuccaggucaucgauugucuucuccaguuuagaaacuguccuuucugcaaacucagcucgggucucagccuagggaagaaaagagucacuauccugcuucagauuagccccucaaaauguagggcaaagcuggguguggucacucaccuccuucagcuugucagacagaagcuugauuucuucuucauauuuauccuccuuuucagaauacuaugggagaaaaacaaaccaacaaaccccaaaggugguccuuaaaagagggaaaaaggcuggagagaugccucagagguuaagggcucuuguugcuuuuacagagggcugggguucaggacccaguacccacauggacgcucacaaccauuuuguaaguucagugccaggggaucugacacccugcccuacagugcagacauacaugcuggcaaagcacuuacacauaugaaauaaauacuuaagggaaggaagaaggagcuggggagaugauucagcgagugaagcauuugccuggcaaggaccccagcauccacauaaagguuggauggguguggcucccucuguagagaugagauuccuggaacaagcuggcuaacuagacuagccaaauaggugagcuucaggugagagacucauccucaauauggcucccauuagcaaaggccugcacgacaauacccuagcacaugucagguuaccuggauugagaacagaacaagauguagcaaguuucccuccaacccaccuuuucagaagcagccuccagugauuucagauuguuaguuacauucuugagcucuucuuccaggucaccacacuuucugcaccaaaaaaagauuugcuguaauguaggcaauucccuuccagcaaguccacuguccauccccccacuccaccacugcuggaaacuuaucauacccucuccugcugagcacaggcagaggcagggcaggagggcaucuggaggguuuguaaagcaaccugggaaucugccagggaugaggcaauagggacuugugaaaucugugacuggcuuaguuuucucaggaaggugugcaaauaagacaagggugggagaugggagauggccuucagaguucacaggacacuccaggaagcaagccuagaauacaucugggaaaccagggugcucccagcccuacaggacucucgguggagcugaauccuugguccaaggccaagagggaaagguguuuuguuuguugggacugugacauucuagcgagcuguuuccaugggaagguaccaauagcaacaucagaagccaugcccugaaacacuugugggguauccggcccccccuauaaacaggauucugugaaaaccaaauggccuggcucaaugugcaaaguagggguaggaaggaagaucccaaguuucagggcagucuggccauacagcaaaacugucccaaaaauuucaaaacagccaacaaggaacagugagaaaaugggaggggguggacgaacaugggcagcuugcgaaugggcagcagagcugugaaaugccauuuucugcauggggcagggcuauugcaccauggacugacucacagcagcagugacugccuacacaagacuugcagggggugaggccugucaacauuccaucauagaagagagaugggcucaugagguccacccuccccagguagcuaucagcaguuaauggccucugggggaggaggagauacauuucucagugguguaacuacucagcaaguugccuugcucggguaaauaaccccucuucaugcuaauaauauauacacuaaauaacugcaguggauagcaagaagaaaucaaagucaggauauacugagaaaaagggggacggugagaggaagaaaaaagaggguguguuguaauuaaaguauagcguguguuuauaaauaaauaaaauugugaaaaacaaaaguuaaacucagugugguagugcaugcuuauuauucuaggaaucagagacaggaggauuaggcauuccaggcuacaagagacccugucucaaaacaaaacaaaccacuuaaugagcaaaacaaagaaacaaaaccaaacaucaaagaaaggaaggaaggaaggaaggaaggaaggaaagaaagaaagaaagaaagaaagaaagaaaggaaggaaggaaggaaggaaggaaggaaggaaggaaggaaggaaggaaggaagaaagaaagagaaagagagaaaggaagggaaggaagaaaguaaagcccagggagaaggaaacuuggggccucuaugcuguccucgagucucaacccaauugcccaguaucuuggugggaaaaggaugcagcaaagcuucccuugucaggaagaaccaucagcagcugucagccaaugaagcaaaaggugagaugagccugggacucugaaugcccaagcucuugagcagaggccagccccagccacaagagguucccagccagcacacagcccauuaucccuccucugccuggagccagaugagcaguucaggcccguucugccacuuacaguucagauaccuccgcccucuccucugcucucuucagcucacccuccaggaugaccaacuuacgagcaaccuacaaagacagaaaacccaacugagacccaucuccacggauacucuggauccugcaagagauggaacaucucaggucccauagccaggggaggaaacgguagagcugagucacuuagccaggaaaggaagaaguacaagagcccacuguggugaugucaucugacuuccuucuauuuaggaggcccaguuucaaaaccaaaucaaaacuagucauggugaccuauaaucccagcauuugagaggcaggagaauugggaauuaaagauuaccccagguugccaggcaugguggugcagccuuuaaucccagcacugggaggcagaggcaggcaaauuucugaguucgaggccagccaggacuauacaaagaaacccugcuugaaaaaccaaaaaaaaaaaaaaaaaaaaaaagauuaccccagacuauauaaaaaaagaguuggaagccagccugagauaccuuagacccuuucuuuaaaaacaaaauucagccagcuuguucaugucuguaauccuagcacuuuggagagggaagagucaggaguucaaggccauccuugcauuguuuucuauauagagaggagaacagccuggaauacaggaaaaccuuucucagaaaaaauaaaaacaaaacaaauauauauuggaaaaccaaaaacaagacagccaggcauagugauucauacuuaucauccuagcauuuggaaagcugaggcaguggacagucaagaguucauggcuagccugggccacaggaauuuuaggucagccugaguuagugggaaauucuauauccaugaagauuaaaaaaaaaaaaaaagaauagaaauagaaaaggguagcagaaucaggcuagcaaucaugacccucaaguuuauuccaacuggucuauauccagcuuaagggacaagcggagugaacugaugaguuggucuccagcagcucagacaaguggccaccauacuuuuguuugaagacaguuucccagucaaguggcugugucuggaaacccacagagguaaucgucuuaaaugugggcuuccgauggguuccuaucggcagcaccauuuccucccacuuccugcagccaucccauaggcccaacucaccuccucauacuugcggucggcuucgucagugaugugcuuggcuucuuugagcugcaucuccaggaucuccaucuuuuccucaucuuucauggcucgguucucuauuaccuucaugccucugcaaguuggauagggugggguaucacagcaagguccucaaaugcauccacccagcacccaggcaaggauaaagaccuauugucaacuucuauauuuauuucauugagccgucuggauucgagaacugaacgcacgucuucuacaagaaagcaagugcuaacuucggagccuuccucuccagccuaugguaucuuugagacaggucucucacugaaccuggagcuuguuguuccccacagacuggcuagucauggagccccaggacccucuggccucugcggugcugggauugcaggcccccugccaugcauuguuuuuauaugaggggggaguacuaacucagguucuuagacugaagaacucaacccgaagagcaaucuccccagccucauacagcccaggcuggucucaaacucacuaugcagucaaggauggcuuugaaucccugauccuccugccucuucccccucagugcuagggugaugggcuuaugugggauugagaauugaacccaacuuuguggaugccaggcaagcauucuuaucaacugagcuuuaauccuacccacccucaccaccccuuuuuuuagaucuuaggagacagauuuugcuacuuagcccaggcuacuauaccucccucagcauucaggagcacuagaaugacaggcgugcaucaucaucaugacugguggaccuccacacacuagcaaauaacccagcuuucacaagcauaccauauugugggucuacuauccccaguuuacaaauaaacugaggcagagaaaagcuaagguuauagagcugcuaaguagcagaguugggcuagccccugagggugcaccccuguuuuguauuccucacaguaagacaagccugaggaccagcagucacuguggaaugugcauccacaccuacaggaacgcugaggagcagguaggagcugaggcggagcagaggguuuuugagagcuuaguugaggucuggagagaacuggaggaguauggcaggcgaaugcucugucucagcacuggggagacugagacaggccuuugagagcaggcaagccagggcuauauaacaggauuuugucucaauaguaacaacaacaagaaagaaaacaauaaagucagagcugcacugugugugaacacaccuuuagucccagcucucaaggguuauaaaaugagacuuuguauuaaaauauacaaacaaaaaaauaucucugcaaaccaaucaaccagccaaaaaaccacauaggagugaaagaacacaggggcaggaugggcgggauguuuaugcuggguggaaagggaauuccuggaagcuuccagggccaggacugaauggaaacaaaauggacaagcuggaaugcaaaagcuacuggaaagucagguauagccugagcagcacaaagugcuccagaaugauguaggcuuuuaucucuugguuuuauuacugagguaaaagguaugcacuacuaugccuggcuuucaaaacaaaccuuuauguuauccagugcugugugagucugaagugagacccacaaccugaacaugugaguacagucacaguacagauggagaauuccuuaugucgcaggccacuguucaaaggagggcacacuagaaacacauggaaugucccucaggccccauguucaagggauaugggaugcauaugaauuaccuguuuagacucugauaccaccuuuaagauagcucauuauugauacacaaauauccccaaaucuagaaacacacaaacuccuaaguacuuucagucccaagcauuucagaggauacuauguuuacgcaggucagaaagaaggauguccucaggcagucagaaaaacucagcugccucagagcaaagccugcuuucgcagaguuauauggauuggaacaaacaagguaaugggcaccagagaaauggcugugggucaagugaucacccgcacaguauccccaagauacaaagauagaagcuaggcacaaggcuugaugacacauguucuuaaaaguguggaagaggauaaaacaccugcuuuauuauuauuuuacauuuauuuauuugugcaugagugcaugugccccagcacacuguguggagggugggacauaccugcaggggcuguuucucuccuccagugugggucccaggcacuaacugaacucagguugucacacuuagcaauaggggccuuuacacacugagcaauuucacuggucauuguuucauuuuuuaggauuuuuauuauuucuaaguauguguauguguaggugcccacagaggggucagaaauauucucuggagcugaaguuauaggcugcugugagcugcccaacaugaguacuguguguguuuaaguguacacaugcaggucagaagacaacuugcaggaguugguucucuccuaacauguggaacucagggauugaacucaggucaggagacuugguagcaagcgccuuuaccuucuggacuaccuccacagcccaacuaaauugcuucuagugcacaguauagagcuaggguccuauauuugcuauaugaucucucucucucucucucucucucucucucucucucucucucucucacacacacacacacacacacacacacacacacacacacacacacacacacacacacacacacacacacacgcuaugcagguacuugcuauugagccacaucccagccucuaguugcuguuuagugccugguuuauagucacagcagcacaaugugaaaccauuugugaugauuuguauaugcuuggcccaggaagaagcacuauuuggagguguggccuuguuggaguagguggacuuuuuaagcauggacuuuguuuaagcaugcuuuguuuaagcauggacccuucuccuagcugucuagaaucgagucuuccacuaccagucuucagaugaagauguagaacucucagcucugccugcaucaugccugccuggaugcugccauguuccugccaugaugauaauggacugaaccucugaaccaguaagccagccacaauuaaauguccuuauaagaguugccuuaguuauagugucuguucacagcaguaaaacccuaucugagacagaaauugguaccagggacugggguauugcugugauaggccuggcuaugcuuugguuggaagaauguggauuuuggggacuuuggauuuggaaagugguggaaugcuuuaaauggggcuuaauaggauauccuaguaggaauauggaagacucuguugcuuagagugauuugaauuacaugguccuggcccaagggguuucaguggagaauuucaauauguggccuagagacuguuuuugugauaguuuggugaagaauguugcuacuuuuugcccuugucugaaaugucugcuucaggcuaaggugaaaagacucagauuaauugcauugacaaaggaagucucagaaaugcccaucacagacuuuguucucugguuaagucuuaugaaggacauuuuaaacaaguguagcaaguuaggaaaaggaaaaauauaaaauauauggucccucagcucuccaagccaagacaugcuagaaccauucauuccuggggacaguuggauaggcuuccuguggaagcccaaaugcugcccagauaucaccagaguagcagggucagcuguaaacacagugaugguugguuauguacugucuccaaaauauagcuggcaucauccaaaagcuuaaagcuugccacagcaaugggaacuaccacagaggcacauggcagagaucacccugcuucugucucccuagucuuuggauaaaugucuacacugccacgcugcccagucuaucuuuacuucucuuuucuucacaucaucuagaaacucaauugucucuagaaugggcaagagaggcaacuggggcuuccccagaaagcaauaacacacucugaggcccuagccccauuucugcacauuuuugcuuuucucuguuuccuggaaaguguccuccuaagcuaucauaaagaaaaccaagcagggcacauggugaagcaucugucaucccagcacuacauagguagacucugccucaaacaaaauaaaacagaaagggaauuggauuaaaaacaaacagguuggggcaggagagauggcucagugguuaagagcccugacugcucuuccagagguccugaguucaguucccagcaaccacaugguggcuuguagccauccauaaugagaucuggcgcacucuucuggggugucugaagacagcuacaguguacuuacauacaauaaauaaaucaaucuuuuuuuaaaaaaaauuaacaacaaaaccagaucuucaaaucccuucagcuccaaggucauuaguaccaucacaaaauuuuuuccauucauacaugucuaugugcauuuguguaugugcauauggagaccagagaaggaugucagguauccagcucugucacuuucugucucauucccuugagacaggaucucucacugaaccuggagguaggcugacagucagcaaaccccaaguccucuugugaaaccacacuggcuuuucaagugguaggauuuaagcacuuaaauacugagcucucacaucuuuuuaaagucaggaaaggcuucauguagcccaggcuggccucagcacugaacuuacagguauguaccaccacaccuggcuccaccccugucuuccacaggucagaagcauccuaccucucacucucaucagcagccuucucugccucuuccagauucugcagggcuguggccagcugcuccugagcccgguccaguuccuccuccagcaguuggaugcggcgguugagagcggcugcaucuccuucagccuggaaagucagauauacaccuuauaucugggugauuaagaagagucaagcuggcaagcagugucuccccacgccccauccccucagugacccugauauccagccacaacccaccuagggacccaggcucaagggaauucauacucauuugaauuuaaauuugauuuuaaaaauuauggaucugugacgcagggucuugugcauuagccagacuggucuccaacuccuggucuuaggaauccucuugccucagacucccuggcaagccacagugcccagccccucuggagaacacacaccucaacaacugagcaaacuugucagcccugauauuguuuugucuucaagucacccaccuuacagguggaaacaaggaggucccaccagugcagugguauuguauagugacuuagggcucugucaccaaggggugacuucccucugucauccagggauggccgcccucaaggaagagcauggaaaguuagucacaugagacucaauuagcagcuccaggagacugaagccaaaggacaaagaguuuuagguuagccugaacuauuauauagcaagaucucuguuaaaauaccagaaaaagggggagcuggcuuaguggguaaaaucacuugcugcccagcauaaggaccugaguuuagauucucaaacaguguguggguucaugagguucaugaggaaaugcagaggaagccaugcuaccuaccggcuuccuuucagggauaaccacuacauggggacagcuauaaaacucagugugagucugggcccucucuaccucaguuuacacagcagggaaaguauaaagaacaaggccagguugccugucaauauacagaggaucccccuugccccccaguuugugaucugugaccacccucccccaacaccaauaugugucugugcgucucaggucucucuucccacaauguggguccuggggacugaacucagaucaucagccuuaguggcaagcaccucuacccagcugaaccaucucaggggcccaugggugccucuuuuuuauaucuugaacuucaauaccuaucauaugcaacaaguggggcaguauugguucccgcccacuucaguuuuuaguauauuuagcaaaaguuauguaaccaggaccacuaucuaauuuguuaacuuuugccauuugcuaaaaagaaccuugugcccaucugcagucgguggagcuuuuaguuguugguuuuuuguuuuguuuuguuuuuuuguuuuuuuuuuuuuuguuaugguuucacgaaguccaaguuggccucuaacuacauagucuggcccuaauuucugacugcccugccuuaaucucucaagugcaggcucuacuucauccaguucacccaguccugcagaagggacccaggacuuugugcauacuaagcaaguaucccaccauucaaugacaaccccacagccucuaaguagccugggcugcagggggcucaaggccacacccaacauaguaaucacuuucacagucacauugaguuuccacauucaugaguugucucaaagaaaaggaaaagaacuuagacugaagaggcacacuuugaucuuggcauauuuucaacuguuuaaaacagaaagagcucuaguucacauccaugcauucauucacacacacacacacacacacacacacacacauccuaagucaucuugagcuccgccccuuccugcaaucaaagccuuccaccggcuacaaaggguuucccuuauaagguaaaagaggcuugcuagauacuuguggccaagcaacaggaagacgucgguuaaucacacaaaaaucuaaaugaaaccagcuguugggacacaagcccagaaaucagcuacacacaccccaaccccauuucuagucuggguguuucuggcccggaaucaacuugagaugucuuucuacaaccaaaagaagcaugcuuucccacaugaacuuuuaaagcagcucagaguuuuccaaaaggcaucccccgcacuccacccuugggccgccaaauuccuggcuuggcuggagucucgaggccauuuuggagaugucuagggugggacgggcguaugagaagccguaacagcuacugugcagagcuuccgcccgguucugaggcuuucuccagcccgagcgguccuugagggauucaaggcuucuacccaggccaggcugucgcccaggcagucuugggaggaguccaggcgguaccugcacugccaacuccaccuagccuuucaguuucuaggguccccgcccugaguucccacacuacggcuucaggagaccugggcaaucacacaacacuucuucccuugucugugagucuccuucgcuagcaaacaccgcccuacuacucaggcaaggggcucuccuugccccggaaacgucuggaaugccucucccuagucuuuucuuucuacccaccuguagcagacuuuugggagacacgaaucgaacgcuuugugggugccagagcugggcuuagaacccagacccaucucuggccccgggcuugacccagggaugaagaggaggcgcggaggccuuuccucuuuccgaacuauucaugcaccccggucccugaacucucagggaaggcgcauacagugggcgcuccggcgucgggcaggcccccuaguggauauuaccuggggcuagggggacacagggugauggugguggugguggguguccugcaggccagcguccaaauucuccuguccccaccccgcccucagcggacgugucgcggccgcacccuaaggacgugccgggaaaguucgggcgcgaagaagcaaaagcgcgcaccgcccccgcccccaccuuggucagccgcagacaaugggagcgcgguauuugccccacuacuccggagugccccgcgcaggacugucccccccgcaaccucccaguuccugccccgccagcguacggggcuccaggauccaaggguauggaugaucaaggcggaggggagacggaggaagggggagcuagaagcaugcggagcugggaagaaaagagggcgccagggagcacugcgggcccggaagcgcgcgggacgaaaagugggaucgggcgggggucgcggacggcgcggguccuggucucucacuuucucgcgccgcucgcgcucgccauccaguucgcgcugcaggccuugcgcgcgauccucugcgucgucugccugcugcugcagggccuggaucuugcgcuucacugccuccagugaguugaggccggccauagcucaaucguucugcugggcuccggcgacagcugggcggccgcgcccgggcccgccagccuuggccacgccggggccgcccccgccucucccc

SEQ ID NO: 4522 - RNA, 3434 nt, Mus musculus
gcagaugggcacaagguucuuuuuagcaaauggcaaaaguuaacaaauuagauagugguccugguuacauaacuuuugcuaaauauacuaaaaacugaagugggcgggaaccaauacugccccacuuguugcauaugauagguauugaaguucaagauauaaaaaagaggcacccaugggccccugagaugguucagcuggguagaggugcuugccacuaaggcugaugaucugaguucaguccccaggacccacauugugggaagagagaccugagacgcacagacacauauugguguugggggaggguggucacagaucacaaacuggggggcaagggggauccucuguauauugacaggcaaccuggccuuguucuuuauacuuucccugcuguguaaacugagguagagagggcccagacucacacugaguuuuauagcuguccccauguagugguuaucccugaaaggaagccgguagguagcauggcuuccucugcauuuccucaugaaccucaugaacccacacacuguuugagaaucuaaacucagguccuuaugcugggcagcaagugauuuuacccacuaagccagcucccccuuuuucugguauuuuaacagagaucuugcuauauaauaguucaggcuaaccuaaaacucuuuguccuuuggcuucagucuccuggagcugcuaauugagucucaugugacuaacuuuccaugcucuuccuugagggcggccaucccuggaugacagagggaagucaccccuuggugacagagcccuaagucacuauacaauaccacugcacuggugggaccuccuuguuuccaccuguaaggugggugacuugaagacaaaacaauaucagggcugacaaguuugcucaguuguugagguguguguucuccagaggggcugggcacuguggcuugccagggagucugaggcaagaggauuccuaagaccaggaguuggagaccagucuggcuaaugcacaagacccugcgucacagauccauaauuuuuaaaaucaaauuuaaauucaaaugaguaugaauucccuugagccugggucccuagguggguuguggcuggauaucagggucacugaggggauggggcguggggagacacugcuugccagcuugacucuucuuaaucacccagauauaagguguauaucugacuuuccaggcugaaggagaugcagccgcucucaaccgccgcauccaacugcuggaggaggaacuggaccgggcucaggagcagcuggccacagcccugcagaaucuggaagaggcagagaaggcugcugaugagagugagagguaggaugcuucugaccuguggaagacagggguggagccagguguggugguacauaccuguaaguucagugcugaggccagccugggcuacaugaagccuuuccugacuuuaaaaagaugugagagcucaguauuuaagugcuuaaauccuaccacuugaaaagccagugugguuucacaagaggacuugggguuugcugacugucagccuaccuccagguucagugagagauccugucucaagggaaugagacagaaagugacagagcuggauaccugacauccuucucuggucuccauaugcacauacacaaaugcacauagacauguaugaauggaaaaaauuuugugaugguacuaaugaccuuggagcugaagggauuugaagaucugguuuuguuguuaauuuuuuuuaaaaaaagauugauuuauuuauuguauguaaguacacuguagcugucuucagacaccccagaagagugcgccagaucucauuauggauggcuacaagccaccaugugguugcugggaacugaacucaggaccucuggaagagcagucagggcucuuaaccacugagccaucucuccugccccaaccuguuuguuuuuaauccaauucccuuucuguuuuauuuuguuugaggcagagucuaccuauguagugcugggaugacagaugcuucaccaugugcccugcuugguuuucuuuaugauagcuuaggaggacacuuuccaggaaacagagaaaagcaaaaaugugcagaaauggggcuagggccucagaguguguuauugcuuucuggggaagccccaguugccucucuugcccauucuagagacaauugaguuucuagaugaugugaagaaaagagaaguaaagauagacugggcagcguggcaguguagacauuuauccaaagacuagggagacagaagcagggugaucucugccaugugccucugugguaguucccauugcuguggcaagcuuuaagcuuuuggaugaugccagcuauauuuuggagacaguacauaaccaaccaucacuguguuuacagcugacccugcuacucuggugauaucugggcagcauuugggcuuccacaggaagccuauccaacuguccccaggaaugaaugguucuagcaugucuuggcuuggagagcugagggaccauauauuuuauauuuuuccuuuuccuaacuugcuacacuuguuuaaaauguccuucauaagacuuaaccagagaacaaagucugugaugggcauuucugagacuuccuuugucaaugcaauuaaucugagucuuuucaccuuagccugaagcagacauuucagacaagggcaaaaaguagcaacauucuucaccaaacuaucacaaaaacagucucuaggccacauauugaaauucuccacugaaaccccuugggccaggaccauguaauucaaaucacucuaagcaacagagucuuccauauuccuacuaggauauccuauuaagccccauuuaaagcauuccaccacuuuccaaauccaaaguccccaaaauccacauucuuccaaccaaagcauagccaggccuaucacagcaauaccccagucccugguaccaauuucugucucagauaggguuuuacugcugugaacagacacuauaacuaaggcaacucuuauaaggacauuuaauuguggcuggcuuacugguucagagguucaguccauuaucaucauggcaggaacauggcagcauccaggcaggcaugaugcaggcagagcugagaguucuacaucuucaucugaagacugguaguggaagacucgauucuagacagcuaggagaaggguccaugcuuaaacaaagcaugcuuaaacaaaguccaugcuuaaaaaguccaccuacuccaacaaggccacaccuccaaauagugcuucuuccugggccaagcauauacaaaucaucacaaaugguuucacauugugcugcugugacuauaaaccaggcacuaaacagcaacuagaggcugggauguggcucaauagcaaguaccugcauagcgugugugugugugugugugugugugugugugugugugugugu

SEQ ID NO: 4523 - RNA, 3434 nt, Mus musculus
acacacacacacacacacacacacacacacacacacacacacgcuaugcagguacuugcuauugagccacaucccagccucuaguugcuguuuagugccugguuuauagucacagcagcacaaugugaaaccauuugugaugauuuguauaugcuuggcccaggaagaagcacuauuuggagguguggccuuguuggaguagguggacuuuuuaagcauggacuuuguuuaagcaugcuuuguuuaagcauggacccuucuccuagcugucuagaaucgagucuuccacuaccagucuucagaugaagauguagaacucucagcucugccugcaucaugccugccuggaugcugccauguuccugccaugaugauaauggacugaaccucugaaccaguaagccagccacaauuaaauguccuuauaagaguugccuuaguuauagugucuguucacagcaguaaaacccuaucugagacagaaauugguaccagggacugggguauugcugugauaggccuggcuaugcuuugguuggaagaauguggauuuuggggacuuuggauuuggaaagugguggaaugcuuuaaauggggcuuaauaggauauccuaguaggaauauggaagacucuguugcuuagagugauuugaauuacaugguccuggcccaagggguuucaguggagaauuucaauauguggccuagagacuguuuuugugauaguuuggugaagaauguugcuacuuuuugcccuugucugaaaugucugcuucaggcuaaggugaaaagacucagauuaauugcauugacaaaggaagucucagaaaugcccaucacagacuuuguucucugguuaagucuuaugaaggacauuuuaaacaaguguagcaaguuaggaaaaggaaaaauauaaaauauauggucccucagcucuccaagccaagacaugcuagaaccauucauuccuggggacaguuggauaggcuuccuguggaagcccaaaugcugcccagauaucaccagaguagcagggucagcuguaaacacagugaugguugguuauguacugucuccaaaauauagcuggcaucauccaaaagcuuaaagcuugccacagcaaugggaacuaccacagaggcacauggcagagaucacccugcuucugucucccuagucuuuggauaaaugucuacacugccacgcugcccagucuaucuuuacuucucuuuucuucacaucaucuagaaacucaauugucucuagaaugggcaagagaggcaacuggggcuuccccagaaagcaauaacacacucugaggcccuagccccauuucugcacauuuuugcuuuucucuguuuccuggaaaguguccuccuaagcuaucauaaagaaaaccaagcagggcacauggugaagcaucugucaucccagcacuacauagguagacucugccucaaacaaaauaaaacagaaagggaauuggauuaaaaacaaacagguuggggcaggagagauggcucagugguuaagagcccugacugcucuuccagagguccugaguucaguucccagcaaccacaugguggcuuguagccauccauaaugagaucuggcgcacucuucuggggugucugaagacagcuacaguguacuuacauacaauaaauaaaucaaucuuuuuuuaaaaaaaauuaacaacaaaaccagaucuucaaaucccuucagcuccaaggucauuaguaccaucacaaaauuuuuuccauucauacaugucuaugugcauuuguguaugugcauauggagaccagagaaggaugucagguauccagcucugucacuuucugucucauucccuugagacaggaucucucacugaaccuggagguaggcugacagucagcaaaccccaaguccucuugugaaaccacacuggcuuuucaagugguaggauuuaagcacuuaaauacugagcucucacaucuuuuuaaagucaggaaaggcuucauguagcccaggcuggccucagcacugaacuuacagguauguaccaccacaccuggcuccaccccugucuuccacaggucagaagcauccuaccucucacucucaucagcagccuucucugccucuuccagauucugcagggcuguggccagcugcuccugagcccgguccaguuccuccuccagcaguuggaugcggcgguugagagcggcugcaucuccuucagccuggaaagucagauauacaccuuauaucugggugauuaagaagagucaagcuggcaagcagugucuccccacgccccauccccucagugacccugauauccagccacaacccaccuagggacccaggcucaagggaauucauacucauuugaauuuaaauuugauuuuaaaaauuauggaucugugacgcagggucuugugcauuagccagacuggucuccaacuccuggucuuaggaauccucuugccucagacucccuggcaagccacagugcccagccccucuggagaacacacaccucaacaacugagcaaacuugucagcccugauauuguuuugucuucaagucacccaccuuacagguggaaacaaggaggucccaccagugcagugguauuguauagugacuuagggcucugucaccaaggggugacuucccucugucauccagggauggccgcccucaaggaagagcauggaaaguuagucacaugagacucaauuagcagcuccaggagacugaagccaaaggacaaagaguuuuagguuagccugaacuauuauauagcaagaucucuguuaaaauaccagaaaaagggggagcuggcuuaguggguaaaaucacuugcugcccagcauaaggaccugaguuuagauucucaaacaguguguggguucaugagguucaugaggaaaugcagaggaagccaugcuaccuaccggcuuccuuucagggauaaccacuacauggggacagcuauaaaacucagugugagucugggcccucucuaccucaguuuacacagcagggaaaguauaaagaacaaggccagguugccugucaauauacagaggaucccccuugccccccaguuugugaucugugaccacccucccccaacaccaauaugugucugugcgucucaggucucucuucccacaauguggguccuggggacugaacucagaucaucagccuuaguggcaagcaccucuacccagcugaaccaucucaggggcccaugggugccucuuuuuuauaucuugaacuucaauaccuaucauaugcaacaaguggggcaguauugguucccgcccacuucaguuuuuaguauauuuagcaaaaguuauguaaccaggaccacuaucuaauuuguuaacuuuugccauuugcuaaaaagaaccuugugcccaucugc

SEQ ID NO: 4524 - RNA, 17371 nt, Mus musculus
cuugcacucaguuacgcgccugcgcacuugcggcucccuucagaccggacauaacgguccacgcgcugcuucauggaccggaaguggaggggaagugucucggggcgcgccgggccuugcugaacgcccgcaguuccugccguugccgccgcccucggcuacugccgagaccuuccaaagccgccauguccgccagcgccgucuacguacuggaucugaagggcaagguacugaaggguucgccacccuccgcguugccaggcaaccaacgggcccucgcccugucaggacccacccuguugcuaggcaacuggccgaccagcccagcuagggcgucaggcaggcggggcagccucacuugccagcccuaccaaguuacuaggaaaugggcgguggucuuuccgcgagucccgccccauugcuagccaacuuggugggcugcgguugcuagguaacuguccgcuuugccccuuucccuuuuuguucgccuggguaccggacucuagcuucuccugcgaacuccuguagcaggacccugcgccccggggaccgugcgacccuuggccagaggcguggcgggaacuauggccuuaggucggucccucgcuccacaggcuucagcguucccuagagccacugagcuuccuaugacauuaagagaagcggaugauaaaagugugguuuuaagaagggcgugguggcgcacgccuuuaaucccagcacucgggaggcagucaggcggauuucugaguucgaggccagccuggucuacaaagugaguuccaggacagacagggcuauacagagaaacccugccucgaaaaacaaaaacaaacaaaagugugguuuuagagggggaaacagugccuagagucacacugauuacugggaaguagcggccuggaagcauccucgccaggcaggugcuaagcccagggccaccguggguuagccuaaucugucauagcucaacuuagucacuuggaaaaaacagaaauagaugaauaccuauuggggccaugucuucauaauggacuagcagcugcaacugaagaaucagggagagcuauccugacugggaauaacaaagacugcugagacaugaaggcccugcacagaaacaggacccuggcaucuugcccagcguuaucugagaaagaaaucuucauuuguguguuucugcggguguguggaggaaggagaccccugcuacucuuacaugggcucuuguuaucgaacucgggucacuagacugauugagcuaggcugccugaaccguuaaaacgcauggaucugccugucuguacuucccagcagaaucugacuuuuucccucucuugguuuuaugagacaaguuuucucuguguagcucuggcuguccuggaacucacucuguagaccaggcuggccuugaauuuagagacugaccugccucugccucccaggugcugggauuaagguauuugccaccaccaccugguaagcaccuggcuguuaccugggauuuggguauagaguucaggucggauauuuggaaaauacagacugagcugucucccuagcauaauggaugguuuuguggugcugaggauagagccuagaacaacaagcucucugucaggcagccacaguguacucuaugcaaaagccucuuccaggaaggcacauuuagccuuaagaaaggcacugucugucgcucuaccucaggcugucagaguggaaggcaaguggccagccucuuauguuuggaagcuaccagaacagguccagccacaguaaacaaguccaacauuuagcagugaaagaacauugauguccagucuacauggaagagcuagagcuuagaagagccccacccuccacguuuuccuuagucccuugaguguguaccugccuuguaugucacccaagaucgacaacuggugaguuccagaccugggccuccuccacagccuucugggaagcuggguaggggcaguguucccuaggucucaugacauaugcucugccuuccaaccuggccuagagguacagugggcugccugucguggcuugcuuguuccuuuagcaaacaucucauuggcacaagcaaguacccauccugggcugaagcuguagagccauauuuacauguggauucagccaaucuccgcagcugagcuguaugaucauagacaagcaccuuggcucagcaccuugggcagucugagccuugcuuuccuaauggaucugaagagccuuaucugaguuauugaguauagaugugagacaagccuggcccuagcaaggucaacagagcauaguauuugggcuccacaggccucuugaccuagcagaacacuuggaccagcaacugaauagcuauuugccuucuguuuggcauuuagagaagguuaugaaagacauccaagcagagcaggcaccugaugugguucugagaaggugacagaugucccaguuggcaugccggguguaagucagcccauagacuggugcugggacuuuggggaugcaaugggaggaagcuccagggccacugcaguuccaggcaggaguccccagguugggauguggucagaccugucucuagaaagcuguaguuuccugccuccuucuaaaaucaaaccagccucaugacaacaugccacacugagccucucauuaccaagggauuccauguggcuacuuuuggcaaauaggagguccuccaagaacacuuggaugcugucuguggcucuggugacucuagauuuggaguacagaaguauugcuuucccgccuuccucucuccaugcuucccuuuugggcacugagaacaaagucccaguuguucacaaggacuuguauagucugaguucucauaaucucccuacccucccacccagugcuuuuccaugugacucuggcucauuccacuuuagccagugggaacccuaaagcagguguugagacaaccugucugcuucugccuugggaccuuuguaccugcaucuguggagagcuguguggccuggcuucaguucaacaacaccuccuccaggaagccucuccugcuugcccuaacugggaucguauccuaccccacccugugcacacugcaucuucuagcccauacugccuacugcauuacauguauguuuuaucuguccauuccuuucuccuccgauguuccugagaaggcacaccaaacucauuccauacuggcuccugaugaccagagcagagccuagcuguuagacagaacucagcaaguuccaagguguucugcugagaaggaaaaggagccauggaaaagcuaacaugucacaugcuuugguggagagggucugcgagugacaagguguacucagaaaauguccaagaugaccauaaggcacccuggaggcccugggucucagagguggacagcgcugcugcaggggaaggguguaggaaugugagucuccucuagggacagagaguugccccuggguuugaucgaguagaggccacccugucuagcuuuucuagauuuuuuuuuaaagauguauuuauuuauuauauguaaguacaccguagcugucuucagacacuccagaagagggagucagaucuuguuacagaugguugugagccaccaugugguggcugggauuugaacucuggaccuucggaagagcagucaggugcucuuacccacugagccaucucaccagcccccucccugucuagcuuuuauugaagccgaauccucuucugcuucauggggaaggaccauggggugagagaucagcaaagagaagggcugucucagugucuugcuugucucccuacacugccacaccaguucagaaguggcuguccucccugagucccuaggggauuccugauacuccucccuaucucuucaagccuugauugaaggcgagacuagugagaagguccccaguuguccccagacagcugugacagugagggaaccaugucgaccuuggcuaccauggugguagccaucacauagcuucacucuauguuuucugagcaagcaaacaaacuccugagcagcccuggugagguaaacagucaggccuucugacuggcucugaccagucuagcccaaucccugcacaucuggggaagaaagugagcuuagagcugccaggagaagaguucucagugagcacagucagugggaguaaggaugccucugagaucgugacccugcucucucuuucuucuguguuaccucaggcaggcagcuccaccucucugaacauugcaaucuauaaaacuaaccagccgaagggcggugguggcacacgccuuuaaucccagcacucgggaggcagaggcaggcagauuucuaaguuugaggccagccuggucuacagagugaguuccaggacagccagggcuacacaaagaaacccaguuugcaaaaaacaaaaaacaaacaaacaaacaaaaaccccacacacuaagcagccuaccacauaagagauaugauagaagugagcaagugugaguuccucagaugggguggggaacaucagacccaaaagcuuacucugugggcacuguguccccaacgaggcccaaaaaggacugggaaggaacuguccucacugcagucucccagcuaggagcagcagagacagugcuuucugaagugacagauucggcagcagguggugcaggucuagcacugcaucucaggauugcuguagcacugccacauggccaacuagccaugcugauagcagacagugugacaagacaggcacugucaccaaguaacagggcccucacccacagcuuccucguggccccuuccugcagccacuuccucaggguccuccagggagcacuuccugauugguuuccacuaugcacagugacucugaggguagagccuacccugggcaucuucauguccugcaucucagagucccauguccugcauucacauucuauauauguccuccacuaacccugaaugguaaauccugauuuaaaaaaaaaugugggggaaggguuaaggggagagggauacugguguauacacaagugugcaggugcuccuggaggccagaagacaucaaauccccuagagcuggaguuacaagcaucugugagcuacccaguauggaugcugggaacuaaaccuggguccucugaaagagcagcagcacacuuaagcaacaagccauuuuccaacuugagauuuauuuaucuauuuguuuauuugugugugugugugugugugugugugugugugugugcgcgcgcgcgcguacacauacaauuuuuauuuuauguucauuaguauuuugacuacaugugugagggugucagaagcccuggaacugaagucauggacagaugugaccugcuauaauugaaccugguaauugaacccggguccucugcaagagcaaccagugcucuucauugcuaagccaucucuccagccccuguuuauuugguuuuugagacagguuucucuguguagcccuggcuguccuggaacuugaucuguagaucaggcuauucuccaacucagagacccaccugccucugccucccaagugcugggauuggcgugugccaccacaccuggcucuaggauuuuuuuuauuuauuuuauuuuauuuuauuuuuuguuuguuuauuuguuucaagacaagguuucucuguguagcccuuacuguccuggaacuuacucuguagaccaggcuggccucgaacucagaaaucugccugccucugccucccaagugcuggaauuaaaggugugcgccaccacgcccggcuccucaggcauguuuuuuugucagagcaggcuguccuuagacaccacagcacuguauuggagggccuucagauucuggaauccugggguccuggaaccuagcuguggagugcuuuggguagguucagacccaaauucuccauacauauguugaaagauauaucuuugucucuggucuguuucuaguuaagauucagccacugaaguguucauuuaugugggcugacucacaccugucaucccagcacucaggaggcagcagcaggagaagcaggaauugaaggcuguccuuggcugcauaguagauuugaucuguaccugggcuccuuggacccaucuccacucccagcuccauucuccuuuugaguguccauggacacacaguuucucugauucucuaagauaagccacugggucaugcuuaacucuggugucacuuucugaggagccacuaacuuugccguuccacagucccccuggaugguggacagugguucagacucugcagugaggaagagcagggcaggguuauuccuguccaggccucagugggaucuuauaaacuuggacuccucagggauaaggugcucagagagccaagugcacccacaugaggaggucuacauggaguacucacaaggcaaagcuugccccagcgucugugggaacagucccuccucucucugccuucuggugcaggaagagccuuguggugggaauucucuaggguggaaaucagacuagcuucaaguuguguccuucacagauuguccucaacccuaccucaggcacucagagaggaagccaucccuucuuuccuuccugaugcaggugcucaucugcaggaacuaccguggggauguggacaugucagagguggagcacuucaugcccauucugauggagaaggaggaggagggcaugcugucaccuaucuuggcccaugguggcguucguuucauguggauuaagcacaacaaccuguaccguaucccugugcugcggagucgggguuugggaaugacaugccugcccaccagcacaggacaacagaguagccagaggccauaggccuagggaaugcuaaguauuccagaagcugcagcuguggagaggaagggagggguacauggcaagaguaggagccaacugggccugagguuguccuuuggagaugugucauguuaaaugggguaggucuuuggauggggugggcugauuguagguggcuuuguggucuagagauuucuggcugcuguguauggccagaggcaggaguggacaaaugaggggaucggguaggaguagggguggaaaguucucaugugcccaacauccccagccucgcuucagccucaaaucaaguguggugccaaguggagacccaccaugggugcacccaccacuuggggcuuugagcagaccucugaagaucuggcuaugcaguaagcagugggguguaccaggucuuuagcugucuguccccccagggucaguaaguaaaugugugcguguguguggccuccaacaggcacagaugccaacucuucccagagacacagucuucccuugcagcuccugaucugcucucccacccaggcauaagguuuuuuuuuuuuuucugauaugugaacucucuuguggagugggccuaaaauccaauagaaagguauuacccaugguauuacccaugauaucugugccacuguugcacaaucaggcacaugcugcuuagcaugugguauuuuagcacacaggguccauagcugagcaggaauguugcugucuauucaacaauagccuucauagccccuucuggcauuaugaaagccacccagaagggugggaguuuccauuugguuccaacuuaauuuccccaugucugacaguccaaguacaaugucuucagcaauaggcucuuaccaucuaguucugccauacaaccaauagcaauagccugcaugguucuuggagcuucaggauuuccuggccagcaauucacaggagauagucuacccuuugcucagggauuuucauccaacaaacugaugaccuccaggaaugucuuuuccaccaauguaggguaccauuuggauuuaaacucuuuuuuuuguuguuuguuuguuguuuuuuucgagacaggguuuuucuguguagcccuagcuguccugaaacucacucuguagaccaggcuggccucgaacucagaaauucaccugccucugccucccaagugcugggauuaaaggcgugugccaccacugcccgaccucuuuaccuguuuuaacaaccuuuuauuuuauuuuuuuaaagcuuucauuuguagggauauuuuaccugcauguuugcaggccagaagaagguauuagauccuucugggacuagaguuaaagccagugguaagccaccaugugggugcuggggauugaacucaggucuuuuggaagagcaaccugugcucuuaaaccacugagccaucucuccagcccuccauuuuuccuuucaguuauccaagccucagcugggcuguaagguagguagaaguaccauuacaccuaguugucuucauccauguuagugaaguggcugcuugucacuguuguucuccauggacaucacacaugaugccuaguuggcugagaaccaugaaaaugcuuguaagaggccuguggcuauguguacacuagagaagugagugcguauuuuucaugucucacugauauccuauuaagucuaccugucaaucuuucccaggaccgauugauuuauauaaguguccauuuguugaggccauaaucagaaacaggccuaguguuuggagagcauguaaaauagaauaugucacaggaagaccagcagccuuagcuauuuucuaaucuguguuggcuuccuuaugaccagacuuuauauggucccagugggaagcuuccaaggguaccugaaaggaaauggcccauacuuugaucuacugugggcucccuauuuggggugaguagacauguguauagcauucccccccaagcuuugucaccaaaaggaagaagagagagcuuccccacccagcugggcucccccagucuugcuccucaauacaguacccagaagcuacccuuuaaaccuuacacucucuguguccccaagacuccucugcuuaccacaugccucugaccuggcucagauugggggcuuaguccuaaucuugggcccaguguaccacuggagugcagcugguauagggagccauggggaugggcaccuaugauuugauauccuggccucagaaagcuccuugacugccacugcaguggucgccacuucaaaaaagaaugcuugugugucacugguguucuccuuccucuacaaggugguacagguaaggccccaguggugggacuucccuccuggagagggcuuuggggauugcacucccucuugggugggugccucuuagccaaggguaggagauggggcaagggaacccauugucuuuuugguuuccuccugaucagguucacagugagcagccuggcuuugccacuucuaauuggugaaauaugauuggggugcuggggcacauuuuucccuagagcuggucuuucccacuugugugcuucuguguuaguguaaagaccaggucccuucauuagccuccuagcuacccauagaaauggagaugcuugucuacagccagagagccaacacuuuauggggguaggcagcagucuugaggcagaggcagggaucacaggcgcaguugggauugaccacagaggcaaucuagagagcugaagugcuagcacagagccacuccuggucagugccuguggucuguaguuuagaucuuuggguucagggucugugcuaucacccacgggugcaaucacucuagcugggguggccuugggccugggcugaguccugcucuacugcaccuggcccaggucuucuccgaguacuuuaaggaguuggaggaggagagcauccgagacaacuuugucaucaucuacgagcugcuagaugagcucauggacuuuggcuacccgcagaccacugacagcaagaucuugcaggagugaguacaugugucccugcagacccccgccccuagugucuuaguucccaguccaacagagcagucagcuuguuccuucugccccaacuguuuuuuaguuauuuugagauaggguccugauccuccuaccucuuccucuggaaugcugggcugacagaaguaggccauguguccuguucacugggcacugaaccugggguuccuaauucugaguuuguuugugugguacugggauucagcccugcagauacuuagugcugagccaagggcuggucuugaguuucuacugagugccucuggggucaggacccuuuccuauagguauacccuguuucuuccacccacacaaaugcaguaucuuuaaucagagcccugccuuugcugacuguacugaacugagacaguccuugggaaucccaccugcagaggcagaaaccagcaggccccauguuacacuuuccaucccucagugugaccuagggugccagcuccccacuugacugggaguccaggaaaagcugcugcucuuuuguccugguggcacagggcucagucccuccaggugcccacaauacugaccacuuaauccuccauucccgaccccauaccagucagugccuugccucagaaaugaaguguauuuggcccucucgcuauagcauacauacuguaccucuccuggagccuccugauguggaguuucaaguaguugggccucccucgucuucuuccuagcuccauccuaaugucaggguggaacauugugugucaccucuauaaaugagcaauuuggccccacagguacaucacucaggaaggccacaagcuggaaacgggggccccuaggcccccagccacagucaccaaugcuguguccuggcguucagaaggcaucaaguaucggaagaaugaaguauuccuggaugucauugaggcuguuaaccucuugguaggcugccuuuucucuuccuuuccuaaccugccaucuuuuccaggguggaaaucagggauaaaacugaaacccagcagaguguguagccugggcccuggcagccgauagcagggcacagccucagccaccagagacuacugucucugcaucagccucacucucagaaucuguagggauagcauuguggugucucucaggagacuuagguaggggaaccuuaaguuccaaaccuuccagaaucacacugucucauaaaaacaaaauagaaggggcagcaagagagauggcucagaagguaaaagggggcuucccacaagccugccuuucugaguuuucauccugguggaagagaacugacuccugcacucuguccugugacuucacaagugugugcauauucauacacacacacacacaguaaauaaauaaauacaauuuaaaaaguacagggcuuaggggauggcuuagugagccaaguugcugcaccccaagccucaugaccuaaguccuauccccagagcccucguaaaaagagauaucaccauaaaccugucuucuggucuccacacagaggcaguggcacacauaauacacacucauauacaguaguaacauuugcaaguaaaaaauagggacacaagcagagcaccuguguacaagcuugaggaccugaguucagaaccuaacagcaguguggaagcugggcguggugguauggcuguagccccagcacugagagguggggacaggaauaucaacccagccaaaaugagaacucuagcucagugagaggccuugccucaaacagaaggugggaacuccuuuuuaccuggugagcuggaagacugcaugcuugcaguugagccagaugugguagaggucacaccucacauggcuccugcuguccccaggucagugccaauggcaacgugcugcgcagugagauuguggguuccaucaagaugcgggucuuccucucaggcaugccugaguuacgccugggucucaaugacaagguccucuucgacaacacaggccgugaguaccugaagacagugcagaggcuggaucugucuuguucucgggaggugacuucacuugacccugagucagagcugagugcaugcuuaccuggugggacagccagcugcuuucaaguaccagguuuaagaaaauuucuugggucuuugagauggcucaucagauaaaggcauugcugccaggccccacggccuuauugugauaucuugagcccacaugguagaaggagagaaccauuuccuacaaguuguccucugacugccacaugugcacugcagcacacacucccucccuuacacagugaacaagauguaacacagagucgcacauuacugcagcucaguaaguggucaguguugacccaccagcaccaaaaaagacagggcgaucuggcugguaugguggcaucugcccgucaucacucaggacacugaggcaggaagauucugaguuugaggccauccugggcuacaguauaagacugugaagaggguggcagagaaccuagguucugaguacuuagaugucaucagggagacccagaguacagccuggccccauccucuguccccuucucauugaggguagguuguugugaggucacaccaaagcuggccucuuuccguggugaggcuucuaaauggcagagugcaguacaggugggcaugcccaggcugccguagcaucucacugguuccuggccccugacagccuccuggucccuuuguagugggugaauggacccacagccacuuagcaaaugugcccugaccuguugcuaucuggcugcugaagacuggcauggcauaagcagggcagcccaggacuccaugcuagcauuaggcaagcaugugauggaaggaggugacaggaggcugucuaggaacuggcuucuuguggaugccuuuugggcaugggcagggacuuauaaccacugccagccucacccuugcugugcauaggagggaagagcaagucaguggagcuggaggaugugaaauuccaccagugugugcggcugucacguuuugagaacgaccgcacuaucuccuucaucccacccgacggagaguuugaacucauguccuaccgccucaacacccaugugaguguagcaaauucccaggcaaguucaacaccaauccucccacauccucuggccaccugccucccagcucccuaugugggcugaaaccuugaccaccacuggcuguaccauggucaucacccucuacuggcauacacaguggucuccuggaagaauggggccuugucuggccucaguuuucccucaguagcaugagacauggugugagugccuucuccgcacccacaggugaagccuuugaucuggauugaguccgugauugagaagcauucccacagccgcauugaguacauggucaaggucggugagaggagagggugggcaccuuggaggcccaagucaggcgugggcagugccuggaauagucagaaucuuugguggguaaugggaauccacuaccaggcagagacuguguggcccugguaagguggcuggggguggccagacucccuuccuugcaucauccagagccucugccuggggccuccuugcaggccaagagccaguucaagaggcggucaacagccaacaauguagagauccauauaccaguccccaacgaugcugauucacccaaguucaagacuacaguggggagugucaagugggucccugaaaacagugagaucgugugguccgucaaguccuuuccggugagccccauauuugccagguaccccaaaauaucuucccaagacccaucccugugccaccuugggaaagguguuuccuuucagugaggggcaguccugcuuaguggcauccuggucccaggaacacugcagccccucucuguacccuacaggacuaggggagagcuggcuauagauccaucccaggagagcuuucacuuggugcugcagcacagccacagugcgcagaggaccgcauacaguaggauucccuggugcaccuccacccuuaucuuuguccucaccagagaagaaauagugagagccagggcugccuucaucuuucuacccuuucuguguacuggagaugaucccaagguaccccaagcaugguagacucuccuacuguccacacugacuuaagggccucccagaguuggggauuauaggugggaaggauggccaaacucaggguagaugcugccuggcccuggugaccacuauugcacuuucccagccuuuugucacauggcacaguggcaaagcucaucaguguccuacauauugcugcaguccuuuuuaaggccagguaguacuccacaccaugccccuuccuuuuucacugauaggcacucuuggugcacccaaguuaugcugcaguggauauuagugcacagggcucuccuccauacccugcuuccuguucucaggcauacacccacaagagaaugauuugccauuagaauuguuagaauuguuugaggcucugccuugguguuuuguguagcaguggcacagugucauuccugccagaggugcuuaacaguucuggauucuuguccaucacauuuuugucuuugucuuugagguugggucuuacuauguagcacuguuuagaccaggcuggccucaaacucacagagauccaccugccucugccuccccagugcuaugguuagaggcgugcucugguaucuguccucauguuuccuuggucuuugauuugugacugugcacccaaagcaauacugcagccacugacccaguccccagcccagucacacucccuccuuuaaguucaguccacucacugguaauuuuuacauuaguguugaugcagauaaacauuucuuccagcuccacccuaaaucuguacccaugaaaccuacaguguaacaugcaacaccauuuucuacaacuucuguuuucacauagaaguuguuuuguauuuuuauuuuguagugacuuuguuugaaacagggucucccuggauagugucaguggucugcaacucauucuguagcccagagugaccucaaacucuuguaucccaggcuggccuuaaacuugccaccuuccuccugcccugaaugcugagauugcuaggcccugcuuacucuuguguuuccugugagcaggucuucucuuuccauuuccccuuacuuuguuguuaggcaccaggagucagaaggcuguuugcuccagcucccaugcagaugucauggcauccuuuauggaugggagcugauaaaggggaguuaggcuauggaagcucuguccugcugcaccccagcuccuaagcaugguccuagucacagccacuccugcugccccuaagugugagcucaggaaaccaaaggccacgugucguggguauaacagaguuggggugccagacagaggggacagccaagcccaggccugaugugcuaccuggccagagcagggcaagugucucagcuaccugacuggucccacucucacaccaccuccaaguuauugcuggacuccuggaaaccugcaccugcccacacuucaguguccucccucucccuguucacaguccccuuggggcugugcaggaggacccaccacucuccccagugugcucccgugcuuuccuuguggaccugucuggacagucuggcuccacagccaccuauccgucucccuaggagcugguaaagccacuucacacccugucuguccugcuuuggcuccugggagccaugagcuagccugagagacagcacauugguugugggcugggcagccaccuaacuaccuccuacaucggcccccaggguggcaaggaguaccugaugcgggcccacuuuggccuucccaguguggaagcugaagacaaggagggaaagccccccaucagcgucaaguuugagauccccuauuucacuaccucuggcauccagguaugaauguguuaggucugacugccugaaccccacacuugagcccaaagucacaacagaaccuccaaacccccauccugacauagggccuauuuccuuggagccccucaaacuguguggaugaggggagcauauuauuccccugaaaggcucaagguuaccaagccugggucuuggcugccucugacagccccucauacaaugucaggccugcccccuuggccuugccuuuuggaugaggggugcuggugggggugcagcacacucaagguccuuguguccaggugcgcuaccugaaaaucauugagaagaguggguaccaggcccugcccuggguacgauauaucacacagaacggagguaaguggcugccugacuggcaggaccuacagaggucuuucuagacuguaucuuccuauguggagcugagggugggugcucugggugucuguguggagcugagggugagugcccugggugucuguguggaucugagggugagugcccugggugaccauguggagcugagggugggugcccugggugaccauguggagcugagggugggugcccugggugaccauguggagcugagggugggugcucugggugucuguguggagcugagggugggugcccugggugucuguguggagcugagggugggugcccugggugucuguguggagcugagggugggugcccugggugucuguguggagcugagggugggugcccugggugaccauguggagcugagggugggugcccugggugaccauguggagcugagggugggugcucugggugucuguguggagcugagggugggugcccugggugucuguauggagcugagggugggugcccugggugucuguguggagcugaaggugaauguucuguuuuuagauuaucagcuccggacccagugagaggccucugccaccagcccagcccaccuagccucagggcacaccugccacacucaccaaaacugaagcuagaggguggcccuggacaugcagccacccucuccucaagccugaguggacucacacagaaccccuucccuggucccauucugauccagggugggaaggaagggccugccagccucccccagggacaagccagcuggagcugugcuccuggugccucaugacuggccacccaccacccuguagacgccaucccugcccaccuccgaagccucccuucuguugccauuuugcugagcauguuggucauugucauugucaucuguggcuguccugucaccuuucuucaaguguccugugcagcugccaugcugcacuuaaugagggcagcuguccccuauccaugcuggucuguaugccggauaguugcucugccugggccggcugugccucccuugccagcccuugaccacaucaguguuuucucagaagggcacauggccucagccuuugcccuaaaauuccugggcaggcacaggcuacccucacuguacaaggccucguuguccuggacccaugugugugugugacaguuauauuaaaauccauuuguuacaucugcug

SEQ ID NO: 4525 - RNA, 2132 nt, Mus musculus
aggguacaauggauuauuacucagacacaaaaaggaugaagcaucaaccugugcacagaguggauggaacagcagccagaucugggggagggggggaucagagugugugaucucauugauaugagguguugagaccaggccaauccauacaaacuguagcaauucagugguuugcaggguacaagggaagcgcauggggaauggccuaggacugacagaggcuggguaggaagagaggcacacaguauagccaccguuuugaaugccaccaaauuauuccuuucaaaaacaacccgagagccugagaggcuguucagggacuaaagugcuugccgugcuggagagacaaccagagccuggauucccaggacccaaggaccagcagcgccaucucuaguccugaaacuccugcagccaggagcagagaggcaggacagucuucagagugagucucagaggaggugagggugauggccauaccugagagcauguucuaaaucagugguucccagucugugggucccaacccuuuugguaaaccuccaucuccaaaaauaauauauuaugauucauaauaguagcaaaaauacaguuaugaagaagcaaugaaaagccgggucaccagaucaugaugauauuuaagggucacagucuuaggaggguugagaaccacugccccaaauaauuaaaauuaaauuaucagcuacaugguaccugaauuucuauuuuaaaaacauaaaugugacuuggugccacaugagcccugugggcugggcuauaacucacuuggcagaguucuugccuggccugcauggagcccaggguaaacuuguaaucuggauaaacuggguacaguggcauacaccuguaacuccaccacuccagcacuuucaagguggagguaagaggauucugguucaaggucuuggcuacauaaaaaaaaaaagugaggcuaaccuaagcuaguuucaugaaacccugccucaaaauuaacaaagaccuaaaaggggacucaguaguuaagaugacuauucuugcaggggauggaauggggucugguucacacaaccauucauaggcucacacauggugcacauacaugguugcagacaaaacauaaaacaaggacaaauuauccagucugcgccuccuucuguuguggacagcuauuucuagcccaaguguguccccuaguggucacaguuggaagagugccaaggacaagucugcaccucccaaaaaaaauaaaauuuaacucuucucccuggggacagggcaguaacaacuucuggguaguagacaggccuugggggacacaggcaacuguagagcagcugugugugagauaagcuggagugacaggaaagguuaugcaggauuugucaugcaagaaagcgacugugcccuuggggcaaaggagagccagggcagugugggaacagagggggccagcaccgagggaguggggcuuuuccuucgagggcacuggggagccaugguaagcugucaagagagggagaugguugcaauuguaaucuuauuaaaaguggccuuaggucaugucaaacgugcucauuuuaugccuugcgggguggagcauguauggugugugagcaccuggacaccagucauaguuuuuacuuuuauagugcugaagcugcaacccagagggcccugugcuugcuugucaggugccugccacaggaggcugucugucuggggacacuuaaguguguaacuagagccgggacuuucccuaacuuggcuggcaaugucacucagcucucucccacuucuuugaaaagccugucugucugaguuuugaaggucauguauauuuuuucucuggcugacuuaaagaaucccccaacuccaugccuuuagcuuuuuucucauuuuguguuuuaccaaaguguaacuguaaagacgagugaauaaauaaauguaauaacuuuuuuaaauggccacugagauggcacaguggguaaagguauuacccagccugccuacuugauuccaauucucaggacacacaugcuaaguaaguuuccucugaccugugcaccaaacaaaugaaagaacaaacaaacaaacuucaaaccagacggcaagccgagugguggcacacacuu

SEQ ID NO: 4526 - RNA, 548 nt, Mus musculus
uccuuccuuccuuuauuauggugaaaaaaaguguauauuuagaauuauccaucuggacucaguuuagaggaccccaaucuugucggcaacaucuagggcauuauaaucaggagccuagggaacauccgccuucuucucuccgucgggccuuaucaggguauugacuuuggccacaucaaugucauagaguuucuugacagccuguuugaucugaugcuuguuggccuugacauccacaaugaacacaagaguguuguuguccucuauuuucuucauggcugacucaguggucagugggaauuugaugauagcauaguggucaagcuuguuucuccugggcucucuuccgaggauauuuuggcugccuccggagccgcagggucuugggccgccagaaggugggugacguucggaucuucuucuuuuugugguuguggacgccuuucagcaccgccuucguagcuuucaagaccuucgcuuuggcuucggcuuugggaggggcaggagcuuccuucuucgcuuucggcgccaucuuggcaaaaaggauu

SEQ ID NO: 4527 - RNA, 548 nt, Mus musculus
aauccuuuuugccaagauggcgccgaaagcgaagaaggaagcuccugccccucccaaagccgaagccaaagcgaaggucuugaaagcuacgaaggcggugcugaaaggcguccacaaccacaaaaagaagaagauccgaacgucacccaccuucuggcggcccaagacccugcggcuccggaggcagccaaaauauccucggaagagagcccaggagaaacaagcuugaccacuaugcuaucaucaaauucccacugaccacugagucagccaugaagaaaauagaggacaacaacacucuuguguucauuguggaugucaaggccaacaagcaucagaucaaacaggcugucaagaaacucuaugacauugauguggccaaagucaauacccugauaaggcccgacggagagaagaaggcggauguucccuaggcuccugauuauaaugcccuagauguugccgacaagauugggguccucuaaacugaguccagauggauaauucuaaauauacacuuuuuuucaccauaauaaaggaaggaagga

SEQ ID NO: 4528 - RNA, 2626 nt, Mus musculus
cuauaaggccugggugggccgggccacagcacacacagucccugccauggcgcucagcgagccuaucuugccguccuuugccacuuucgccagcccgugcgagcgcggccuccaggaggugagggcagcgaggguccgcgggcggcgggguagcaagguaccaggcuacagggugcaggagccaguacuggagaugacaagguccagggugcugaccgccucagggaguuagacuucaggcugugggacaggaggugggugcagggacugaggacacgcgcgcugaagggaugccgugcaccgggugcagaucuugagggccuaguuguuagacuuuggggugcaggguagcaggaggcacccccacucacgucccgcgcccugucuccugcagcgcuggccgcgaaaugaacccgaggcgggcggcacggaugaggaccuaaacaacguguuggacuucauccucuccaugggauuggacggucugggcgccgaaaauccucccgagcccccgccgcagcccccgccgccugccuucuacuacccggagccgggugcuccgccgcccuacagcauccccgcggccagccugggaacagagcugcugcgccccgaccuggacccgccucaggggccggcucugcacggccgcuuccuccucgcgccucccgggcggcuagugaaggccgagccccccgagguggacggcggcggcuacggcugcgcuccgggccuggcccacggaccgcgcgggcugaagcucgagggcgccccaggagcgacaggugcaugcaugcggggucccgccggccgccccccgccgcccccggacacgccgccgcucagccccgacggcccccugcgcaucccggcguccgguccccgcaacccguucccgccgcccuucggucccggccccagcuucggcggucccggccccgcguugcacuacgggccucccgcgccuggcgccuucggucuuuucgaggacgcggcggcagcggcggcggcgcugggcuuggcuccaccugccacgcgcggucuccucacgccgcccucguccccgcuggagcugcuggaggccaagcccaaacgcggccgccgcuccuggccccgcaagcgcgccgccacacauacuugcagcuacaccaacugcggcaagaccuacaccaagagcucgcaccuaaaggcgcaucugcguacacacacaggugggcgccuggccucauucccgggaucugcggcagggggauggccgcgaguucaggaacaggcuagguuacagaggaagacccuguccauccuccagaagggaaauggauacuguccccagagucuaugacacugccaaggggguguggcaguuuaauggguuggcuccgagggacucaggucucaagaauucgggacauaauuaagaagcuguggagggcugggcuggggcuuagcacugcauauaaaguuuggcaugguggccugagccugucaucucaguacugagcagaagaaucaggaauucagaccuaaucucagaauguuaggggaggaaugcaccugagccugcuaguggucagcuucaggagcccaagguucucuguuuagauuagaugugggauggagaugagagggagagggcagugcuauccggugcagggugcccagagcaggcuuucggggaaauugaggcucaaugucauuccucucugaugcaggugagaagccuuaucauugcaacugggaaggaugcggcuggaaguucgcgcgcucugacgagcuuacccgccacuaccgaaagcacacaggucacagacccuuucagugccacuugugcgaccgggccuucuccagguccgaccaccuggccuugcacaugaagcgacacauguagccugggucgacucggcuagcccaugcgcgacuguggcagguuccacgcgcggggcacgguccccuugcaaacagacugcuauuuauuggaccuuaggacagagccggacaaguguggccacaggaaaaugacucugccaccaguucuggcccccacagugacugaaggccccaggaaagaagacaggagucugugaagaauguuuucaaaauggugcaauaauugacuuauuucccucggguccccacuagaggaucgaggcuagaugccuugugagaaaugccuuugaguuuacuguccccaacguuuuuauaauauuguauauaagacuaugaccgauuguauuucuauaagggagacgauggcaucucugccgccugcuucguuuuuauacgacuuuuuuuuaauuaaaguuuuggaucuuuggaggaaucacgguagugguguggcuggggauaggguagguccugaggggacagggagcagucagugccuguggccaaggucaccagcugcagcccccagcugccaaggccuguggguucgcuauaaauguaaacaugguguuuuaggauugagcacagguuauuuuuaagucugcuacuuugagccauaauuugccccacccccacccccuguaucccaagugggaaaagccuuggcuccacugauguggcugaccauuccuuuuuuuagaaagaaaaauagaaaagaaaauuaaaaaccuuuuccugguac

SEQ ID NO: 4529 - RNA, 80822 nt, Mus musculus
gacacccacuuuggccuuugccaguaccuguguauauaugcucaccacucauacccaauuaaaacagacacugcagucgggcaguggcggcacacggcuuuaaucccagcacuugggaggcagaggcagguagauuucuaaguucgaggccagccuggucuacagagugaguuccaggauagaggacagccagggcuacacagagaaacccugucucgaaaaaccaaaccaaaccaaccaaccaaccaaaaaacagacaaugcggcuccucucccaaucacugguggggagggcucagcccgugacccauacuuucugauuaaaaagaagauagucucauguuuuguauuaaaauauuuuauauuaaucauucaaacuucauuuuuauacaacgaaugcauacaucauguguguggggugucuuguggaugcaaggaagggcuggggguggagcuugucugcagcuaggagacuggaggccuucucugucagccacugaaugauuggaaggaagagccuaacugaucaccaucauaccucagagacuggcagguuccaggacuuuuaccuauagcugccuuccuggcccacccacaggggugagcagugucugaggccucucaacaaggucccuguagccugaggcccuguggccagcuguccuuggcuguggcauggcacaacuugaagggauguguacauacagcugcggcuuccccugugucaccuaggcuggcauaucagccuugcugagggcgauggccaguuccagguccuccuguuccugucgccgcagccucgccagccgcucuugcuccgcuuuuucacucucccgcuuggcccaagccaauugcugcuccucauugccaaacuacaaaggaagauuggauagugagagagggcucagagccagaguggaggguccuaagaagauacaaccagaggcccaugcuggggccugacuucaccccauggaagaagggccagggugcauucaaccugagcugccuacuggagggcuaggcacccauccuuacagagagaggcagcuggaccuagugcuggaagauucuagcaggcagauccaauaacuaugggugcggucuauagccuuuuuuucucugucucuuuuagaaacagucuccuuauguagcccagguuggccuagcacaauaaccaaucccacugccucagccaccccuccugauugucaacacucccacacucuuuagggcugcagccacauucuaccagaucauaacucugcuccaugcccucuagagaggccucaagccccaagggagccuacuucuuguccagggacaucaagagucuucuuaaccacugucucuuccaaggaauauuugugacacuagggacaagguuccaguccucuggagcagacagacaccagcagugagugagacugacaaccugcagccuccuuggggagggagagcauugcagggugguguggaggaaugaggguaggugcuucuucagcuagagcauuuggcccucagaucaucuaucaacagacagcaguaacugacaacguccccucgucuguacccacagaggguuacagaucacccugccucagacaagcccccaucagugucuagcagcaaggccccuuccauacugcaacccacacacuggggugcuucagagcuggaggccaagagagggaauuccacacagaccugccucauguacucuguaagcacaacaagcacuugggcugagagaaauuuccagaaagagaauuucucagggauuuacugacuaucccugcuuggauugggccaccucuaauucuccucaggccagagcuaaaccugugugucuuaggugccccaagauagcaggaguccaccuuucucauacaccaucaucauugagaaugugugucaagaaguaaaaauuuuauuucugaagccucuuggaaauuuggaaaugccccuccauagagcaugcagacaggcucugcccccacuucccagcuuguucauggaguacuugcaaggcccagcccaaccagucugaugucugcuuggcucucagggaagcugugcagacaacagcaagcuacuuggcuaaaaaacccccaccagauugcuuuuaaggaggaucacaaucacagccugaggcuguuuguucuguaggacagggacacaggcaacccaagcuggcccugaauucccuagaaguuugacgggcgccaccgcaccugcuaagcagaagacuugccuggauguaaagaaaauucuuuuuuguugccuuuaagaaaauuuuucucuaugcagcucaggcuucccuccaacucagagauccaccugcugccaccucccauaugcugggacuaaagugcuggcuccuuuguccuuuuuuuuuuuuuuuugagacagggucucuuguaacccaugcuggacuugaaccagcugaggaugaccuccugaugugacaggccugcaccaagucugcuuuacacagugcuggggauaaagucuugggcuuuagguguacuaagugugcauugcugagcuacagucacagcccagaagcuucugcgagugcuaaggagcuacugagggcgggcagucacccauuaccagaaagcucuggggugccacugcagguaccaaagauagcaguggccauccugcuugggugaaaucaguucuggaagcccaagcuaagcaggcugcuuucuguacgugaugacaaccuuuucagaguuugcacagcauuaaagucccaaggauccuggaaagcaggcucauggagggccaucccaaguccugggagggcaguauauuuauggcucagcaaggggaaguucaaaauccuaccagauuuuucuggaacaugguccuguuccagagaagaccguguguacugauggggacacagggccccucgugguggugaaggugacaacaacuucauaacaauaaaaggccacaggccaggccaggcaggauuugguuuccuaucuggagaugagaguguuuaaaucagaauuuaaacuagguauggugcggugccugacaucccagcauuuagaagcuauaaaauugagaccagacugggugaauccguuucucaaaacccaaacaacaaacagauaaacuugaaaaauaaaacugaagccuguaacuacucuggggcaacgaguuguuagcucagucacagcuuggaaccugguguucaugacaaaacagcagggcugggguguucugccugugugggcacaggaaguaaacuggcuuuucagaaaggccagucauuucucuacacugugguucagcuccaucaccacucuccccugccugaaccgagcacuggagucaugugccaacagcugugcuguuugcuuguuugguuuuaaucuuuuuuuuuuuuuuuuuugguuuuuuucgagacaggguuucucuguauagcccuggcuguccuggaacucacucuguagaccaggcuggucuugaacucagaaaucugccugccucugccucccaagugcugggauuaaaggcgugcaccaucacaccggcacugcuuguuuuuaaaauggauuauuuuauuuuuguaguccaggcugaacuggaacuccuaauccugcugcugagagagaaggcuguguggccccggggaugggcccagggcagggcaugcuaggcacacgcuggacucacuauaccagcucuggccuuugugguuaguaguuuccaccagaaaauaacccuggugauauccaaacaacucaaagugcuuuugucucugguuuuuacuaauaaugucacuuuucugaaggcacauuguaggcacugucaacggaacugaugggcuacagagacaaauaguuacaagaccccaggaaucaacauauuauuacuauuaauauuuuuaggcagcaucuccuucuguaucucaggcuggcuucaaacuugagauccuccugccucagccuuccaucccaguacugggaugagagguaacugccacugggcccagguaugccuuaggcaauucaaauuaagcuacaggacaauuggcuggggaggaccaggguauuuauugugcaauacaaguggguuuuguuugguuuuguacugggaauggaagcuaggguuauaugcaggcucugccuguccaucaugacugagcuacacacuucagcccuccagguccgcuugacaccugucauuccagccgugcacauaguacacauagguuagggugcaaggaucaguaaguagcucaaggucauucuaggauagagacuaagaagguccaggcuuauuucaaagaaacaaacauaaaucaguaaacagagcagcucuccagucucuccugacagccaagcaaggagcuucaccagcacaaaggagagcucuugaaaaaaaaacggccucaaccugaagggcgaaauggauuacaggagacagcaccaagcacggcugcccugaggugcuggaggaugcugaggcuaugcugaaggcacuggcaggcucuccacagauagcaaggcagugcuagugagagcccugggagcuuccacaaagucucuagccacuuuggacaaguggucuuucugaacccuuggaaaagaaaagagguuccaagguggucaucuagguugaaauauuuuucaguguagcuaauaaacagaaaucagauaaaagcacaaugaacaguauccaaaucucucacucucuggauacccuaccuggacucuuuugcuccuaauugcaugaugcacuugggcaggaccacugacucaaaggucuuuuuggaggcagcagaauccuggugaaauguuuguaauuggucucgggaagugccugucugcucugccuccagacacaaugaaccagugugguggcacacaccuuuaguaccaacuaaagacagagacagguggacucuuugaguuccaggccagccuguguuacauagcuaggccuugucucaaagacccagugaacagaacaucuucugagggccacagaucacaagccacugaguacugaggcaggcaugcugugugugugugugugugugugugugugugugugugugugugugcgcacgccacucucccugcaguucguuaaaccauggcucucaucuuuaucaacagucuauuugccuuacagaagccaucgcagaauaaauaacaaaaguaguuggugacuguugggaggcaccagcagcagggcaaagcaguguccauagcugcagagggacccccaccccgagaagcagcaagcgaggcaggaagguggccgagggaggacucaacuuacagaggugaagucggcaaagccggaggaagaggucuuaggagguuuagcugaagaggaaggggcaaauggaucuuugccacuaaauggguccccaaaccccuuuuuauuuuggaacgggucgccgcugucagccccgaguggcuggaauggaucaggggacucagggaagucugaagaacccagcuggcuuacagguguacucugaccuggaaaguuuagggggaaaacacaaaacaaaaacagaaaaggaaaaaaaaaaaaaaaaagaagaagaaauacaaguuacuuacuaggacuagaguggggaccuggcugucucucuagggagagcagggagauuuagagaaggguggcccuggggguucugacuuuggggugugugugccuggaauccaggaccucaugcccauucuguacuuauuauacaauggaguuacauucuauauuaaccuggaacagaguguagcaaggucaugccaggagagugauuuuuuuuuaacagcuguuuuuaagacagagucuuauguaggccagguugggccuugaacucaucuuccugccucagacuaccaagcucaaggcugacagguguguaccaccuggcccaagcuuacuucaggucacaugcaccagcagcuaacacuggaccugucuuuaguaguuauagacacauuguuuuugcagaguguuugguucccaguaccaacauucugguucuacagugucacuggcccacacuucucuaguuacuauguauccauucaaagaauacuuagagugagacugguagacuguuuccacuugagcuuuaguccaucacagcugagcagagaaacacauugaaaacuucuaaggauagcaagaggggguaggaaggucucccuggugacgaggccaccaacucacuagaguacaggguaugacuacaggugacaagcaccaggcacacaccagaaaaguaugaauuuccaagccgggcagugguggugcaugucuguaaucccagcauuugggaggcagaggcaggaggauuucugaguucaaggccagccuggucuacagagugaguuccaggacagccaggacugcacagagaaacccugucucgaaaaaacaaaacaaaacaaaaaacaaaacaaaacaacaacaaaaaaaaaacaacaaccacaacaaaaaaaaguaugaauguccagccuggcucucuugacuccugguguugugccugagcacgcagaguccagacauccaacauggcugacacauuagucccaagggccaggucagcauagcucccugguaucaacugaacuacccacagaagcucacacgguuucaaagucaucguuuagaaagacacgaaagcaguugaccuuggacaccugguuguggggacaacacaaagccugagccaucccaggcgccaacauggaaggagagagacauccuguaaggcuguucugacucguucguacaauggcccucaucucccaauaauggguaaaggcaagaaaagaucuuaguaccguguucuguuuccccagaccaauaaaacccccaccucaauuucugagcuuccagaugucuagggcuucaaguuuauucugaaccugccaccuucugaucuggggcucauggaggaaaaguucugagggcuaguuggucuuaauuuccccauuuguguguggugcaagaaugaagagacugggggugcugcugccugugggugauacuuagcagccguuguugguaugugccugacagagcccugguuuuagcucucuucuggaagcagcuguggcagcugggccucagcuguaaugugcaauaggucagauccaggcugugucucagcuuaacuuaggccagagguacagcacuaugagaaguaagucucauaucacaguaaccuggugccaccaccaggagauaagaaccugauaggguagccaaggguuccugaaguuucauaguguuauacuccacauacucacagggacacagcagaugcauggccaugguggaguccguugaguaucacugcacuguccuuucagaaggccgcugcuccccccucccaaagguagaaucucaccaugcagagcaggcuagccugaaguucacuaccugacugcugggacuaaaggcaugcaccaccaccccggucuccuuagauuucugcccaggccaugguuacagaccugaagacacugucaggagggugggcacacaccuggcuccuuugaguaggcuucuccuacuccuaagaaccccggcuguucucucugcccugcugccaaccuccagcccccugcaagccagagcucagcaagcccacucaaccagaaaugaggaagcaggcaacagaggcuggggaugcucacaaaccagauacaugcuugguauggagacagggucuagcugcugcccugaguuuccuucuucaguccccagacugcuaugaacacaacuauaagcacauccuauuugcagagagccucagccaaggaagucaggcaaagggacugugacauggacaaggugcuuguccucauuugagugcucagaucuccccacuagccuagcauacucacagauucaccucaccuguucuccaucaggcuuuucucccauccacacuuacugcuaacucacugcuuggcucacauacauuccugucacugccuguggcccuugugacuaaagccugcugugccuucucauuuucuucucagggauuaaaacuauucaagagucugucuuugcucuccaucuucagccccccaccaggugggagggaggacuuugacugaauguggcucuccacagcacaaaaucuggguuccccacguaucugaacaccaggaaaguccaggaacguaacaacucuccuagauuucugcaguaaugcccaaaccugggcacucuuuuccagucagauaucaucuugugcuaccaugguuucugaagcccaucccuaucauacaugcacacauacuaacacaugccugugcaggccuaguacugggcaaggugcuaggcucaagacugcagcagcuggauccuggagggucaugaggagaggagggaccuccuuacacaucccuacccagccuguguugucugcucucagucugucuccacaucacaccaucaaguccaagguugaaagcucugaccuugagcuaugcagaacaggucacuaauggaaacaggauucuuuuguuuuuggagaaagggucuccuguagccuuaaacaugcuauguagacuguauuccauagccagccuugucucacaauaaaaacaaggguagggcacuugcuuagccuggaguggagcuccagguuucauucccuacccacgagcaauuaggcaugguccaucaugccugacucuggcacagggggauuaaggcagaaagacuaggaguucaaguucaucacuagcuaccuagaguuuaaggcaagccuggacuccaugagagccuuucucaaaaacaaugaacaauaauaauuuaagaccaggacauuucuuguggugugguaggucugaagacaccugagcagggacaggaggugacuagccacuuguuuuuuuguuuuuguuuguuuuugagacagguuuucccuguguagcuuuggcuauccuggaacucacucuguagaccaggcuggccucgaacucagaaauccaccugccuuugccucccaagugcugagauuaaaggcgugcgccaccacuacccggcgacuagccacuucugaaccucucucaucucuaugauggagaacucuuucuccucuggcuugaggaauuaaaaaaauaaagcaaaacaaagaaacaaagaguuuugcugagaggggugggaagccagcuggcugcagccaugugaagcucaggcuucugagagcauugaggggaaucaggaacgaaaagacuauuuuacaccaagacucgguacagcugaaaccguuauuuagaaauugugacugcgcucacgaaacccgccagcaguaacugguaucucuuguuuucaaaggaggaugacgguuuucauaugggugguuuuuuuuuuuuuuuuuuuuuuugguaugugugugcuggcguacaggcacuuuaggucucugucauuugcagguuggcauggcccugguuugagccugggacuuggcacccugaguuauuuuugguggcuguauuguuaaggcugaaucuaguuccugcuuuuauguaaccacuucugcuaacucuguaaucgcuuucccuauuuucugagguggaguugauucucagugugacaaagucacucuguccaccccaguuguaggaagcaaggucacagugcuuuuggcucuuuggauaugagcauggagaaauggccacagagaaggaauuggaauaaacuaaaaacugcugaggagggaaucuggagucuaaggacaguauggaugacauacugaggguguaucuaaaagacaaaacaagggacuguugaauggcucaguagacagaguugcuugcuccuaagccugauaacccaagguaaauuccuaaaauguacacaacggaaaaaccaacucccgucaguuucugacuccaccuguaugccacugacucaaggauacacagaagcaaauaaauauaguaaaccaacaccgagggaagaggcgagugcacuccuaacuauaauaauuaauaauguaauaauaauaauaauaaaaaacacaguuuuuggccaggcuaucucugaguuugaggccagccagggacuggcucugagacagcuagugagagcccucucacaauaacaaacaacaaaaaaguuacacaaaaacuuugcaggcuggugcucauagugggcauggcaccccuggcccaugcccccagugcacuagcugagggacuggagaggcacaguaggccuuauguggaaaccacagcaguuucaacagccgcccgagcgguguaccgaaaccacacacagcacugacuucggcaaaaacaacacgaacuccaugguuuaccacagcguacucugcuaaaaaaaaaaaaaaaaaaaaaaaaaaaaaaaaaaaccuuacucaguggccggccccacccugguaggaauuucuuuaauuuuucuauuucucugguuuccuaggcuauuuaucuccucagcaauagaggcagcacacccagagacuaugggggaggaaggugccuaucucuuucccagcuugcuuuucagggauuccccugagcaauucccagagccaggcuuggacaauguauuggaauugccaagagccaggcuugggaaauguaucggaacugccaauagucagcuucgagaggguagucucuccauucaagaagcugaugcaggaggacagucagagaccuggggugcaggguucuuagaaaucugauuaccaagaauaucaaaugucaggacuggggacccacauguuagaacacucaacauguuuggagaacagggaguccugggcuccacccagcaccacauauauaaggaauggugcacagcucuaaccucaguaccccgaaggcugacgaaaggggauugugaguucugagcaagccagccugggguacagugugagagauuuugcuauacuugggaggggguguauguggaaaugcaaauaaaacaaaauacaaccaagagagagcaugcgcuugcucuugucagacuucgaguucuguugacacaauucauugcuguacuuaaaaaaaaaaaugcagcucugcagaugggagauaaauacaggaaaaacaccccccaaaagacaaccagaaaaacaaagacuaaagcuuuguggucagggcagcugccccacccuagccacuauccucugcaacccaggacucucccacacugcugugcacccugacacgggcaccacagaacuguuaggugucccagaggacacacacugucagugauuuuacucucaacagaacaguaccaguugcuuauacaucagguuucugaugggaacuggacgagggacauacacgggacagggacaucaagaggucacuagggaccucaauccauucugcccuaguggaacagcaaaauaagaguaagugauggcagagaagagaaaaaucagauugccugacucaaacuuucaacugucaugugaaaggaauccuuuuugcccacaccuccauccucccgaugacuuguucuggaagccuguuggccaggccacugagggccugcaggcagggguccugaagacuagguagguuggaacacagcagagcagugcagcccaggugauagaugucugaggucccagaucacaucauggugcugacauuuuccaccaaaaauauuuaccaauuuuugagaagaccagcuuggcacauuggaggggacaggaugagguuugggucugagcugaggggaaaagcugaacaaauauuuguuaucucuaccuaugcuggcacuauguucgccugcugucaagugggcaggggccaugggaaacucuggggcuggcaggccgguagacaaagaugucacuccuccauggcaagggaaucuaguggccacuugcucuggguccacaaaggacacauggauuugaagugaggaagacaacuuucuuuccguuuucacacaaggcugcuaugaucucugaugaagaacugaugaaggacauuagccugcagaagaaaauaggcaugggcaaggcugacaugaacugugcucugagacaggcuucacucugcagcccccaugugcugggaucacaggcaugaaccaccaggccgugcaccuguaagucuucauugugcaaaagauugacagaucucccacuuguucuccaguagcaccuuugccacaauccuucuguucaagugggugcacagggagaugguaucuacacagaagccagacaguggagggaguccuaggugcuugccaugcacagccacgggggcugccaggaccucccacuuuuguccucccuacagggugcaaacauaaacagaacgguaccucuacaaugggcagguagacacuuuggcacauuuauaaagucaccacagacugugaugucugcagugggaaugugugccccgugguggaaagggucacaggccuggacaggaccauguagacuugggggagggguuuccuacuuggcucucuacugaccacaagcgugagcuacuauacugagcucacuacaggggugaugugucaaucauuuauauaccuagagaccuggccugaguccuuuaggugaucaaagaguggaccuucagccaagugagggccugggaguuguucccacccacuuacuaccacagaggcccgguaggaaggcccagucuuucugggcuuacauccugcaggucccccagaaccuccacuguccagauugugacccaccucuggugaggcauuuacucguuaaugaauaucaggccacaggacacccacuggauccaccuugcugagugcaaaagggugggugugcugagguaggcacuauuucuauuuucaaacuguucugccaaaucuucccucaacaacagccggccucaggcugcugaaaccagcuggauuagcauggguuccuccaccgccugggaaggcaaacccauacaguauaugggugccucccucccucagccagcauagaucuacagcagccacugguuaucccgagcccugggacagacccuccagggugccauagcaacagcagagcagugagugcccugagugugugggggcugggggcugcuucaaugccuuccggccauccuggcugcuagcgaacaccagaaccuuccugaaauggaacaaguacauuccuuucuauacucuccaguguacccagcgcauuaucucuuugccaccaucgugggaacggaauuaaaguaguuauauucagggcagaggugcuaaccacaggcucagacagugaugccauuugacaauacgaaguaacaaggggcuugggcauagacaggacagccagcagcaccagggcccugacccgcagguuccauccucuuccugggaucucacagaaaggcugaaaguucacaggauugggcugcuuacaauccuaaauauucccugugccuguacccugcugacccugugagaaagccuuggccauucugcauagauagcaugugggugggggaggacuuuucugcucgaggagaaugacuuuuugcggaggaauucaauacacaggcuagaccauucuuauguagcuugggaaugggcugcucacuaacacaagcacucucaguggugcugugggaaagggaaaaaaaaagcugccaaaaucuuccuccuguaggacaucuggccuugcagaugggguggagaggucaugaguaguuauaaagaugaucauuaacuuagggagagguuaaaggugacuggcuggugagugggugucacuggggcagcggguaggcucugcugggagccgcagggcagcgcuggcaggaaguggcaggguggggcccgccaggaucccgcuaucucaggcaacccaaucacugacgcccacacagccguuuccugagcuuaaaaaaaucuguuucucucuuugcaaaucaacaacuuuuaccuagaaacuucagcggugaguucugacugaucuccaucuccguccguugaagaaaauacaccacuguuuaccugagggaggcgugugcucacuccaacuggcguguuucagggcuguuuugcaugugucugaaagcaaucaacugcuucagucccagacaccugcagguuauuuaauacauugauggaccuuucuagaaaagaucuccaggcaggagaauguagagcuuucaagacauccaauuucugugcacaucccagcagccuaaggcucacacucugaagcuucaaggagaaaacuauacccuuagcaucaagcugcuagccaccucagcugcuaccagcagcagugacuguccagaugcuuagggagacuauucgacagaccaaacugaucucugugagagcagagacugaacuccaagauagaacacaacagcagaguaguguauaaccccaggcccacacugacacucauccuggguaaugauucucaggggacccagggcuggcuuuaaauuugacaccuuaaacaucaacacuuuucaacagaagacauuuuucugaauugucaccucaucugggucaggcccaggugacacagguggcuguggggggugaacacauaauacaauacagaucccacacaacaccaccaugccaagugcuuuacugacaucuuggacucagggcugcccagggacaucugccuggggccuucacauuccccaaagcagccugacugaacaaccccuuagaguuggauagguagcccagagcccacuagcuccuucagguuagaaaagcccagguaggaaggugguggccuaagagcucucucacaugcagggcagcaggacugcagagaagccacugucucuccugacuccugagccagguaaagcaugucuugggaagcacuguggcaugcuuucuccaucagaaggccgaccaucccuggagguccuugggcaggcacccucaccucaucuaucuccuccuagccaugcugggaccagcccacugcagaguuccacaucugucugacaucccaagggacugagcaauggggugugaccagcuaaagguauuuauugcuguacacuggucauaugguuuuccccaauggaaauuggguaggcagaaaaccaccauccaaaaacaguguauaauggggcaggaggaugguugaguucccagucaccauagagauccugucucaaacaccauaaaauaagauaaaguuuccacuuuggcuucugagcgaguguagcgguggagcuggucaaugugcacuguugcccugggaaccugggugaguggcuguggugugauaaggaugggucaggggcagaggaagugcacggcuaugcuccaaauccaugcaugaaccagggagcuggggcaaagagccaaaugcuuucccaucaaacagggcuaauuaauaggucagcugaggcaggggaggguccugagcugugcacagguaccaugugguaccuguauaguuagagacuaagauaagaucaacagcaugggaugcugggcugacaugcauccaccacacaucuguacguaccacccagcaguguguacacaaccgugccuuucucuccagcugcugcuucuggguagagugaauaagaaaugcuuaggcccacaggugcucugcucauggguuagaauguacgaaagccacaguucucaggaugaggacucuccuggcuagguucuccugauugcugauguacgagcaaguggcaaguaacagagacaaguagugggcagaguggggggccaaggccuagugcagaugcuaucuucccugugagucuggguggcccacaugcccaccuuccucugugguaagugggcaucauauugccugcuccauggaucucauggucucacuagcaaaggaagagauaacaguugcuucaggccucccaaggucauaauggcuguggcagagcccagcucugcaucauuaauaagucagguccagagagccucagacagggcuggcugauggcccugaggucccaaccugguccuauucuugagagacuuggcucugaugccacugagggcuuucucagcauuuuacaggcuguccuuacucuauaaaucuagcacgagaagcagacaaaacagaaggacauggaacgauguauggggugguggugugugucuccaugagaacacaugcaaaugaaugacuguacaccugacacaggcaguguggcauacuaggggaaugaauucucauuugacacucaaacauuuggcaccaugagcacauaugcaaacauguacacaggugcagacauguucaagccuuugcuuucaagguccaugugagccuugagugaugaaacacacaugugacgggcuggagagauggcccagcaguuaagagcacugauugcucuuccaaagguccugaguucaauucccagcaaccacaugguggcucacaaccaucuguaaugggaucugaugcccucuucugugucugaagacaguuacgguauacuccuauacauaaauaaauauugaaaaaaaagaaacauguguguguguguguguguggggacacacauguguaugagauggugugagugcacgcacacacacgcugccugugaaugaagggcauguaugugugggcaugugugcuuguguacaugcuuguguuuuuccaucagcaugaagcuacugaggugagggggugcagggcgcuguucauagcagaagggcucccuugcacuuuggagucaacaucauuugcaaggcuccucuccaguacuucacacaggcuacucaagucauauacugcuggccagaccccccuuauaaggaaggcagugugggcauugucccugaggaacacaggugggcccaggugaugaggcaggaggagagacuccuaaggcuuucuuccgucuauccaucuucugcagguggacuauacagaaagugguaaucauguggacucagugagcuggggcaggcuaggucccuucaaggggcaccugcucuuauuagggacuggaaaggagauguuacacauuugugucacucagauguuccuucuucuucacaguauuggauaucaaagugagggccuugggcacacaaggcaagugcucuaucacugagccagucagcucugucccuagcucuuaacacagaagucacaaguacucaaaaucugcugggggaggacacaauggcccucuuugguaagcagggcucaggagagugaaguuacagggaagagggcaggaagcuccucaggcagccuucucucaaccagcugaguagaguaauaauggagagccaggccguccugcucauucaaaacauccaagaaagccacuaucuuacccaagugcccauccagucaaggcuacccugagccccugcuguagccacccccacgagaaaggcgcgaggccaggaggcuacuagauagacauugagggaccacgcagauggaaaaacauugaugaggacaccaucauagccuggaccaugggacagggaaauagcacagcacacacagcacacucugagggggaaggggagcaacagggaggcaacuuggcagaggggagacguucugccuuggggucugcucuacucugggcugcucaauggaggggcccugugcccgccgcccuguccccaccggcgggugccgcgagaggaggaagcguacugaccgcugggcgguuugggccguggaggagcgggcuucuucggaggcagagcaggaguguccuguuuacuuuuaaaggggucaucugagaauccugugccucccaaggaggaggagaaggggccagaaggugggggcuguaagagaggacacgaaagaggcaaaaauagacauuaaaaagaaggcacugagcaaaugcuuccgcaccaagagcccuggcaauacccggguccucucaagcccccgcuuuccuuuacccucaaagccaaaaccucuguaugaaaugaaaacagccaauacaagcagcagaugguaacacugcucuccuguggccucucuugcuacauuguggguucuuucccaauucaacacugcacaugggucccugggacuucuuucuguucaugaucagagacaugcauggucucagccucuacuggacuggaacagaccagacccucucaggcuggcaugucugcuccaauggcuacccauccccaucugcuggcaagucaauacuaucuccacccacucuugguagccaugucagcuuguuucccuuauccagugcccaguuuaaguagcccccauuccacugccugaaauaagacaguugcaaucagauggugaguagguggguaaauguguggauuggcagguagacaaugguaauagauagaugggugggugaauggcuauguggaugaauagauaaauaugugagaggauggagagaugacaggauagacugaugaggguaaauggaugaguagauggauggaugguacaaugguuaguuuaaacccucaaccugacacaaucuacaaucaccaggaaagaaagucucaauuaugagggcucaaagucagaauaaggcuguccuguaggcauggggaaaggacugucuuuaugacaugauuugaggugggaagacccacucacuguguguagcaccacuccuuaaguagggaauccugaaagugagagaacugagaacuaagcacaaauauacauguguuuaucccccgaucuuaaacagucgagaucacagggauaugacuggcuguuucaagcccuacccugacuuccacaggguagugauggacuagccugccccucucccuuaaaguugcuucugacaggauacuuuauuagagcaacaugaaagaaacuaggccagacggauagaauaaggaguagauggacaguggguagacacaugaauggacugauggaugaagggaguauagauggauggauuaacagagagggacaggugggugugcgguggagagagguugugagagagcugcuggguggauaaacagaagacaauggcauccauggggcugacgucauaacacacuccaaggucccauccuccucuggccaagucuugggucuuauccccaagcccauuuccucaaacaaacaaacaaacaaacaaacaaggcuugguaugagcucugagagcggcccugaggacucagccaaauccuagagaucccauggguaguucaguagcugaagcccacuguggcugagcccugccugucggucacaacucugccuuggcacuaucucaguggugggccugggcauuccuccugugccacaggccucgucuacucaugguucaaggucagugcugaacaguggcugucaggggcccgugugucagcaucauaggauacagugccucugacuaaugggggacacagccuggacagacuagugacacacaagcucgacugaggugcucacagaaaagagcugguuccuucuauaugcuguguggggagggguggguaagaaacacugcuuucuuaugucagguaguccuggaguuuccugauacuccugccucaaccucuugagagcuaggaagauagggagguguuaccacaccugguggagagcaagcaaauagggaaguguugucaccaagccugcuaaccugaacuuaaucccuggaccugugugguagaaagaggaaacucuuguaaucacaaaugcacaugggcauucaacacacacacacacacacacacacacacacacacacacacacacacacacacacacacacacacacuauaguuuaaaagaacuaaagugaaacugggagugcuggcugcucuugcagagguccuggguguggcucccagcaacugcagcccaggcaucuuacuccuuccucugaccucuaccacaggcauagaugcaagcaaaacauucauacauauuacauaauuuauaaaaacaguuuuuagugugacauguuugggcggguaugguggcacccgccuuuaaucgcaguacaggaguaucuuugagcucuaggccaguuagggcgauagugagacccugugaugggcaguuuuaugucaacgagacacaagcuaaagucaucugagaggagaaggagccucaauuaagaaaaugucucaaaaaaaaaaaaaaagaaaagaaaaugucuccagaggcuggagagauggcucagcggguaagagcacugacugcucuuccagagcucuugaguucaauucccagcaaccacaugguggcucacaaccaccuguaaugggaucugaggcacucuucuagugugugucuaaagacagcugcagcguacucauauaaauaaaaauaaauaaauaaaucuuaaaaaaaaaaagaaaggaaaggaaagguuagguuuccagcuuguuaguggcaguguacaccuuuaauccuagcgcucugagucugaggccagccuggucuacagugugacagccagggcuacagagaaaccuugucuugaaacacacacacacacacacacacacacacacacacacacacacacacacacacacacacacacagacagacagacagagagaggaagaaaggaagagagagagggagagagauacagacagacaaugccuccauaagauagggcugcagguuaaccuguagaacacuuuauuacuuauggauaaggaagagcccagcccacuguggguccuauaaggaagcaggcugagcaggccaugggaagcaagccaggagguagcaccccuccauggccuuugcaucagcucuuaccuccaaguuucugccuugugugaguuccuacucugugugaguuccuucagugaugaauugcaauacggaaguauaagucaaauaaacccuuuccuccccaacuuucuuuggucauggcguuucaucacagccaugguaacacuaagacaguuccuuucucaaaaagagugaaauguuuaauaaaguggacacguuuuacccaacauacaagauaaugagcgaaguaugggccacaaacaucuaguguguugccaggcaugauggcacagcugccaucccagggugucugcaaguacugggcagaaggguucucccaaagaugacaugagacucuucagaggagcccagagagugagagggguuggcgcuuucuguuuccuuccccacagggcaagccaaggacggaaagcgagccagagaacccaggacccauggcagacucagacugagggaagaguaugagaagcaguccugcucuagccaugcacugaccccuuacaggagggguguggcagggacuuguaguggcucuggcaucuaagcugacaccagcaggcccuucaaugcuuucuagaagcuccugggcaggaaauggcuacuucuauauggucugugagagauuucuacuaccauuaccccugcuuuacacacagacaaacugaggcacagaagucaauguggcuugcccagacgauaccggaucaguguugacccaguacaccuuguccacuaccuaggccugggcucccugacacugucugaaggguaggcauagggccacaacauggaaacuagcccuguccucagucuggaggugacgcacauggaccuccaggacuugcuugccagucuaggugaagcugugagcugcagguucagugagaaccaucucaaacaguaagagugauugaggaagacaucuaacacguacacacacacaucauaugcacaugugcacauacauacccaagaacacagggcucucugcaagcuccauauuuacuuccuaacuagucccccaaccccccaaucccuauucccugcagcugggaguuucaugcaggaaggccuggugggcuggcaggcugcagugcagggagaagcagaugauacucuaccaagaauauucucaagucuuuauacacaaauggcagaguauuaauucaaagcuuguccaugaaaguuuccagaacaucagccuggucaggcugcagagcccuguggucagaggugagcuagguuaaucaaccugaacugaaaucccagcccaacucccugugccuugauuucccaucuguaaugugacagagaugagaggccuucacugucuggaaugccccagaaaggaagugucagguaaaaugccugucagacacuggauagagcagcagagauggcacauugaauacagcugccccacauugucacaucaugauccguaacacugagaacaugaagaggaaaaguuccagaaaaacaguuucugggucugaaauaacuuuuauuacagcaugcuguaacuguuccacuugccaucugugccuuguuugagucacacuuuuccagaggugcagauggaacagcgaacauggggcucaggcacccacugggggaaggcucccaagauggguccucacaggcuaagaggacacuuguguaucgugaggcacgugggcaggaucucaccucuuucugaagccugugucuacagacccucagcuccuccugccuuggggacuggaaggagguaggacaagggucaucuacagguuaguggcuguuuuuguuguuguuguuguuuuuuuuuuugagauagggucuugccauaaaucugaggcugccuucaaaugcauguuacucuagccuccagacaagacacagcaugagagacgcuggaaagauggcuuaauauacuugcaagcaggccuagcgaccugaauuugaucccuggguucacauaguggaaaaaaaauauugacucaagcuuggcacaugggugccaugacacccugccccaaaagaaaugcaacuuaauaaagaaaaugaaaaggcacuuguuagcugaaggcaaaugagagcucaagcccgugugcacugaguccugagucugggugugaaauccagaagccugaagagaaggugcaguacagaugacguuuccuggucuuggggugcuuccuggguauaaguuauguccugggacaggucuccggacucaggaaacccugagucacaggaaggaggaggagccggagcagcucuacuuucuaauccacacaggacccagugcugcgugacucuccagguggcugcaaugucccaggcaagacagacgugucaucuccccaaggaguugaaguccaccaaacugauaccucgaaggggacaggcuuagcuguguuagccuggcucccuucauagggcucuguucaguccagugccauaaugcccaggcaaguuuccacucuuauuuuauuuuauuauuuucuuucuuucuuuuuuuggaaaugucucacuguguauccuuagauggucuaaauucauuauguagaccaggcuagccugccuuccaagugcugagauuaaaggucugugcuucuaggcccccuuuuagccuguuuggacaaucuuaggcuucuugggcauuggaauuuggcucuuuccuacucgagcgcuggauguuuguaaaaguguucccacaggcacgggagcuggggaagaacaagguaugcuuccacuaacagcaaggacucaggagcaggaaugagcuaauaaccgcuacaacugccucaaauccugucaaaguagguuguucaucuucucaggagcagagugaggaacagccaaaaaggacuugggguggagccucuguguucuaccagcaccagcgcaaacauuuuuuaaaaagaaaaagaaaaacaacaacaacaaaacacacuauggccgaagucacugaagauaggcugcacccaccuacuauugcacagguggccuuuugucuggugcagguggggggaggguaagaaguuagauuuauguucucaagugcucuaugaacacacuuuaggaaacucacuuacuuugaucuccuuucuggcugcagugcugggaugaacccagggcccugaucaugcucugcaggcucaugcugcugacugaaccugcugcuggaaccugcugcugggaaacucauuuuuaaagcaaacaaaugucacugaugcucagcaagugccaagaauauucagcugggaaccugugcuggcuaacuuuaugucaagaugacacaaguucaagucaucaucagcgcggaggaagccucagcugaugaguccaugaaggaauuuucucaauuagugaaugauggggaaaagcccaguccauuguggguggugccaucccugagcuggugagcaagcaagccguugggaacaaggcaguaggcagcaucuuccauggcaucugcaucagguuccugccuugacuuuccucagugaugaaagugauguggaaguguaagccagauagacccuuuccucuccggguugcuuugcucauagaguuucaucgaagcaaugguuacccuaagacagacucuaccgcugguaagaugccuguugucaccuuccucagcacagauguacagagcuaggacacucuaauucgaggacugaggaacagcacauaugcugccccacccugcucaggugcggaagggcugguggugaugguuaaaaaaagaaaaaaaagaaagcuaagaggaaaaaaaaagcccuugcacucuacuuucauuucccuucaaauuuauuuauaccagguguuguucuugaaaacuagcaagguaaccagagaggaaaaucaguaguggguggggcagggcaggcacaauccuuacaagugucaugaagucaagaagccccaggauggugcauauauuguaugggacaaguucuuccacagcccuacccacuuuguccuggccuagagccaagaacagaaagugggccugguuuuccuauccuugccagggggcugagagugagagggcacauaguagcacaggcuugcauuccuuuggagaagggggccuaugcaacuggagcagagauccauggaaggauuaaguagggguuggcaacuaguacauucuccagucucgacucucagcacaucagguguagaacagcccaggccccggcccacagcaaugugcauggccacucacggaacacuuggagcuuacuaacacuuuuacauaugugugaugcauucccaaagcugacauucccuccaacucccaaggaacccuuucuuccuaaguaguuccccuccuaugucuuugguauucugguucuuuuucugacucuuaggccuaaguagggcagcuugcaugcauauaaccaaccagccaguggccacaguacaauggagaaaacuccuuuuccaucagaacccauaacuucagacaccuuguacacuuggugaggccuuugcuggggcugacaaugagcagagacggguucuaagcuuagagagcagaaaggagcccacugaagacagcuugagacaaucuuggucaccagcccuuguaggcugcugcccccauguggccgacagguccuguggccaccggcugccucugccucuccaaugccaggugcugcuuaggguacagcaauggcuguuccuggaucugcaugcacagggcuccuaagugugucaaaugcaggucucuugcuagaagccaugccuccccaugccucuguauauguuugucacuguguagguuuucacugcagcacaaguguugcuccuguugccagccuuuggcaccugagaauuacugagcaacugagacaccaguaaagagggcaugcuuggugagggcagggaccccaggauugggugcuggcugccacuugugcuuugucuccaucucuugggguuccacaccugaauuccuucaagcaaccucacacugaggagagaaaaacacugcaucuguacugagugcacgcaggcaguuucuuucagucugacuacaauggagacaaugcaugcagcacucacauccugcaagacaacugaagccacccagagguacagucugucauauucacaaugaacugagucaugucacaggagggaugccagugaggauuuugauauccccugggacaucacgcaaccuaucuuuauggauaccaagggaugucugcacccucagaauucccucccacugccuccuucagguggacagaacuaaugggacaggauugcugcccuaugacucccgcaccaccaaccacaugaccccaggaguagaaggauggacucugcuggggaaaccaugcccaugaggagcauuugcaaggcacagaacacugcucuaaggacagauccuugccaggaggggagcagaguagacaaggugcugagucaggcaagugcaggggcugagacagcacaccugugacacuacuguccuuaaauacuuugcugucacaggcuggcuugaccuuuuuauucauugccaaagaugacaccaacauauaucaaaccaacugaaacaaugcaccuggugugcugggccaggaucugugacuuaaucccucucaccaagcaaggccaggucagcaagguccugauaaggaugaaccuuacugcuuucuucucugccaugucugucucccuguggagcccagguuggccuccaagucacaguaguccucccaccaccugagccucucuaguacuagaggaagaccugcaccccaucaguucaucuggggugcuaccugcgguguggcucucuaaccaugucccuuuuaaugagugaagccagccauaguguauuccagagccagagcagacaaggaagccuuucagacacuccagcucaagacagggcuacggcuuuuguccuugagcaaugcaggcugucuucauguacauauuuauucacacucguuuugagcucaccauucaauaacgucaagaauuuaguucauggaggcuucaggcauuuguguagucaacuuuauucagauaccucaagccugaggccuguuauucuggccuccugggaccaacaugucuaucucuuccuuuccuagggccuuggcagacagaaaaguaugcuuggacacagaggugccaacuucaugcccucaaagcugauccuucugugaugcuaaugagagcgagaugggcaauggcugauggcacccgggagacauggauacagcagcuuugaggggaccuguccucucacugcuguguacaguugugcucaagaguaugacaaaugcaggugcacgugugagcgcgcaugugcacgcacacacacacacacacacacacacacacacacacacacacacacacacacacacacacacacacacacacacacacacagaggacagcacucaugucugcuugcccacacaagcagcauguggaacucaggccauggcuaggccuucguaagaggccuuaccuuggacaucugacugaagucagcgaagcccucggcacugcugaaggagcugcuuccaaaggggucuaggguuccaaagggaucugugaguggcaccaacacaguugggguuauggucugagcagaugugcccaaaagucuagggcaauccuaggaagcaagagacucagggcugugaauguuucugggaagauggcuccuaugaggucaguggaucacaguggguaaaggauggaucaguuucugccugaagcuggcauccuaccaguauaggagaagcagggaagauggagagaaugagacacugaggauggccacuugugugugugugugguucaucagccggcaaagauucccccacuuccccuuuucaaauaaggccgcacucuguaguccaggcuugucugggacucagagaugccccugccucugacucccgaguaguaggauuauuaaagguguguacuaccaugccugggucuuuuuugaaacuaaugauccuuaguuucucagugcugggaagauguagguaccaccaugcuuggaaaacuguggacuguccccauuaagaacgagucccccacagcacugguguuaacagagcaauuccuacaaucuggaagaaagccagcucaugaugagaaagacagcccugugaaggaugagaugggggaagaggcauucacuuuggccugagagccucaggcaaggaccuaaaaguuccacccaagagcacacuuaucugggaacugaugguauuacugaggugugguguguggucaggacaggaguuucaagucucucucaccugaaccuuucgaggagaugcuggaggaugaaaaaggaucacuggacucaaaugggucgagcugagggaggaaagagaaaaguuuauucugccauuuagccucucaaccauacuuucccuaacaguuuuaaaugacaaacaauacugcaccucagggaggguggggugacuagacaaaccugggcaguggagcauaaugcucaacagauggccugcugcagguaacacugaugaauucuauaguccccacaaaugaccagugaacgaaaggccugagaagcgaaccacagccagacauagacagcacugagauuuggcagacgagauaaggguggagccccugccuaggauucccaggugaggguuugggagcaugguucaauaaaauaaggaacgucugucuuccaaaagaaucagaacugauacaugccuggccaauucuaagagcacuuaauuuaccaggcuuagagguacaacccuuuaaucauuagcacuagggaagcagagaggcaggcagaugucugaguucgaguccagucugguuuacagaggaaguuucaggacagccaggcuccaaggaaaacccuuccccaaaaaagccaaaagaaaacaaacaaacaaauaaauaaauaauaaaaauuauaagaggaacuuaacucuuuuaaacucacaccugucaucccagcauguggcaagacaggaggaugcuugcaacuuugagcccaguugggacuuaccagagagacuaugccucaaaaggaauagagagaaauggagagagauauccagaaaaaaaggaucaaaagaaaagugccaaggcaggcaggcugggacacacagauucuccgagucccacaccaaccagggcuacacagaguaccuggcuuaaaaaauaaaguccugagcuggagcucaguaguuacaagcacuggcuggucuuccugcaggcucacaacuauguauaacuggagggucagggaucugaugcccucuucuggccuccauaggcaccaggcacucacaugguacacagacagacauacaggcaaacauuuauacaaauaaaauaaaaaauuuuaaaaaucuuuuaaaaaucccaacagaaaugcaguuguuugugcuucaugccccaguauguugggcaaagggacagcacucuaggacugugcacacauggugaacuaacuggggauggggccccagucuuaccaugaaaauuguuuguuucucuugugugcggugauugugcaugcaaaggccagagguaccugguguccuaguccaucucucucugccuuacuccgcugggcuaacaaccagaaagcuccaguguccuucugucucucuccagcucagugacaggguuacagcugugcauguccaagagcacaggcaguuugccucacaggugcuaaggucugaaggcagcucaugcuuccacagggugugcuuaucugcucaucacuccaggaucacucccuacucugugcuuuuuuuuuuugagacagcaucucucuauauaacucaacuacuugcuaugaagaccagguuagccucaaacuguuucuuacauucaguacacauccuaaagaaaaauucacacaacauucugagugcaaccgcacccuggcgugucugaccacaagaggucagguguggaacucugcauuuguaucaugaugucaggucuggcaggggcagacuagguucucugaaaguuacacggaggggaaaaggcaagcaugcuuggucccuccuagccuucggguuccuguuuuucuucucuggcuucugcaauuuuauauucacaccaaaaccaguagccacacuagccuccacucugaaccaaaauaaaauaaauaaauaaaauaaaagcacucugugcuuuauuaaguguccagccucagguauuguguuagaguaacagaaaccaggucaucaaccucuaaguuaucuaacucaaaucuaacacagagacacguacacucaugcauguaugcacacaugugcacacacauccacacccacauggacacauuuacuuacacacaaaauaucagggauuuaaagaucccagagcauagcuaaugagaugguucauuaaguaaacaugcuugcuaccaagccugacaaucuaaguuugauucccaagaaccuacuugguagaaggaaacaucaauguauguuguccucugacauuaacuuguucucuggcaugcgugcacccacgcaugcacucaugggcuguagacacuucagugguuaaaaauacuugaugcucuugcagagucugguucccaacaucugugucaggcaauucacaacaaacugaacuucuguguuagagggucugaugucuucuagccucccagagcaccuacacauguggugcauaugaauucauguaggcacacacaauaaagcauauauauauauauguauguauguguguauauauauaugugugcguguguauguauguguauauauauauauauguauauauauauacacacacauaugcauacacacacauauauaaauauauauaaacaaugaaguaucucucauacacacacacacacacacacacacacacacacauaugcuuuaaacuauaaaacaaaauaauacagucugugugacacagagccuuacugugcugcccaggacaauagguguggcuaccaugcccagcuacaugugguauucugcuauagcuguaggagauggaguaguggugggagcagagaaccauagcacgaagagagacuggaagggacaagggcugugagaagaugcccuggucugacuuggcacuauguacacuggcucagugacagugcugggugccaccuuaccagccaggaaugagaccaggcuuguuaugacagcuccuggccaagccagccagccuccccgacaccaugaaccgaucccaacacacugcagaggcccugcagaaaccacucaccuuugaagguaaggaaggguucuuugugaaggggucugagguaaaugggucauucuuugucuguuucuugaagaagucaucacugcuugagcuguggaaugggucacuuucuuugaaaggauccccuccaaaugggucuggaaaaagagggcacaacuggugaccaauggcaccagggagacgugaggagauagcaacaggagagagggcucaggaugaggcagaaauuguggugacuguguggucaguuguccaggagucagaauggggacaauggccacagguuaggagacccuuucagggcgauggauugcacuccaaccuuccacaauucuauacaucugucaaaagcuuuacuagggcaagagggauggcaaagcggauauaagcauuugcuguaaacccugauagucugauccauauggugaaagauaacugacuccuguaaguuguuccuaacuuccauacacggacacacacacacacacacacacacacacacacacacacacacacacacaacacacacacacauauuuacacacacacauauacacaugcacacacaugcuaauaauuaggguuucuucagauacgacucugucuacugaguuacugagugcugggauugaaggugucugacaccaugcucaggguacaaacuuuuuuuaaagaagaauuuugugguauauacauuaugcucugaaauaaagcugcauguaaaaauaauaaccacugugggugaugccagggcaggaaacacugcugucaucaggcaaugaguaggguagaagcuacugugacagguggggaucucuguggggaggcaaauauuccaaauccuuuguuucugugguacuggggaacccaggucuuuggacauacuaggcaaucuaaaacggaagaauaaaggucacaaaaagggcuggugagauggcucaguggguaagagcacccgacugcucuuccgaaggcccggaguucaaaucccagcaaccacaugguggcucacaaccaucuguaacaagaucugacucccucuucuggagugucugaagacagcuacaguguacuuacauauaauaaauaaauaaaucuuuaaaaaaaaaaaaaaaggucacaaauaaaggccuuuaucauggcugucuauugcuaugacaucacugucccgggcaugggugguggggagucccaccaugugugacagucacaccacauacucaauauagacagcuagggcacaagugauccuguccccaaauaaacugagcauggagagacucuggacauugucaggaacucaaggaagccagccuuuaccuguggaagccagccuuuaccuguagcugcugucugcugcucugagaagggaucacuuuggaaaggaucaccuggagcaaagagagaagcagucaggugaggggagggaggaaagcagaggcaggccuuuugucuggcucaggggaaacaacuagucugucuucuugcacuugaugcugcuauagcauggucauggugaaaagcagcagcccaggcaggcagucaaggugagcugggaugcuuggcuggcagcagauagaacuagccuuagagaacucacuuuucuuuccccacucuggauccccuuaccuccuccuaccuuacucagaagaggacagacacaguagcucuccuggucaugucaugaugaccuacaaugaugccaaagugcuggaucugucccuuacaccuaagaugcuacuaucaacaucuaaaagcuucccaggcauguacucaggaggcagaagcaggagaaucucugaguucaagaccagagugaucuacagaguaaguucuaggacaggcagggcuacucugucucaaaacaaaacaaccucugaaaguuaaggggauggagagguggcucagcaguuaagugcauucugcuuaggacuuagguucaauucccagcagccacaugguaguuaacaaauuguccacauuaacuccaguucuggaggaucugacacccucuuuuguccucugggggaacuguacacagaugaugaauaugcaugcagacaaaacacucauaugcauaaaaaaaucuuaaaaagaaacaacagucuuuuuuauggggacauuggcugggguguaccuuugaaggggucagcuccuuuaaaugggucggacuugaagggguccucagccuggaaggggucuggaugaaguuccugggaguuguugcuaaacaauaaggcuuuguuuuugaaaggaucauccuaggauggugaggaaaggacaggugcugaguuauuucugauuuaagcaaagugcaggauuucacaccuaacucagaucugcacuguuugcaaugugacccagaacaguaucugaaggggagucacccagguggagauuuuggcuacaaacaagccuggacauuggucuauuugcuaagguaaaaguggagaccaggcauggcacauggagacaagcaucacagcuuugcaauuuuucaggaaaucuaaagugacucuaaucaagucucugagcggaaugaauaaguagauagauggaaccuacccacccgugaagugaaauaauacucagcccugaaaaggaaggacacucuacuguaaauggagaagcuuuaaggauuugcagcuaagugaaauaagaggucagugacagcgauagacgugguguggucccgcgcacacccuuaggucgccacguucacagaggcagaaugauggggccagagccuagccaagggcugggagcaacccccaccccacgguucuauguaaaaaaccaagugggccguuucugcccaaguaggaaguggggcuuaaggugacacugguguagugggagcugcuaaagcaugcaagacacucugcauguuugcauaaagguacucaguucuagaagcuggcaaguguacucaaagcaguaggaaaaaaaaauccacaacauuuuugaagagugcuuuuccauagugggaaugaccugaggggugggugaacccugcaaacagaaugaugggcugagaaaucagggaucuguucugcuuaagagacacaauccuccacaaaacugggcuauuuaacuguguguguguuuguuuuuaaaggcaggagcucaaugaucaagucaugucaaagcuggggcaucugugaaaguagacaaagguucagaaaaaugacaugaauacucuaaaaggcuauuaaacccaaaaauaaguccaaaauucuaugaaaccugggggcaggggaagaaguguuaagaggaagccaccagaugggaacaggaagcacacuugcuacucugguucugggaagcccaaggcaggaggaucaauagguccuggccagcauagccacacagcaagagucauucucaggaaaugaaaaaaauaaagauuaaaaaaauaauaauaagcaguagucacugacuugggcugugaguaaaugaagaagugggugggccaucuucuuaccuggaaccaauucuucagagcuucugggcacaggccuuccuagggaagccaggccuggugcucagggagguuaaacacagaugcagcuagcacagcagcugcugacgacgcuuggguacggccaggcccgagauggacacacccuagugcagcugcuggaguucaaggacagggagaaccucaaugggagaaucugaccaaaggaagcccaugcacuggggcaggaaauaaccccuucugccauacuguggacaaaggaagcacacacagcugucgggguucaagaacagagagacacuggaagaagguuaugaccuaaggaaacccugggccaggcaaaagacaaccuucuuguacuagcccugggcaaggaauggacuguguucuaaagauagcgggaagaaggauggaguuagccacaacagcucagucuuagaaaggaagcucacagugagcacuaaagggcuguugauggacagggccaguuuacugacaaucugguguuucuaucacugaggggaagacagugaguaaauagauuucaauagcacaaaugugucugggaacuauacuaccaguccaguacguggaauguuagggccuacaccauaacgucaggagaaaucuacauuucaugcagcuguggcuccuuccccuaaggggccauaaaauagcuggguguagcugaguggcaaagacugacuaagcaugcacgcagcucagcacugcagccaaggcccuggcaggacucacauuagaaguaaggaaaaaaggggacagccugugccagacuugaagcugaaaagagcccccugcccuccaaacaugaauacagucagccaccagccaggaaaaugaagaacauaucacccuaggggacagaaauauaaggguuaaguauaggccuaugguucuucagcacagaagacccauucugucaccaugcagacaaguugaugaacuuauaaccuacaauguuacuaguagauggcaucuuuuuagugcacugaaucacgugguugcucggugacugagcaugguauaaggggagauauuacacuagggcgagcaaugaguaccaucauagagguagaacauguuaacuacuuuuuuucccccccagacaguguuucucuguguagcccuggcuguccuggaacucacuuuguagaccaggcuggccucgaacuuagaaauccacccgccucugccucccaagugcugggauuaaaggcacgcgccaccaccgcccagcaacuacuuuuauuuaauuauuaacuuguauugcaugaaggacaggacccagggccucccacugcugugccacacccagcuacagaaaacauuuucaaaggcaaaacagcuaguccuaagcucugccuguuuucagaauauagacauggccacaaaggauacucaagaaguuucugugacauuccuggcuuuuacagagugcugggaguuggucaugggaugcaugccuuuucaucucugcacuuggagacagagccagauagaucucuguaagcccaagggcagucuagucuucauuuacgaguuccaggacagcuauggcuacaccaugagaccuugucucaaaaacauaaucaaaaugaacuguguuguguagaggcccaaugcuggugcucccaccaauuguccugaaguaaauuuuuguccuagcucaagcugccagcuaagaggcucucauuuacaaaugcuugcugggagcccauaaccuuggcucuuccaugcuacuggaacuagaaguggucaaguaucuaaucuguccugguaagucagagugauaagcugggauggugcacggcuuucucucugcuguguaggcuuccuggguaggaagaggcuucuaucagucacaagaaauaaacaugauuuugggcugggagcaaaggucaguggugaguccuagcuaacaugugugaggccucagguucccccuacagcacuguaaaagaaaaaaguaauuaaggauauacacggaagugaacauggccuauaagaauccuauugccucuugggcaguuguaccuugggaacuugggcaguuguaccuugggaacuuaacauuuagcucaguggcucaagagucaccuguaguaaguuccagaggugccacuuuggcugcacaauucugguaagcacaguuccuagcugcacaccaugaagagaacggacggagcauucuuugcuccacagccccagauggaacacugaacaaagaccucgcuucaaacuguuuauuaagaaauggaaacaacugcccccccccauuuuuuuaaaaauacaagauguggguuccuuuggacacaagucuuaaguuucuagguaauauaucuuaugguuacacuguacaaaugacaguuuaccacucaaacuccaacugguuaaacgauggacaaaaauaaccauguacaaaauguucugguagugacagaaaugaccaccaccuguaaacugucaccaacugcuaagaugcagcccaggaugugauaaaagcuacaggggaaccugauagacaccuuuaaucccugcaacagggaucucuggaguuccaucacagccuggguugcacagugacacuguugcagaaagaaaaagaggagaagcaaagaaagaauacagacagacagacagacagacauauauauauauauauauagagagagagagagagagaaagagagaaagagagagaaagaaagaaaacaccaaacaauccacaaggggagacuuagagggagcauuucccuggcccaggacauaggacaagccagcugcacaggggacaauggugagauggagccaaagcaaagacuacaguaagaagacagaaacacacacuggcuacaggccaaaaagcaaggaauuccaugggaauuccauggaacagaugcccacugugggcaggaagccaccuacuuauaagucuaagagugaaggggaacuccaggugggcagacaugagggacaggcagaaauauaaacagcaccuucuaagugguccaaggaaagaacaggcuucucugugaguucuuggaugagaaagagaagagaagagagagggaagguagcuguguuuagagugcaaggcgaguggcgaccacaagagggaagguacaaagaggaaaagcagcagggcuggagcaacgagagcccuggaagaugaggcggccgagagguuaaaguagcauacauaauaccccggauuauggccacagagacaucccucccugaguuggggcugaugacuccaacaagggcacugacaaccuuagagaagggucgcauggagcaucaauggcucacgagcaguguggccacacagugcugagguucuuccucccagaggccagccaacagcuggcugcacagaaccuggagagcagaugugcuguggugcuuagugauggaacugggagccugcagugcuuacuaccaagcugcagcuggagccuguuucuccaucuuucagaaucacuugacuugaacgacacauacuugcacccaaggcuguaucaguagagcaccgagcucccacagcaugggaccaaacuggcuuugguuagguuugcccuccacauuugggugacuggcccaaaagaaacacuucugaggagaugaaacaccugggccucacagcuucuagaugacagaggaacucggccaccagcccugggaccugggcaggcagacaacuagcaaaaacaaagggacacauugagggagccaguguugugagcagaucuacaguugcagcagagcccucguggacccggagacucuuacucgaccuuuaccauagcuccaaagccgccccucucugccagcaagaugccuucguucaagguggccaggucaggcaggcugguaccagagaccccaucaggcaccuggucauacuguuccaggcuccggugagcuucuagguggcucuccuguagcugggacagcuugcuucuugccugcaagacaaacaccaugaacaucaaaggagcuccaggugcagccagcaagaugccuucccugagggaucauacacauagggaaggacugcccugcccaagcuguaucacuagacaagaggcacugguccugugaaaggaucucaugucauaaagaaauucuguauauacaguaccugcaggacugacaaaagauaggaaggaagaaggcggccuaggaaggcugaggcaggaagacugaucacaaguucaaggcugaugugagcuaucucaagcacaguucaaaacaaaacaacaacaaaaaaaaacaaaaacccaaaauccaaaaaaccugaaaccgaaccaaaccaacaacaaaaauaaugugcuggucauggucauaugugccuuuaaucccagcacucaggaggcagaggcagguggaucucugugaguucaaggacagccuggucuacagugaguuccagaccuguagaggccacccaguugagauccucuguuaaccaccaccaaccauuccuucuauuagcaauguauguuaggccaucuccaagaacagucucugaaggcugggaggaagaacccugaaaauaaccccuuggaaauaacguuuauaaaacacaauguaagacaugaccacugagaucaaagaggcauccacauugcccugucagccuguagccugaagacaagcagauaguuucagucuauaggacacagguuucuuugcuguaugcuaagggcaucacacugucuguagccuacaucccagagaccacacaaaaaccagugaccaacauaugcacaaggacagggcaggcucagagcuuccuccuggcuuucuggaaagggccagcgcucaugggacagggaggcaggcacuucgagucacacccuacaaaguccucagcagcuaaccucacaguaccacugacccaucccuguaaaaguaccugguugaugucauccugugugcacuucagggaccugaggauggucuccagcugugcacguccagccuggaugcucugcuccagcugugucuccucuugcugcagccgauucagcucugacuuggcccuguucaggucauccuccugggacuucaagucugacuccugagacugaaucuggguuuucaaugaugagaucugaagugagagccaaaaggacuuacaagucaggacacagaaagacagaaagacaccaagcuuucuuucucacuguguguggagcuagagauauagcugguggauaaugugccagaccaaaaucucccugcuguccucugaucacacacaaauauauccacaaauucucucucucucucucucucucucucucucucucucucucucucucucucucucucucucucucacacacacacacacacacacacacacacacacacacacacgaaugaauaaguauaaagcauaaggagucugcauagccagagaucaguguacaggaccugcaguuagagaaagcagauaauaugugauaaaaggggucacagcaggaggcagaggcaucugcagcccuguucccuguuguaggacauccacggcauaguuacugaagccaugcaguuuugcaaccugaucccuaggaacagaaggauuguucacagaucaggccucaggugccuagauauuucucagcuggcauucugucaucugcuggcaagagcugucagggaagcucggggacacuggccacaccgugaacucacugucugggucucauccuggcauuucugccgcacgucacucagcaugucccgcagcuuagccuucugcugguccaucucauccaggcgguccugggcauccuguuucugagccucaagcuccugcagacuacuaguuucccggucuaggucauuuuguaauuccuauggaaaugggugguauugacuggcacugguaacaacaguucccagauaagagguuaaagcagacccugggcuggacugugguucagccuuagacacuauguggggagggccuccgucccugugccugucaaggaugaguauaaggcccuagggucuacuucuggcaccugggcacagacuaggcuuggaguuuuauacucgcugccuaccagcuaugagugaaaucccagguuccauccccaaugucaccaaggaaacaaaaacacaucgaaaucccaaagcauugucauauauucagcacacaauucugacuuuuuccuacauucagcaggccugagcugaggcacagcauccacaccuguacuucgcugguuuucugucugauugccucuuccuuuucucugaugucuuguuccaaugaguauuucucucugcagguuuaaaaacaauggaugaaaaacucuggaaguucaggaggcagacaggguggaguaggagugguccccagcauuagcaaggggcucccagcugacaagucagcaaggaaauggagagcuugaauccagagcagcaaggaccuagcgagaaguccaggcauauaccuucuccuugggcuccaacaccagcggacagcuggcacaggcaccugcacacccucccuaugagcuacuauacucaugucaccaaacuacuuaguucugugacugucacacuaagagaaaccacuuccuauaucccacauccaaucaaaggcacucaguagucugacacugaugggccacucaacaaagaggggcacaggggacaaagaauugcagaugaacaccauccaguacugcagggacagugggcuaugaggagguacugugggaaucaaagauauguugugaagaauuuccugaaggacaagaauagaaagcaaagcugggcuaggggagccagggggagugcauggagugauaugacagucgcuggcuucugguaaaagggcaaugaggaacugcuccacuguguacagcaggugugccagacuuaagucugucaccuaagcugugugcuagacucucaucucggcuguuuguaucccuaggcaacuauguagccacagccugacugaggcuaccugaauaauauagacucagagcaucaaugauucaagcagaaauagaucugagaagacuuguguccuccccuccuucaaaggcuuauggguaaacggacauaagacugcugcaucgggacucaccaaaaaguaggcagccacauaccucugcaacugugcgaucuccuggcuaaugucauccagcucuuuaacaccagugaacucuccugaugccagaguacuugaacuguccuagaauuaaaacuugaaaugucacagggagccaaguagcuuacaugucagugggaccaaagcacuggccacugacuugagaacacuccagguggcccaaucaaaggauccccauccccuuagucccacccccaaacguggccuggagacugaggacuggggggaagggagggcgguggggugggggugggggggugucuuggggcaugagcaccaccuucugguggguggugggaagaacagaaacaaggaugccuggcuacucacuggaaugggagugccucucucagaggguggcaccaugucaggcgagaggacuugaggagggucgaugccuuuacugaccuucugcugaaugaaauacauagcuagugcgaacugcucuuugcuuaacuugcccguuugucuuguaucagccagggcccugggagagaugugggaugcaauuacacaucacaguugcacuugccaccuauucugagcccuccccgauuaucaagcccaccaggaccacagcaagccccgggcacugccuccauguucccaucaaugcugaugagcacuuccuuaaggauggucacgagugcaugggagcaaugcucuggccuacagaaccugcuuucaggaagaacaccuccccacaacacacaccccuuuaguugacugugagggucaaggcuuucuugguucauuuuguucaagguacuccagagaugcaaguggccagcacagaccaugaguccuugggcagauggggcagggcuacauucucauuccuguugaggcugugcauggucuccagugagagcugcacucuggaggucucaagacacccucccugaccacagagucuucgacagcaggagcuugccuugggccugugucuuguguggaaccagggagaacagaaguauccuagaugagauggcacugcauggccuggugagggcaagcacuuuugacugcugguuaaaaguacagucacuugccagaggugggcacaaggccuucaugggcccacucuacagcagcuaccugcagagcauaaacgcaaagcaggcuuaggcugcugaggcuucuccacuugagugcaacaguaagcucuaaagaagcaggcaggcuggcuaaagaggcaacugaguguccccugacccuuggugcuggcucuccucccuaccuggcuaggguuacucaagaugguucuuucaggugaccaacucaguucccugauccagucagaaagcagccaggaagcuacucaaggcucugguuuggaacaagcuaacuuacuggaccacaccaguuacguucagaagaauccucgcucugagaugucagcucuguccagcacuuaacagggguaggaugaaggcagaucccucauccagcaccaaguguuuguuauucaguggccaccaucuacacuagaacagcuguaacaacuugcaagagaaccccgaaaaucaaccuaauagcugaugacugucccugugcuagcuggcuuuguaaacuuuauacaaccuagagauaucuaggaagagggacucuugagacaaugccuucaucagauugacuuguaggcagcucugugggggcauuuuccucauuaaugauuggugggguuggaaauuucauuguggguggugccaacccuggguaggugguccugaguuguauaaggagacuaagcaaaccauggggaacaagccaguaagcagcacuccuccaugaccucugcuucugcucuugccuccagguuccugccugacacugugaucuggaaauguaaacagaaacaagccguuuccacauuguuuugggucaugguguucuaucacagaaauagaaagccuaacuaaaacuauccuccauaggagaguaggaguuggacccucaccuacaccucccaaccccuuuaugucauucugauuuaaucucauguggccuugggucucaagagguaccaggguccacagaauguggaagaggaccagcuguggggucaccagcacaucuggcugacauuuacuggcaaugcaguugccccccacaaaaucacacucuggugacccacucgacuucagugcaauguacuuggaaugcccauguccaagugggaccucacuggaacugucaagguccuuguugagguuacucaaguggcaggcagaguaaccguuacagguggcugugacaagguaaggcuuguggagaagacuauuuucaacacagcucuccaguaucagauaagggcugacccuaccucccuguauacugucaccuggaaaacgggagcccuccccacccucuuucccagccucucagagcaccuccaccaauguuuccaucauuaccagaugugugccagaagguucugagugaggccugagugcaugaagaucuccuuaacuuccuggccacucacauagccaucaagguccaggucugucuucaaaaagaucucaucaaagcgcaucuuaucugccacaggcacaacccaggccacugguggcugaaacagguuacaacagagugacuuauuugugagcccugucccagucucagcucugcuuauacuucucacugacagugucaggaccauacagcccaguccaggacccuggcuaggagcagagagaauaaaaaaaggucagauaaacauacacacauacagugaaguucgggucagugggggaucucugcugcuaccauuucugcuuccuguaaacccagaacaauagcauauggagauagucucaggauagaaacauccaggaagaaacugcagcugcugaccaguuuccauuuuuuguuguuuauuuucacuauaugauuaucccucagcucuggugagucugagacaggaauauuaggaguucaugaccagccuggaacuauaacaagacccagucuuuuugguguuuucgagacaaagaguuuuucuguguaguccuggcuguccuggaacuccagacuggccuugaacucagaaaucugccugccucugccucccaagugcugggauuaaaggcgugcgccaccaguagcaaguagcuagcaagacccagucuuaaugagcaugggauacauuuaucugcuacugacuucucuaugcugcacagccauucccuaugcagucucuuugggcucaagaggcaugucaguacaugcuagcuacugagccuucauggacaccaaagcucucagcacuuucuuacguguacacagacccugagcauauccucccaagcacuuuccccaucuuaacaugacuaagaaugcccgacucaauguuacagcucugugcaguacauuauuucuuugucacaaaugcucaugggacagggaaauaauguccucugccaggacagccuuuccagcguccaaauguucuucauagaaaguccuagguacuguaccaacaaaauaagcucuugucccagugccggagccaggcacacugaugugugaugagugagagggcaggccugugguuagaaggugcuguacugaacucaggccacacauaacugcuguggcauguacccacccaugugugcucaagcagucaauguaaacaaagcaaaacagcaggcaaugcaacaccuuacaguagaaaaaccucauccuuucauucagucuuagggcacugaaagcaguuagaaaacaggggcuagggcugggagcuucuucaguguuuaagacugcuugaugcauaaacaugaggacaggagugcugauucuagaaccacguaacaaacaagcaggacauccugcaagugccuacaacuccuguaccaagagacagagucagggagaccacucagguaugcaggcuaccagcccagcuaggaaagaaagaagagccccagagaucaagagaccuugccucaaaggaauggagagacagugauggaggaggacaucugauauccucaguggacuccaaauaaagaugugugcacauacuuacacaaaugcaugcauauaaacagauaaacagaugaaagagucuguugucaguaaggugaguccacaagcaagcacagguucugugaagacacuggaucacuucaaugaggacuugagcacuagagagcacuguccaggcccacguacaccagggaacaauuccacuuaccugaaagcaagcucauucugaaccauacucauuuuuuaagguucuuucuuguuuguuuauuuauuuaaugcguauugguguuuugccugcauucaucuaugcaccacaugcucaaguacagacugcugcgagcugccaugugagugcugggaauugaaccugguccucuggaagagcauucaguacucuuuaaucacuaagccaucucuccagccccacaccucuaguaagguuuuaaaaaaauuugaucaaagcuuucucuuuauugcugaugagaaaugauauacaagaggccuugggcacugaccugcuugacgcugugcuucggggacaggcugccugugcuguugaggcugcuuacgcugccgugggaugguguggagcggaggcugucuuugggugggggacuagcaggcaggacaggcacagcuccugcaaacacagucuucuuccucuuagagggugggaugaggggcgggggcaggauggagggcacugguuccuucuccagggcgcgguacaccaagugcauagccuguggugucaaugagaagaaaaaggcacuggggggguuggcccagaacacaaagagcgccucaugcagucugggagccauggggauuccuagaggcucuaaggaagcugcucaucuuuucucucucaucagccuccucugcaucuucaagacauguccaauuugggcagcugagugaacacagaagacagccauccagacacagcacacagccacugucuguuccauccuaagaucagaguuaccuguggucugcaaaaguuauguagaaaauuccggaaacaaaaauacacauuccuagcacuucuacuagagugcacugccaugacuagugugagacagguaucucaaguuucccaggauagccucacacucaccaaguagcugaagaugcccuuggacuccugaccuuccugcuguguccacaggauuuuggcaugcuuggcaagcacucuacucaguaaacagcccagucuuuguuuuaauuaccucacuacaaucauuacuacuuuauuaccaaucaaagcuguaacaacuaaagacacacagggaaaagugaagcucacauauguaacagauuugcuugagucucuaggcaccuauaccuccccucagcaggcagguugaccaccagccucaaagcuuaugauuuccaaaguucugaagucuggaggugcacugacaccaagaggagacacaguaugccccuagaggggacagugugagacagcagggagcuacugcacugcaagaggagagagauggucuaagucaugucuauguauuuauuuauucugaggcaaagucaugguauaaaguugaggcuggaccugaaucccaauccuccugccuuagccuucugaguccugggaugauaggcacacuggcaaaaaucacagcuuuugaaggguaauuuucauaucuaugaguauuuugccuaucugugucuggacauuuuauguguacaguguccaugaaggccaaaagagugcaucaaauccccuggagcuggaguuacagaccacugugagccaccaagucacaaauggaagcugggaaucaacuuggguauucacacuguaguaagaugugucucuguauuuucaacuguugauuacugugagagcuaaaugcuggcaggauuuuggcauuaucauaaaaacuuggcccaucaucugcuucuaauuuguauguuagucccuucccaucugcccaaaacaugaaggucaggaaagcuccccauugccuaaaggcgacugaucuaagaaauuuggaaauguugucucauugcugauugguugcaauaaugagcugacagacaauagcuagggcaggaguuguagguggagagggagccgcaggauagauagcaggagagauacuggcggcggcagcaggaaaacugaaaaggacaggaagggaacagacauggacuggaguggggcagggagguaaaagaggugggucuacagggugggucucagcgauacaagguuagauuaaguggcuagagacugccccagcaaaaggcccaaagcuguaaaccacauaaacgucuccaugucuuauuuauaccucagcuggguuugcaagaggccugcaacaccaggucugcaguaccgaagacauuucuccagccccaaucucacagauuuuaaagucuauuuuaaaauguaacuggaaagucaggugcuguacacauuuacaaugcuagaacuugagagauagagaaaggagaaucaagaguccaagaccagcuucaaggaggcagugauggcuaaaggcuuuaauuguuuaaucccaggacucaagagacaggcagacagagcucugaguuugaggccagccuggucuccaaagagaaacccugucucaaaaaaaaaaaaaaaaaaaaaaaaaaaaaaaaaaaaaaaaaaaaaaaaaaaaaccaaaaaacagaauagaacaaacaaacaaaaauaucagcuucaauuaccugagacugucucaaaaaaacaaaaauaggcggggcagugguggcacaugccuuuaaucccagcacccaggaggcagaggcagguagaucucugaauucgaggccagccuggucuauagagcaagcuccaggcuagcccacaaagacagagagaaaggagggcgaaacaggcauuguaagguaaucacacuggauaaaagagucugaacucucgaguacuccugaaccuuuuuaaguacugggaagauguaaaaauaaacacuuuaacacaagacugcagcaccaaccaaugugggcacuuccuuaggucucagcaagguggggacaagacacagaggacuuaccacagcaaacucaucucgguccaaauguccauccuugucuaugucacugaggucccagaccuaaaggggacagacagauccaggagagugaugugagaaggaagagcuuuaaggcucacccagcacaagcaugagaccaaggcaaucacuggccauuagggagcucuauaccugucuucuaacauacccacacaagugaacauacacaaagcacacacacauacacacacaucacacacaaagaaaagggaagaaaagagaagaaaagagaagaaaagagaagaaaagagaagaaaagagaagaaaagaaaagaaaagaaaagaaaagaaaagagaagaaaagaagaagcauuuaaaaacuagucugugagguugaggcaagaggauuggaagcucaaggccagccugggcuacagagaguucuuggcugucuuggcuauauagcaagauccuaucuguggugggcugggugggaaugccguuaguauuugcaaacuuaggcuuugagguuucaaaagcucaugccaggucuuucccugccucucugccuauggaucaggauauaucucucagcuacugcuucagcacuuuaucugauugccugcugccaugcuuuccaccaugaugacaauggacuaaaccuccgaaacuguacacaagucuccaauuaaaugcuuuauuauaagagcugcuuuguucaugaagucucuucacagcaacagaacaguaacuaagacccuaccuaaaacuaucaaaacaagaaaccaaaacagcagccuaacccuacaucucucugaaaaccaugcucugauggagugcugaagaucaaggucgagaucugcacccuuccuacagcaugcucaauuccuaggcaacccuuucaacugaaauuugacucaaaccuggguccucugcaggucauaagcccuaagacccagccccaauaucacagacuuuaaagucuuuugaaauguaacugaacagguucugcccauaguucuagaacuuggaagacaaaggcacaucuagugggcauuaagagacagucucagagccacugaggaccaguguuuguugcuuuuaggcucuacuagaguuuaggagccucugaaagaccucagucccucuguagcaacgccccacagaugacaagcuugccugacccacauauaccauaaagcaaacugccaggaugaugccuugggugcagccaugacccucuagaagaacagagcccgcaguagggaccugaagccaaacacuucacauucauaagaacaaauuugaaguucauuuuugauaagggauucccaauacaggauccagccaaccaggcuggccucaaacucaugcuccuccugccucagccuuuugggauuauggugugcacugcacacccacuaaaacugaggcuuuaacauaaauaaagaaauguacuauggagguagaucaggaguuuaagguuacacccagccaauauggaaggcaagagaucccaucucaaaaugauaaaacccaaaaugaaauaucuaagacuauuucuaaaccugugaguugaaagugccuuaaccuccagacugacaggcaggaaaaagcauuuccuuaaaaagagaaagcaaggccaauggaauggcucagcagguaaagaugccugcugggaagccugaaaaggugaguuugauccccucauagagacaaccagaucaugcaagcuguccaaugaccuucauagauacacagugguguacacauacugugcacaucuacacacuaaguuuuuaaauguaggcagcaugguggcacacuccuuuaaucccaguacugaggaaguauaguuagcagauuuuuaugaauucaagaccaauacuaucuacacaaagaguuccaagccagccagggcuccauugugaaacugaagaaagaaaaaaagaaauuucaauguaauuauuuuuuaaagcuggaugugguggcaugcacuuguaaacccagugcugggaaggcagagacaggaucaugccuggauucucuggccagucagcccagcucagcaacuuaguuaauucuaggcccacugaaagacccaaucuacaaaaaaguagauagcaguuuaggaaugcuuccaagauuguccucugaaccucacauauauacacacuccugugaagacacuuuuuaaaaacaaacaaacaaacaaacaaacaaacaaacaaacaaguagaaagaaacaaauagacaaaagaaaagaaggauuccugcuaggcucagcgcaggcucucugguuacagguccauguaaccuucucccucugccuguaccucccauuauaaaauggaagggugccagcaucuucccggggcagaagagcagucuugacauacagggagcauccgguguacagugcaugauggugggagaauagugauuguuaacagucaagcauacugcagugcaggaugggaaaacacccagcccaguaccuuacccugcccagcacauccagagguaguuucgaguucaugaggaccggcuugaccuugucuccagagaguagcccauugacugguagaaggcuuucaaagaugccaucaaacuuugccuucuccuccaccuaccaggaaagaagccagacugaguaagagcaaguaguguggauccauagccaggucugccuacuuggugagagcaagaugucuggguuuccagggagaauuuaauuuauggcuugggaggaaaagcucccuggcacuuugagucugggggucauggggagcagaggccagcagggugauguuuccccucuggaaugaacaugaccaaagucagccucuaguggaaccaauggcacagccucucauuccagcaccaagacagaccuaggaagauagagggcuugaagccagccucuguuauauggggagauccugucucagauguaaaucucagugccaacauuuugcuuuucauuuugcaaacacaagcugugauggggcucaaugcaguaaagguuugagugccaaccucaccacccaaaaaaaaaaagguuuggaaaagagugcuagugcuguggcuugguggguggagugcucaugaagcaugcacaaaaagcccuggacuccauccgcagcacauauaauucaccugugauuccagcacucaauucaagguggaagcaggaggacuaggaauucaagaucauucuuggcugcacagcaaguuugaauacaugagacccuaacucagaaaaacaaacuaaugggcuaaggauguagcuugguggcaaagcccuugccuaagaagcucaaaggcgugguggcgcacaccuuuaaucccagcacucgggaggcagaggcaggcggauuucugaguucgaggccagcugaguuccaggacagccagggcuauacagagaaacucugucucgaaaaaaaaaaagaaagaaagaaaacaaagaagcucaaagcuguccaagaggugccuaacaggaucaagaaaaaagggagaacaugagccaugaggguggggcuacugccauucugaaagcauccacagcccacacuuguaguucaacucuggcucaggagucacagguuuuauagucauguaucucuaguuuuaacuuacuuauacacauuuaagugggagcacccacaccaugguacuuguguggcaaucagaggacagcucucuccuucguuaugugaauucaggaucaccacacuuggcagccagcccaucuuuuuuuguuuuugagacagguucuucccuacaugacccaugcuggccuugaauaugugaucuguccuccauccucaaguucccaaguguuguggagacaagcucgugccacugugauaaaacagcgacugagacagaaguugguaucaggaacugggauacugcugugaaguccucaccugcugcuuauugcugcacgugagcuuuggaacucuggauuaggaaaguaguagaaugacuuaagugggggauuaauggaucauccuaguaggagcauagaagacagugcugagggugaugugaacuguggaaaaagaguaauaacgugaccaaaaaaaaaaaaaaaaaaaaaaaaaaaguggcccuucucugaaaaauuugccugaagcuaaauuaaaaaguuugggauuaacaggguuggcagaggaaaugccagggcagccuaguauuauugacucuguccuggugguuuuuuuuguuuuuuguuuuuuuguuuuuaaacucuuauauauuacauguccaugcaguuuccccucccccuucucauucuaauccuucccccauccgcauccacuccuccuccauuucccuucagaaagggcaggccucccagagauaucaucuauuguaaaaaaagagcaagcugagcaaggaaaaauacaaaagguagagccugaggagagaaguugcaagaagugugauggagcggagucucgugccuaccaagaccuaaagggcaagaccucauccaguuaagcuucuaacuucugaaaagaaauuuuaaaaaaguuuagaguuaggcaugguagugcugcccauaaucccagcacucagaggcaggggcaggcacaucucugaguucaagaccagcccggacuacagagaaaaucccaggacaaccaagcuuaggcagugaaggaaaccaucaaaaacagaaagcugcuaaagauguaacugaaugaggaggccauguuccagcccagguuaagaagcagaacuuggcagcuuuggcuaugugguucuggcuuuagaggaaaagauacaagaaaaggguuauagaaucccccuccacgacuaaggaaagccacugaggcccggcagguaguaggggggucccuacaugaagcccacagaaaccacugugugaagcucugaaagugaaguuuggauugccuucgagaccucaaaauguugcagaugccagagacaugggauauaguuucaacagagaguagaaccagcucacgagaaagaaacuugcugcaggcaccaaagcaggacagauuagagcacugaaaagcacuuugcuaucagacauggaugcagaguuuggaguuugcccugaugguuuucagucuugcuucuguccaguauauccucacuauauuccuuuucuucccuuuuggaaagguaauguacaucccgugccauuguaugcugguaaaaugagaucuauguucucauuuugguuuuauagagcauuacaguuaaagagauugcaugacucucagaagagacuuuggacuuuuaaacagggcuugagacugugauagacaaugaaaacuuuugaaguuggacugcgugcauuuugcauuaugauauggcuauaagccuaggggccagagaauggaauauggugguuugaaugaaaacggcccucaaacguucauagguagugacuauuaggagauaaggccuguugggguagguggggccuuguuggaggaagugucauugugggugggcuauguaguuucaaaagcccaagccagguccaguggcuuucucuuuagcucuccagcaugucugcuugcacaccaucaugcuucccaccaugauaauaaugggcuaaaucucugaaaguauaagccagccccaauuaaaugcuuucauuuuuaagaauagcuaaggucagacuggagagauggcccagcaguuaagagcacugacugcucuuccagagguccugaguucaauucccagcaaccacaugguuucgcacaaccaucgauaauggguaucuaaugucaccuucugaagacaguaacaguauacccacauacaugaaauaaauaaaucuuaaaaaaaaaaaaaaagaaaagauuugcugaggucgccgugcuucuucagugacuaagacagccaccacguuuguuugcuaauuuuccuuccuuagaggcaagaccacaucacauuaugcauggaagagaacaccuuaggugcugaacaaggguuuuugcagaucaguggacaccucagagagggaagaguggcuggaagacugccugagcugggugucuccugucuacuuggaagaaccaauacaagcaacacagccucaaaugcuugcugagagcucagggauucaacugcaaccucaaacccuuagcuccuuguuccaagacucagcugcgagaugcaguaaagagacuggagaagcaauuuuccaagucaaguuuaggcauagcuauuuucucugugcuggagagguagaagcagagggucagcagucaagagcagcuucagcuauagucugaguuugacaucaguccgagugacaugagaccauuucucaguaagaaaauaaucaaaaauuaaagcgauggagagauggcucagagguuaagagcacccaagugcaguucccaacaaccagcugcagggaaucccaccacugcuggucuccaagagcacaaagacccaccauagguagacaaauaauuuaaauaaaauaaauucuuaaaaacuaauaaaaucagccgggcguggguuccaggacagagugagcuccaggacagccagggcuauacagagaaacccugucucgaaaaaccaaaaaccaaaccaaaccaaaccaaaaacuaauaaaaucuggguggguaggggagcggggagguauaggggacuuucgggauagcauuugaaauguaaaugaagaaaauaccuaauaaaaaaauuggaaaaagaaaaaaaacuaauaaaaucaaaacacagauaugauccuucaauacuguggagacauaaaaaggcuaaauaaaacauauuccagaacauucugaauaguaugaauggcuuguccccguucacuuacccgcacagcccagugggucucugcagaugacuguguggccaucagugggcugcugguaucaugcugaggaagaaaggcacaugugaucaaaaggaucuuaucccaaagugggaaggccaccaaauggggaugcccuaugaucccacagcuucccucccaggugugagccacagguaugcacacagauccaugaucguuuaguaaugcaaggcuccaaacagccaaagguggacacaugagcuguauccuuggucauggcaauaacaaaagccugauccaggcuaugauguggacaggcugagagaaaaugccacaugcaaggcgaucauauccuguaugacuccauuaagagaaauguccccaaaagacaaaucuacacagaaagauaauggguggcugccaaggacugggugauagagaaacaaagauuaagguaugguccagggccuuccuuuuaggaggugagaacggggacucaggaugauggugcacaacacugucaccuaacugugcacucauuaagggugugugaaccuaggugaacugugcauuuuaaaauggaaacuuuuaugugcauuucaccuugacuaaaacacaguaaagacaagagaagacauggagacgccacucacauguaugcacacacacacaguaccaugaguacucacaaauuuuggugguggcauggugaggcucagacugcucaaggugacuucauggccacucugugcacaggccaccagucgcagugcaacauagaaacccuguaaacccaaaaagaggcuucaacaccauaaggcaggcagcccauagguccucagucccacugugcugacugaagcacagccgguggccauuggugagcacugagcacugaagaggcccaagaaaagggacuuucccagagagaaugaaugagcuucuagaucaggaaacgcuggagcagucguacacucauaaugacugauggaucaaacacaccuauccuauuuuguuuucuguuucuguggggccaggaauaggauguagccuaggaauuccaaacaagaacuuuccuccaaagcaguacugcagcccagguauuggauuuaaacaacuuuuucuuuuuuuugagaugaaaccgcauguauuuauuaggaaggaagggucaugugcauccagugugcauguaaaaaucggagagcuuggggaauuuagcucucacuuucuaccaugugggucuagggauuggguucagguuguuguugggcaugacagcaaacaccuucaccagaggaauugucuugcugaccuacuuuuucuuuuuaguuaguuuugcuguguuuuuuaaucuauuuuuuuuuaauguauggguguucugucugcacacauaccugcauaucagaagaaggcaucagauuccaccauagaugguuaugagccaccauuugguugcuaggaauuuaacacaggaacucucuaguuaagaauuaagucuugaagggcuggcaagauggcucaguguguaagagcacugacugcucuucugaagguccugaguucaaauuccagcaaccacaugguggcucacaaccacccuuaaugagcucugacgcccucuucugaugagucugaagacagcuacaguguacuuauuuauaacaauaaauaaaucuuugggccugagccaguagggccgacuggagugaaugggguugaccagagggagcagagguccuaaauucaauacccaacaaccacaugaaggcauacaaccaucuguacagcuacaguauacucauauaugggccacaugcaugcacacacacacauuucuguguugcugugucaucauccuguguugugcgugugucggguguguguauguuuguuuguuuugagacagucucacuguguagcccuggcuggccugaugcucacagagauccauucaucugccuccacugacugacuguugggauuaaagauguguaccaccguaucagguacaauucauuuaauuaucuuaauucuuuaaaauguuuuaaucauuuacaguuuugguuuuguuuaaagguguguauguauguucugaguggucagaagagggcaucgauucuuuugagacuggaauugcagaugcuugagcugacaaauaugagugcugggaccugaacuauguaacagcugaaccugcucucucuccugaugauguuuagcuuagucuaccuggcacaaugggagcuaccuagaauaaaagucucaauugaggggcaguuucaaacaggcuggcuuuugaggaguuuuccuggguugccugagaugaggaagccaaccugcauauggccacaucaccccugggauaggccuggacugagggaacaggaaaaagcugcugagcacugguuugaugcauuuauuaccugcuccugacuggauggggucagcugcuucagguuccuacugccuugacugccccaacauacacacacacacacacacuugcaguagguuguaucuggaacugugagcuacagguacccuuuccccaaguugcuucugucuaggcaauuuaccacagcaauagguaaagaaacuaagacagguacaagacagucaaaggcaugccacugagucaggggccuagguguacuuaaagaccugcauuccacagugagaacuccucacuugagccuggcagcuaugugugauagcagacaguagaagaaacacacaacuaguccagccucagggguucccacccccuccccugcuccacaugugcauauauaccuguuuguccaagaacccuuuaccuucggggucugccaagucccauaucuguggaaacacaaaagugccugugagugugaguacugcucaccaacaacacacagaacaggagucuuaucaaccacuucucugucaugggcacugggaccaauagccaacagcccugccaggccaggguuauuuggugguagggcucaaagaauacccugugcccacuuagcuccccaggguguagugauuuagaucacuacacagcaacaugaaccuauagcuaucaagauaccaaaagcccucuguucuggucugcugccuaugccuugaggugacuaccaccugagacugaccaggcuagucucaaacucaaggaaucuaucacucucugccuccagagugcugggauugaaggaguauucccuauaccuggcaucguggcuuugguuuaucuuugcaaagacaggucauacuauguacuccaggcugauccuucugccuuauccucccaagugugaggacaggcaaggaaggucauaucuaacagcuucauccagggccugucuucacacccaccaguuacagcuaagaggcuuggguguccugguccugccccagagaagauuugcauagcugcuuucauuccaaggaugcaggaagccaugcuucaucuucccuaccuuccccaggaugaugucugagagccccgauuucuucagaaacagcgcagccucgcuugccccaacucucccuguguaggcaggguccaccuacaaagggacagcaaaagucgacgcauccacuuagaaauaacaucuccauguguacucacagaaagcugcuuuaaaugcaugcccaacuucaacaaagauguguggcuaggugcaacucaguggcugagcuguucugcauguaagaggcucuggguuuugcccacaacaccaacacauacauacacacaggaguacauacauacacaacauauauaaaggcagugaugggcuggagaaauggucaguuggcaaaggugccugccaccaagccugacggcuugaguuugaucccugggacccacaugguuaaaggagaaagcugacccccacgaguuguccccugaccucuacaggcaugcuauaguacaggugaacauauauaccuacacagaaaagaaaaagaagauaacacuuagacauaccugcuuguaauaagacucguauaacggauuuccaccgggaaucuaaacaaaacagaagagucacaaagugcucacaagcagacauauguauggccugccaacagagaagcacccucccauccuggcccuuucucuucagguacuaucuaggauggucuuuugcuguuuuguuucauuuuuguugggacaaggcacugcaagauagcccuggcuggccuuaaaguccuagugauccucuagcuucaggcucucaaauacugauauacaggaaggaacugccacacccagccucaagccaagugaucucuugccuuagccuuagguggaggugacaauacacaauguuuugccaucaccaaaauaugccccgguucuaguaaggaugugugcaccccgcauccccaggacagagggcucacauaggauaggcaauggcagaagaaaggcccccuuucuuugccuccuuccaagccccauguguugggcaagugucagcaugugacccugggucaccagcaugcauuuggcuguuuucaggcccccuaacagcugccuaacagcagacaguacacagacucacgcugcaggggucuuccaggacacacagccuugugcugaaagcaaccacucccaaugugcaggaagcccaaggacaccccacaaucagccagaaugugucuggcucauuccaagcuucaguucacaggcucccacuuaucccauucccucccucacuggccucaacagaggacaccccuauaaggagguaggagucaucugggggaggaagccaccucaguggggaagugcagugcauuagcuacuaagcaacaagguggucuccaguccugggggagggguagccaagggaggagucaggacaacuggggguacuuagugcuacccugucucaaacaaaaaaauaaagcagguaaacaagcaagccgcuauaugaaagagcuugcucuguuggggcuuuuggaagacugaagcacagaugcagggagcaccaaccccagugagcagugggggaaagggcaccuuccaguucaaccaagggcuccauaaccugaagcuucagucugcuaucacccuggaagugauuucccaagggaggauguguccugcccacucugucugccugccuaaauguggguauccugcuugaccaucccaaccaccagagcuuacaggagaaaaucuguucuugaucaauaaauauaccagccuugggaacccaucacaaaacacaccagggcugagugaagagagugaguaggguaacuuaaagaagggugccauccacacagcuguggggagauggagacagaugccguccacacagcuguggggggaugaaggagaagggugcaguccacacagcugugggggauggagggaccuucugagucauuaugagagguuuaucaacacuuccuuaaggucuguggagcaugucuucaaguccuagaacucaggaggcagagagaggaggaucucugugagucugaggccagacuggucuacacagugauuuccaggcuaucuagggccaaauauaauaagacugucuuuuuuuggggggggggggcggggguuuucgagacaggguuucucuguguagcccuggcuguccuggaacucacucuguagaccaggcuggccuugaacucagaaaucugccugccucugccucccaagugcugggauuaaaggcgugcaccaccacguccagcgagacugucuuuuaaaaacaaauacacacuuccuuagccuggccugccuaugauacugaugguccaugucuaaagacaaaaccuaaaccaagcagaacugccagauccucaaucaagagaaacaaggcccaacauucagaaaggcugccacagccaggcccacucaagucuguuccaacccugggacugacugcauccuaagaaggagccuaggggcaggggaguagaaugcugugaacacagaugaggaaacagaguaaacaucagacaugaaccaugcuuccuuucauaccauuucuuccuggggacagugaagucacagcugcaggcugucuaaguguucacugugacaccauccaaaccucagucuacagccuuggccaaucugugaaacagguaugaacaaaaacugcaauagcagcuagcucaugauacagucuguggcccccaaguugaacucccauacaaagacagagcccuccguuugcccacauuugacacuacccacacaagucuagggaccaaaggacaaggcuuugagggcaagaggcuucagggcaugaagauggccacagcccacgacacagucaggacaccacacuuucuuguucuuuuauuuuuuuuuaauuuauuuauuuauuauauguaaguacacuguagcugucuucagacacuccagaagagggcaucagaucucauuauggaugguugugagccaccauguaguugcugggauuugaacucaggaccuuuggaagagcagucggcgcucuuaaccacugagccaucucaccagcccccacacuuucuucuuaaaccauagcauacggggcugaagagauggcucagcgguuaagagcacugauugcucuuccagagguccugaguucaaaucccagcaacuacaugguggcucacaaccauccauaaugagaucugacacccucuucuggggugucugaagacagcuacaguguacuuauauauaauaaauaaauguuaaaaaacaaaacauaacaaauagcaugcaggucccugagguuccuucacuuuuccuucagcuaggugagacggcagggagagaacauggagcaguuuugcacacugcugcugaagaaacuucaaaacaccacagcucuggagaaaauggcaauacccccuuggaggggauggucuagggaucacaucccagcagcuccaacccuggcagcgccuggccaagagcaggcuccuuacaagccuccacaccguccugccaaaucuacuuccuacaugcucagcugaaacugagcuucaguuauagauagaucuuggaccucuggggcugaggagaugcucaggaggcaagcaagagagccugaguuaggaucuccaaagcuauguaagggcagcuauaaucccagcaccccuucugugagagaagaggcagcucuugaagcagccagagcagcauacacaguggaaggaaggauacccaaugccaucuguccugacagcucuguuacacuguccacaccacacccaugcacaguggcuuuguuguuuuguuuacauuuuugaaucuuugagaagcgcuuauuuuguguuauauaguacucaggauugauccuagggccuuauacaugcuaggccagcucuaccuaagcuauguccccagccccucacuggcggauucuaggagcucuauagcucucaacagguggcaggggugaaaagacauaaaagaaaaaauguaaaugacaaaaguauguauaauccauucuaauaaauagaccacagugaaacacaguagcacaugccugucauuccaacacuuuccucaagggaggaggaucaggacaagggcagucucaggucccuggaauaccuaaaaccaucucacccuccugugagaggccacacuccucacuauucacugcucacucaguguuuugcauccagcacuuucaucugaagacuguguuuucagacaaagacuucuugguguguaucuagcacucgaaacuuagcuugggcugaucucaaauucucagcaagcucugccucugcucccuaaggcugggauuacugguaguauacauaugccaccaugccuggccuugagcuccucauucagucauccuauagggcaacacuacagggcagacaauaugauaccuccuguuuauugguaggacaauggaucuuuucccaugcagacagugaaugcugggacuuacaggagccccaggcugggaggccuucauuccauccuaacuugcugcaaagagaacccagguguggcagagcugggcaguuacaugggcuugugaccugagaaaaauacauucuugggguuccacaauaguauaguuuauaaaaucaaagcagccaguggccagagacugaacauacaaagcuacuugaaaacagguauaggggcuggagagauggcucagagguuaagagcacugacugcucuuccagaaguccugaguucaauucccagcaaccacaugguagcucacaaccaucuguaaugggaucugaugcccucuucuggugugucugaaacaacaggguacuuauauacauaaaauaaauaaauauaucuuaaaaaaaaagaaaacagguauagccugcuguuuccccagggagcacaaacugcccuugguacaggaagaaggcacagucugaaguccugcauggacacccagacaugaccuagaaaauggccugcagaggugugagugccacggcugucaucccagcucuuugcaguggggacaagcagaaaguaacagagaaauuggucaugcaaugaccugcagcuauggugggcucuuucaaccugagcuacacgguaagacccugccucagaaacacacaaaaauuaacagaguugaugauguagcucagcuagcagagugcuugccuggcauacacaaagccuggcuccaccucuacaaccacauaaauaaucccagcacucaggagagguaggcaggacagaaagguaaaggucauugcugguuagauaguaagucuaaggccaaccucagcuauauaagaaccuguuucaaaaaauguuuuuugguuuuuuuuaaaaacugggggcaaugguggugcacacuaaccuagcacuagagaggcaguuuuugaggccagccuggucuacaagguugaguuccaggacagccagggcuacauagugacacccuaucuugaaaaaauaaaaacaacaaaaaaacugggcuggcaagauggcccaaugacuaagacaucuugcaaguuuggugucuuaagucacuguucuauugcuguaauaaaauaccaggaccauagcaaaaggguuuuuaguuucagaggcuuaguccauuaucaacauaguaggagcauggcaguacacaagcagaggcaguagcuguauaugaucuguaagcagagagagacagacacucagggcuuggcuuggacuuuugaaaccucaaaacucacccccagugacauaccuucucuaacaaggccacaccucuuuucuauuacauuuuuaauuaauuacuuuauuuauuuauguuccaaauguugcguccuucuguugggagcgacccucuuugaauguuaacugccuagucagccauaagugcuuacuuagaaagucuuggccucugugggaaaguacuagcccagcugaguacaaauagacauagauccugaagucagccgagaacaaauagcuauacaucuugugcauaggugccuaacaacccauucuguucugaucuucugcugaacuguuuacccagucaauaucuuguuccugacccccucccuccaccccucuuccugcuccuauauaaccugugugggaaaaauaaaaauuugucagcuugaacaggaccuugucuugcugucguuuuuuuuuuuuguguuucuuguccccauucucuuccaggugccccucaaaccccuguucgacuaucccgugggucaggacauccuccuagucuccccucucagaguugaguucuuuaccccaucuccccuccccuuuaccucuaaaagggagcucccccucuuucccacccccccccccaggcaauuacgucucuacaggacuaggcaggcacaucuucucccacugaggccagacaaggcaauuuucugcuacacaugugccaggggccucggaccaucccaguaagcuauuuaguugaaggccacaccuuuuaauccauacaauucuuucaaauagugccauucuaucaaauauauggucuaugagggccauuugcauucaaacuaucacaccuggugaccuagcuucaaucccagaaccuacauaaagauggaagaaaagagauggcuuuauauacacacugugccaucugacugccauacacauuaugcccacucugaccgccacacacaauguggcacaugcuuuaccuccuguaaaauuauuauuauuuuauuuuauuuguuuuucgagacaggguuucccuguguagcccuggcugaccuggaacucacucuguagaccaggcuggcuucgaacucagaaaucugccugccucugccucccgggugcugggauuaaaggcaugcaccaccaugccuggcuacaauaaaauuauuauuauuauuauuuuuuuacuuuuuauuagguauuuuccucauuuacauuuccaauguuaucccaaaagucccccauacccucccacccacuccccuacccacccacucccacuuuuuggaccugguguuccccuguacugaggcauauaaaguuugcaaguucaaugggccucucuuuccagugauggccgacuaggccaucuuuugaugcauaugcagcuagagucaagagcuccaggguacuggcuaguucauaauguuguucuaccuauaggguugcagaucccuuuagcuccuuggguacuuucucuagcuccuccauugggggcccugugauccauccaauagcugacugugagcauccacuucuguauuugcuaggccccggcauagucucacaagagacaacuauaucuggguccuuucagcaaaaucuugcuaguauaugcaauggugucagcguuuggaagcugauuaugggauggaacccuggauauggcaggcuuuagaugguccauccuuuugacacagcuccaaacuuugucucuguaaauccuuccauggguguuuuguucccaauucuaagaaggggcaaaguguccacacuuuggucuucguucuucuugaguuucaugcauuuagcaaauuguaucuuauaucuuggguauccuaaguuucugggcuaauauccacuuaucagugaguacauauugugugaguucuuuugugauuggguuaccucacucaggaugauacccucgagguccauccauuugccuaggaauuucauaaauucauucuuuuuaauagcugaguaguacuccauuguguaaauguaccacauuuucuguauccauuccucuguugaggggauaaaauuauuuuaaaauuaacaaagaaacagaccuguggcuuagcagggcaucaauuugcacagacacaguccuagguuuuauucucagcauuucaacaaauaaauaaagguaaaaaugaggaacaagauagaccauaaagaagucaggcuacacugcuaggacaggaggacaccguuccucacuugcagcugugcugggagaacaucuggcugcaaaguguccagccaacagggcuuccuaccuggggcucuuucagguuauggguacuuuucauaucacacagcaccaucuucuggauuaggcucaaaucuaaacacagaacucagcuguucccaggagccuugcacacauacccuagcaaacuuccuagcauauuucaugcaagccagucccagaaggucaggugugcaacuuacugccugcagagucaugcccauaaagaacuauuguaucguggagcucaaaaaacccacuugggguuuuuagcaaagaaauauguagccugcauuauagaacagaaugaggugccagccuugcugucuacucagcaaagucaagaccagccauggaacagagcuggcagaggcauacaaacaaauucugaguccugcucuggaggucaaacaaugcaacugcaaauacuaacuugugugucccagaugugcaggcuuaagccacuucccugaacuccagccagacuucuguuaacuauggaaucauucucagacugauacagaaaggcagcacuaaauaacaugccugugcauguguaugccacagugcauccgggugucagaagacaacuuuuaagagucaguucucauccaccauguagguaaucaacaggcuuagcagcaagcaccuuuaguagcuucuuaauuuuuaaaaaauguuuaaaaaaaguuuuauuuauuuauuuuuuauuuuugguuuuucgagacaggguuucucuguguagcccugggacugcaggugggcaggcagcaccacacugccugaaugacagccuauguuugcaaugcuagaggugggaccuugaguuccguacaugcuaggcaagggcuccaccacggagcuacacuucuagcccuguuccaauggagucuaauaaaagcagagcaggagagauggcccaguggcuaaaugugcuugcucccaagucugaggccugaguuugaccccuaccucuuggcaaguuguccucugaccuccacgaacacaauauagugcccuaacauaaauaaguguaauauuuuuuaaagaaguagaagccacaccaagagccucauucaaaagcuggaaggggggagguagcccgguaacuggaaggagaguuuucugcacagugcuggagcaacacagaacuaaguggcucucagccugcagauuacacacuggugauauauaaaugauacagguaaaaacucaaaugaucaugacuucauucaguauaaaaugcaaaaauauaaaacaugcugggcgugguggcgcacaccuuuaaucucagcacucgggaggcagaggcagucggauuucugaguuagaggccagccuggucuacaaagugacaggacagccagggcuauacagagaaacccugucucgaaaaaccaaaaaaaaaaaaaaaaaauauauauauauauauauacacacacacacacacacacacacauauauaaacauacauacauauaaaaaacauucaggaaaaaucuuuaggauucagggauagaugaagacagagaagcuggggugccugcugcucauguacagaaccuaggcugcacauucaggccgguucaucuccagugcuuaaugagcaugccauaacccagguucccaugagccauacuuccugagcauacacgguaccagguuccauccacagcacugaagugacaaauaaaaaugaguccuuagaccugauacuacagugaaagacuaacucaagcugccggaauucaaaugcucacagaagaacagugggagacaaaggggucagggugucuacagaauacucauccuccuacacagcacuguccaaugaguggcaaaacacacaaggacgguuccaguaaauacacagacaggguuggggggggggggugcaaagaugcuggaugacaggagccagcagagaaaccgaaacuaaaugccccuggggcaacugcugagcagggagcugcuaaaaaccccaaacuaaacaaugcugcagcuguccagggccuccacucuucaacaguaagagcugguguguaaagcacccugucauuagccuacauagucacagagucauggcucccagagagucaacucagcagacacugauggaacauauuagacacaguucgagggcaauccauuccuuagaggcugaggcaggggaauuacuagcucagcaccacccccccuccaaaagaacauacuuaaaggccaagauauagcucaacaagcugggagggggcuggagagauggcucagugguaaagagcaccgacuguucuuccaaagguccugaguucaaaucccagcaaccacaugguggcucacaaccauccauaaugagaucugacguccucuucuggugugucugaagacaacuacaggguacuuagauauaauaauaaauaaaaauuucuaaaaaaauuaaaaaaaaaaaaacaagcugggaggaaggcagagggaaauggacaaggaagugggagcugggagcacagcccagacugagaaggugcugucugguaagugccugcagugcaguaugcagacuugacucagaucccuagcaggcacauuuaaaagaaaacaaagaaagguuuggugugguugaaaacaucaguaacucuaguaaggagcuguggggacccagagcugagaggguagccacucuagcuaucaaugagcccugggcccaauuagagguucucaaaagauaaggcugagccagugguauggcucagcuaguaaggauaccugucacaaagccuugacaaccucaguuugaccgcugaauccuccaagguagaagccaaccucugaccucuacaggaacaccgugacagucuuguggacaagcacauauaggacacaaaauuuaaaaauuuuaaagacaagguugagagcaauaggagacacucaacacuacucucccaggcuccacaugcguaaguacacacauguauuuacauacacccaggcacacacaaaaauuaaagugaaaauguaccauagacuuaagcacaacacauacaaauacaauaggauaacaggauaaucuagaaaacuaccacacagacacuauggccacacaaagcaaccagagacugagcacaagaggccagucccaaaaggugacugcuugcuauaccaacaaccagcugcugauugcuggggaacuggaggacagaggaaagcaugagagggagggggagaccacugucacaggugcacaugacuacaacaaucucacuguuucuuuuugugucuguguaugcacaugcacacacucauguaccccaacucuaaagccaaggucaaggucauucuuagcuacauagcaaguuagaggucaccccgagccacuugcaauuccauuucaauaaccaaaaaaaaaaaaaagggggggggcuggagaauuggcucagcaguuaagagaacagauugcucuuacgaagguccugaguucaaauuccagcaaccacaugguggcucacauccaucuguaaugagaucugacacccucuucuggugcgucugaagacugcuacaguauacuuagauauaauaauaaauaaaucuuuaaaaaaaaaaagaccuuagaauuaaagaaauaggucugagcugggauggcgguaccugccuuaucucagugagcuaaagcugagacaagagaugaagggcuccaggucagccugggccauauagggagaccacauagugagacccuacucuacaaugaaaagcgaaacaaaaauugugcauguggcugggugaggggcuuggaaagacuggugcagagauggcagaguguggcuaccuguggugaguuuaugcugucauucggcccuuccucucccucuagcacaucaggccucuguguagaagaccauggucaagcauuucugcucugccaggaaccagaacagccaggcuguugacugaccugcagauguugagagaagagagaacuuuuccaccaacaagaccaggcucuuguccaacccugaagagcugccauuuugagcaggaugagucuuaugggaagaagaguucugagccugugugaggcccuggguuccagugcuagcacacaucugaacccccagcuacagcagcaacgugaaguacacaagaaaaaccuguccagaugugcagggcaggaagagugacagggcuguuuccuccugaagucagaaauggacagacagggaugguaagccacugaggacugaccaaaccaauagacuccugagacagacagagcacagcagaaaggaugccuuagcuugggccacagauagcacagcugccaagcacuggucaaguaaagaaggagacacggagccccacaccacagcucaagguccugcuuccaucuccagagccacagaaaaagaccaaagguugaaaacuacacauggugugguggggccauucugacagggcuuucuugguaguagcuggcuugccucuuccauguucucuggaguuccaaccuugaaccauguuucucuguccauaggacagguggcuggaggagcuggcagaggguagaagauagugguuugaguagguuuggcccccagacugauguguuugaauacuugguccauucaaagugaaugagaaaguggagccaggaaaauguuuagauucccaaacaguuccaugaaaugaauaaucuagagacacccuagcugaguguaccgaccccaaccggaggccacuuguccuuucuccauguguggaacuaguggaaagcauagagcaucaauugcuaccaggugaccuaggcucccagccuccucuacaagaugcuuacaaacugacaggacucuucacacccacccugagccuugcuggccagcccauccuuccuucccagucuggacaaucacugucaucaucggccuuggucacugcccccacugccuggguccuuagacagcaggugcugagcuccaggaucuugagccauaguccagucaacugacacaaacaggagucaacuggccucuccucaaccguuuccacagacaagaacacagcacuacugacuaggccuagaaggacaacccagccucucuccugccuaacaagaggagcaggcagagcaacuccaccaucucagguugucucuacugaacgccccauaucaaucucagaaaaccauaaagagaucauggcagguuagugcacuccuguauaaacacacacaucugcucaugcacccgcagucacacucauggcagcaucccacccuuccuuucuuuuucugccugaugagaugagauucauaaaacaucaagacacugucaccccuggaugucacaaugguuucuguguugagugcuggggcugacugcuccccaaccaggacugagccacuguccugggcagugugucucucccaucccuaugcccugggccccaacugaggggaagagugcuucuuaaguucugacucacggaggccaguccugaacccuccuucuccuugcauuuuucacacuguucgagcuggaguugcaggggcaaagauaaggacucagggaccccuacacaccugccacaagcuaugcucuauucgucacaugguccagugugagccauagccccacuuaccagcuccuauuccaaguuuccaaagcuagcaggagugaaagggacaaccugagagauccccagagaacaaaacccaagagguaaaugccugccagaccccaccagagcacagcugcaucugggaccccaacagaugcgggggaagggggguaugaccugaggcucauccaguccaauggggguaauaaugcugauaaauacuacagucacauaccugccugaaaauuggcuucucuuaauccaaaagggguaugcuuuucaauuuuacauuucccagcaaagaaaaccguccucagcuauuugccuagcaugugcgaguugauggcuuccauucccaacaccaaaaaaauaagggcuaggaggcuggaggaaggucaggcuaguucccugugaugagggccuccccacccuccaauggacaucugugccaaagagguaaagcagaggugagaaguagccuguggcugcccuggagcuuaaggcuggucuuagccucuggugugcacagccaauggcuacuucuuucauucauuuguuuacuugggaggacaugcaugggcacagugccuguggaagucagaggacaacuuguaggaguuggaucucuccuauauguggcuuccagaacuggauugaaaucaucagaccucuacgcacuacgccaucucacagguacauggcuacugcguccuccucuugacugcauaucuugacaccgcacauccuguccagcaggcugucccguggcaguacacagcacccagccccacccaggguuucaugacuccucugacagcucugcugugaacaugcagccacgcccugggaugcagaaugaaugauaaggcaugggugggagagguaauaugucagggaucagucacucuacccaggaauucccaagccaggaacaguggcugcugugcaccaccccccacccccucacccccagcuauucaugaggcugaagcacguaggugaaaacuuugaggacagccugagccacacugggagagccugccacaaaauaaauuuccuucuuucuuuuuuccucgagacaggguucuguagaccaggguggccucgaauuuagaaaucugccugccucuaccucccaagugcugggauuaaaggcaugugccaccacugcccgccuauuucuuucuuuuuuuuugaacuuauuuuuauuuaaugugcauugguguuuugccuacauguaugucugugugagggugucagauggaguuacagacaguuguaagcugacaugugggugcugggaauuaaacccagguucucuggaagagcgguugcugagccaucucucuacccccccccccaauaaauuucuuaaggccagaacuauagcucaguugguagagcagucuuggugguucacacccaucauccccacucugggagggauggggagggagaucauacugcaaggucgucauccucuacuuaaggaguuucagccugggcaccaugacagccucacucaaaauauguuuuuguuuuguuuuaaaugagacagagaguuugaaauaauacauaaaucauaaacagacauguagcaaagagaaaagaguccaucacaccagccagcuguuugugagaaaaggccucucugaggaggagacagcucagcugaggcaggcaaagcagcugaagagagagaaggagauggcuauuccagucaggauacugcagguacaaaggccucaggacagcccacagggcaagcagugcuaggugugggaacccugaugugccaccaggguuucuggugucugucacugcuuucagucaguaagaggcaacgcugucuguaaucagagagugaaagcucucucauagagcaggcgcaggggccugaggccccaacuguugugccaucggaaccuugcugggaucacuggggauggaaaggagaagaaagcauuagccuaagauacaugaaggaggcucugguucagagcccugcacuccaacagcaaaccaagcacagaugcuucuaagcccacaucagacacaguggcuaauggccuaaauuacagagggaguggaaaccaucaugcccugggccaauggagucacuacccuguccaguggcaaguuguggcccugccuaaggacagugacuagaugucacccccccugaaacccuuggccucaggccagcguucgaacaagcagccaccuaucagcuuugucaggacucauuugcaaucuaggcacacaccaguguagaagccagguguggucagccuuaggcagcugaggaugcagaauggcaaguuuaggagcagauugucuuaaccucuuaaccugucuuaacccucucccccaaaaugcauacaauauaaagauagccagauggaugaucagcaggaagagcccagccugaagacccaggcuccagcccuggauucacaagguaggagagaaguuguccucugaccacacacaguaguggcauguucacaaucacacaaauauaaaaauguucuuuaaaagaaaguacaaggauauaagcaauaggcaggucucuaagagacagucacugcagucagccagugauaucaaugucauacugauaccugaaaacaauccuuccaggacaggaaacugaagcacaauagaaagagcuaggucagagacccaggccaggugaggcugccaggcacagcccagccagggaccagaugguucugaccucagcuuaccccucuacacagucagcaaccacaacaaugacaggguguccaagaagauaaccuaagauacagucagcccauguaugcucuuugucugucugucccacaugcucucucucucucucugucucucucucugugucucucuacuguuuuguuuagucagguuugacucuguaguucugccucaccuggaaccauguaacccaggcuaguccucaauuuacagaaauacuucucucugcucccuaaugcuggaugauaggcugcccaccuagauccacugcauagaccaacuuucuagagggacacuggcugcuccagugaagccaagcugaggaggccaaagugaagcucagccuccagagccaccucauguaaagacaguuacuuggcucuucagagcagcugacccaggcucaaagacaggcaugggaacuggggcugagggagaaagcaugugaucuuguuugacaaggcuucaggagucagaaaaaaacaaacaaaacaaaacaaaacaacaacaacaacaaaaacaacaggcacugcaggucaacaaagcagccagggacucuggagcuccagcagaggacaaaucugccccuaccauguucucuguccaucaaggcaauggcacagucaccagccuuccaaaaagagccuugaaaacagcacaggcacaaggggacaaaugaaugucccuaggcccugcauuccagacacacuagucuggccagagcucuacgcaggaugcucgcucagcaggcuauguggaagaaugguguuggagggagcuccacagcaagcaaccaaugguuuaacucuaaugggacacauggcuauggggcuuucacaagucaccuggcuacuauggguaucagguuuuucucauccaauaaacagauucuuuuuacaaggcugggaggaauagcuugccaguaagcacuaccuggcacgugcaagggccuggguuucaccacagcaccagauacaaucaugaccuacaaccauggauuguggcucaugaaggugucacuaaauccccuggacauaagaaaugauaccaggaggaagcuggauagccuagggcacccuuauuaugaacaaagaacccacagaugcaaugggcagaaugaucucucagguccgggagggugaaagggaagucagcagacuaccugugccccacagcuccaagaucaacguuggugagggaaagccaggggucaggacaugagaccagaauagcaaggucagucaacaaggucaggugaggccagaaaggggcagaacaggacuguggggugcuggcucacaagcccagacucacuuugagagggcaggcacuuuaccacagagcuacacaccuaaccucccugugagaauacaagccacgaaagguucuggagucagggaauaguaguuagaagaucccacggugauagcaggaagaaagggaggaaucaagacugacagacagugccuaggcccagugcccugcagaacugccgaguucagaaaguagccaauucuagaguccagcagcccccagaagggcagacagugucugagucuguaggaggcagguuuagaguacugagcaaggaggcugggaccagagagcagagagaaaggacagagagaugggaagccaaaaaacccugaggagaaggaaggugagugggcacaggaggaggcuguguguaagggcucaggcuauguuccagacagaaccucuggaagagaagcaggccuggaggucugcugucacucaugagcaaucuggugugaaagggaguucaggaugggauuggggagaagagagcagacagagggcaauaggaaacauccccuggggcugccgagaaaaaggagcagagacucucccugauccuguggcugggcucaaccacaccacagccuucuguucagcacaccucagccaaaugguaucccagaacucuccaugcccuguuuuccuugugauccuaugugagcuguuaggcuugcucuaagggucuggguaauaguaacaucuauaucugagcagcaaguauaaacacagacugcugaacaaauggcucagccgugcuuacugcucuugcagaggaccuagguucaguucccagcacccacaucaagguccuguuccaggggaucugacauccucuugccuccaugggcaccugcacacacuugauacaaauaacucagagagacacaugcacauaaauguaaauaaauaaaucuuaagacaaaaggggaaguuauagaagcugagcacgugauucaaaucuguagccccggcauuuaggacggcaaggcaagagaacugccaugaguucaaggucagcuugggcaacuuagugccaaugagaugguugaacaaggacacuugucaccaagccuaacaaucuuacuuugaugcccaggacccacauggcagaagaagagacccaacucccagguaguacucugaccuccgcacacacgcucagcacacaugaacauaaggauugcuuagugaguagugccgagcaugugugaaacccagaaccaacccucagcacacugcccuuauaaaagcagguguggggcuccuggaccaggccuucugcuaaccaggagguaggaagcaaccaggcaugcucugggaucacaguccucuagaggcuaaggcaggaaaaucaauagaagucuggggccagccugagcuacacagaaagacuuggaacucacacaaaguaccaaugcaggaaaauuguccuuugacuaccacaugcaccaugguacauaacggcccccacaggaauaaaucaauaaauacaaaaaaauuuaaagaaucaccacaaaaacauggggguggagggaaagcagcucagaaggcaccugaacuugugagccaccacaggccaugucuccucaacugcuguuucagcuccuguucccacccacagcuccaucccacacagggaagaaaggccacacgggagcugcugcaggugcagucacaguccccauaccuacuuaggugacacuuucugagugucuuuccacuggcaacaggucugacacagaaacaacagacacgcaaacauguccuguggaccaagagagcuguaggauuauaugaugugcacauggcugugugccaugacuagcaaaggccucugggaaggaugauaucugaacugcugcugaaggaagagaaggauccaagccagagaagaaaaggcuggagugcuucagaaagaaggaucagucuucagggccaccauagcugacaacacagcuagguaugugaagaacagagaacugaccacaccauggugccauggagagcauguggaaggcaagucacaaguuaggaagagagaaucaggauucuaucccagaggcucuaacaaggugaaucuaaugaaacugacucauguuuuuguaucugucaucucaguaugacaaaacgccauccuacgguaacuaguuuaccaauaaaauagagcaucccuccuccccagacagggccucauuuuauagcccaggcuagaacuuucuguuacugaagugcuagcugaaaguugacauuauacuuggccaggaaccgcuuccuugauauucugguguuugagaaaaaauugacagcauguauccaacucccauguacucaauaacuaucagcuacuacuauggcccaaauuuuuaaaaauccaaauuaugacuaaugucaaaauuaggaaauuugaaaaacccucccucaaaaaaagucagagguaaugacuggacugaagccagcugaguuaguaacaugcuugcccuaaaagcucgaggauccaaauucucuccccagagcuagcucacacagaagugcuacaggaugcacggcacuugugcuggagaagaagggacaggaggcucccuggccuugcugacuuuccaggcuggccuaauugaggaacuacaggccagugagaaccugucaagagagaggugaacacccacagcugguccucugucaucccacuuggaagccuggagcacgaggaugcagagaguccaggaauuggaagccagccugggugacauagcaaggcucuaacucaauacacaccuauccucaauacacucccuacuaucugucuaguccuuaaccauuuucagaagacaaucacaggugcuguaagagcauguuaauuaauaucuacuggucuccacauguuaauauagugucaaggcugcugguggcugguccuuccaggacuuaaccacccuguauugcccucuccuucagaccaggugaccugggugcaucagccugccaagcaguucuuaccagcuuuggcauucauacuugcucuugucuuagucccaaacacccgaauuuauugacggguaacaaaagagcuuccaauguguuaggcaaaaugugcuuuccacaguuuucugcuaaugcauuuuacaucucuauuuuccaaaugagguaauugauaugcugagguuaagaagccugcuucaaggacacucuuccagaguuggagccgagaucugaauauaaaaugcuuccuccugguaaccaugacccugcgaaagacgauucuagcaaagugcauauaauaugcuguguggaacaaacggguaauuuggcaaauuagcaggacaggaauacuuucuaauucuuauggaugucaccuggaacuagagacuuugucagugagagacugcugagcucccaagcaccugaucccaagcacguuagaaaguggcugaagaaugaaugaauguuuuccgcuagaagcacaauggccuucucacugcuauucuguacgucccuguagcauuugauacguucaagaaaaccauccagcgacccugaggacgaagacuggugcauaccguugggggcguaggauccgcgcuuuucgcaccgcacagagcagcggaagcggaucucgggggaaggagggcugggcggccagaggcgaagcgggcgugucccgguuccccuugcgacuccaguaugggacaccacccgccccgacgcccgaccccgcgggagacaaagacuggcggcgggcccaccgcucucgcucgccuccgcggggacgaagcgcgacgcggcucgaacaacagcgcccaccccccaaacccccccccgucccuuaaccuggccaggccccagacggagcagacauacgcagcggccgcgccccaucaccucuucgcagccgcucgggggucgcccggcgcaagaguaugcgggccgcuccggccugucaccuucagaaccgcccggcccccgccacucagccucugagccuucagcgcgcgccuccgcgguccccuggagccgcgcuuccgcgacgacuuaucuuucucgcggcaaccaccguccgcaccgccccacggcgcaccccagcaccauaccugcugcgagagggguacaagcggcgccgccaucuucgugcggacucggccuccggagcgccgaaggaacg

SEQ ID NO: 4530 - RNA, 80822 nt, Mus musculus
cguuccuucggcgcuccggaggccgaguccgcacgaagauggcggcgccgcuuguaccccucucgcagcagguauggugcuggggugcgccguggggcggugcggacggugguugccgcgagaaagauaagucgucgcggaagcgcggcuccaggggaccgcggaggcgcgcgcugaaggcucagaggcugaguggcgggggccgggcgguucugaaggugacaggccggagcggcccgcauacucuugcgccgggcgacccccgagcggcugcgaagaggugauggggcgcggccgcugcguaugucugcuccgucuggggccuggccagguuaagggacggggggggguuuggggggugggcgcuguuguucgagccgcgucgcgcuucguccccgcggaggcgagcgagagcggugggcccgccgccagucuuugucucccgcggggucgggcgucggggcggguggugucccauacuggagucgcaaggggaaccgggacacgcccgcuucgccucuggccgcccagcccuccuucccccgagauccgcuuccgcugcucugugcggugcgaaaagcgcggauccuacgcccccaacgguaugcaccagucuucguccucagggucgcuggaugguuuucuugaacguaucaaaugcuacagggacguacagaauagcagugagaaggccauugugcuucuagcggaaaacauucauucauucuucagccacuuucuaacgugcuugggaucaggugcuugggagcucagcagucucucacugacaaagucucuaguuccaggugacauccauaagaauuagaaaguauuccuguccugcuaauuugccaaauuacccguuuguuccacacagcauauuauaugcacuuugcuagaaucgucuuucgcagggucaugguuaccaggaggaagcauuuuauauucagaucucggcuccaacucuggaagaguguccuugaagcaggcuucuuaaccucagcauaucaauuaccucauuuggaaaauagagauguaaaaugcauuagcagaaaacuguggaaagcacauuuugccuaacacauuggaagcucuuuuguuacccgucaauaaauucggguguuugggacuaagacaagagcaaguaugaaugccaaagcugguaagaacugcuuggcaggcugaugcacccaggucaccuggucugaaggagagggcaauacagggugguuaaguccuggaaggaccagccaccagcagccuugacacuauauuaacauguggagaccaguagauauuaauuaacaugcucuuacagcaccugugauugucuucugaaaaugguuaaggacuagacagauaguagggaguguauugaggauagguguguauugaguuagagccuugcuaugucacccaggcuggcuuccaauuccuggacucucugcauccucgugcuccaggcuuccaagugggaugacagaggaccagcuguggguguucaccucucucuugacagguucucacuggccuguaguuccucaauuaggccagccuggaaagucagcaaggccagggagccuccugucccuucuucuccagcacaagugccgugcauccuguagcacuucugugugagcuagcucuggggagagaauuuggauccucgagcuuuuagggcaagcauguuacuaacucagcuggcuucaguccagucauuaccucugacuuuuuuugagggaggguuuuucaaauuuccuaauuuugacauuagucauaauuuggauuuuuaaaaauuugggccauaguaguagcugauaguuauugaguacaugggaguuggauacaugcugucaauuuuuucucaaacaccagaauaucaaggaagcgguuccuggccaaguauaaugucaacuuucagcuagcacuucaguaacagaaaguucuagccugggcuauaaaaugaggcccugucuggggaggagggaugcucuauuuuauugguaaacuaguuaccguaggauggcguuuugucauacugagaugacagauacaaaaacaugagucaguuucauuagauucaccuuguuagagccucugggauagaauccugauucucucuuccuaacuugugacuugccuuccacaugcucuccauggcaccaugguguggucaguucucuguucuucacauaccuagcuguguugucagcuaugguggcccugaagacugauccuucuuucugaagcacuccagccuuuucuucucuggcuuggauccuucucuuccuucagcagcaguucagauaucauccuucccagaggccuuugcuagucauggcacacagccaugugcacaucauauaauccuacagcucucuugguccacaggacauguuugcgugucuguuguuucugugucagaccuguugccaguggaaagacacucagaaagugucaccuaaguagguauggggacugugacugcaccugcagcagcucccguguggccuuucuucccugugugggauggagcugugggugggaacaggagcugaaacagcaguugaggagacauggccugugguggcucacaaguucaggugccuucugagcugcuuucccuccacccccauguuuuuguggugauucuuuaaauuuuuuuguauuuauugauuuauuccugugggggccguuauguaccauggugcaugugguagucaaaggacaauuuuccugcauugguacuuugugugaguuccaagucuuucuguguagcucaggcuggccccagacuucuauugauuuuccugccuuagccucuagaggacugugaucccagagcaugccugguugcuuccuaccuccugguuagcagaaggccugguccaggagccccacaccugcuuuuauaagggcagugugcugaggguugguucuggguuucacacaugcucggcacuacucacuaagcaauccuuauguucaugugugcugagcgugugugcggaggucagaguacuaccugggaguugggucucuucuucugccauguggguccugggcaucaaaguaagauuguuaggcuuggugacaaguguccuuguucaaccaucucauuggcacuaaguugcccaagcugaccuugaacucauggcaguucucuugccuugccguccuaaaugccggggcuacagauuugaaucacgugcucagcuucuauaacuuccccuuuugucuuaagauuuauuuauuuacauuuaugugcaugugucucucugaguuauuuguaucaagugugugcaggugcccauggaggcaagaggaugucagauccccuggaacaggaccuugaugugggugcugggaacugaaccuagguccucugcaagagcaguaagcacggcugagccauuuguucagcagucuguguuuauacuugcugcucagauauagauguuacuauuacccagacccuuagagcaagccuaacagcucacauaggaucacaaggaaaacagggcauggagaguucugggauaccauuuggcugaggugugcugaacagaaggcuguggugugguugagcccagccacaggaucagggagagucucugcuccuuuuucucggcagccccaggggauguuuccuauugcccucugucugcucucuucuccccaaucccauccugaacucccuuucacaccagauugcucaugagugacagcagaccuccaggccugcuucucuuccagagguucugucuggaacauagccugagcccuuacacacagccuccuccugugcccacucaccuuccuucuccucaggguuuuuuggcuucccaucucucuguccuuucucucugcucucuggucccagccuccuugcucaguacucuaaaccugccuccuacagacucagacacugucugcccuucugggggcugcuggacucuagaauuggcuacuuucugaacucggcaguucugcagggcacugggccuaggcacugucugucagucuugauuccucccuuucuuccugcuaucaccgugggaucuucuaacuacuauucccugacuccagaaccuuucguggcuuguauucucacagggagguuagguguguagcucugugguaaagugccugcccucucaaagugagucugggcuugugagccagcaccccacaguccuguucugccccuuucuggccucaccugaccuuguugacugaccuugcuauucuggucucauguccugaccccuggcuuucccucaccaacguugaucuuggagcuguggggcacagguagucugcugacuucccuuucacccucccggaccugagagaucauucugcccauugcaucuguggguucuuuguucauaauaagggugcccuaggcuauccagcuuccuccugguaucauuucuuauguccaggggauuuagugacaccuucaugagccacaauccaugguuguaggucaugauuguaucuggugcuguggugaaacccaggcccuugcacgugccagguagugcuuacuggcaagcuauuccucccagccuuguaaaaagaaucuguuuauuggaugagaaaaaccugauacccauaguagccaggugacuugugaaagccccauagccaugugucccauuagaguuaaaccauugguugcuugcuguggagcucccuccaacaccauucuuccacauagccugcugagcgagcauccugcguagagcucuggccagacuagugugucuggaaugcagggccuagggacauucauuuguccccuugugccugugcuguuuucaaggcucuuuuuggaaggcuggugacugugccauugccuugauggacagagaacaugguaggggcagauuuguccucugcuggagcuccagagucccuggcugcuuuguugaccugcagugccuguuguuuuuguuguuguuguuguuuuguuuuguuuuguuuguuuuuuucugacuccugaagccuugucaaacaagaucacaugcuuucucccucagccccaguucccaugccugucuuugagccugggucagcugcucugaagagccaaguaacugucuuuacaugagguggcucuggaggcugagcuucacuuuggccuccucagcuuggcuucacuggagcagccagugucccucuagaaaguuggucuaugcaguggaucuaggugggcagccuaucauccagcauuagggagcagagagaaguauuucuguaaauugaggacuagccuggguuacaugguuccaggugaggcagaacuacagagucaaaccugacuaaacaaaacaguagagagacacagagagagagacagagagagagagagagcaugugggacagacagacaaagagcauacaugggcugacuguaucuuagguuaucuucuuggacacccugucauuguugugguugcugacuguguagagggguaagcugaggucagaaccaucuggucccuggcugggcugugccuggcagccucaccuggccugggucucugaccuagcucuuucuauugugcuucaguuuccuguccuggaaggauuguuuucagguaucaguaugacauugauaucacuggcugacugcagugacugucucuuagagaccugccuauugcuuauauccuuguacuuucuuuuaaagaacauuuuuauauuugugugauugugaacaugccacuacuguguguggucagaggacaacuucucuccuaccuugugaauccagggcuggagccugggucuucaggcugggcucuuccugcugaucauccaucuggcuaucuuuauauuguaugcauuuugggggagaggguuaagacagguuaagagguuaagacaaucugcuccuaaacuugccauucugcauccucagcugccuaaggcugaccacaccuggcuucuacacuggugugugccuagauugcaaaugaguccugacaaagcugauagguggcugcuuguucgaacgcuggccugaggccaaggguuucagggggggugacaucuagucacuguccuuaggcagggccacaacuugccacuggacaggguagugacuccauuggcccagggcaugaugguuuccacucccucuguaauuuaggccauuagccacugugucugaugugggcuuagaagcaucugugcuugguuugcuguuggagugcagggcucugaaccagagccuccuucauguaucuuaggcuaaugcuuucuucuccuuuccauccccagugaucccagcaagguuccgauggcacaacaguuggggccucaggccccugcgccugcucuaugagagagcuuucacucucugauuacagacagcguugccucuuacugacugaaagcagugacagacaccagaaacccugguggcacaucaggguucccacaccuagcacugcuugcccugugggcuguccugaggccuuuguaccugcaguauccugacuggaauagccaucuccuucucucucuucagcugcuuugccugccucagcugagcugucuccuccucagagaggccuuuucucacaaacagcuggcuggugugauggacucuuuucucuuugcuacaugucuguuuaugauuuauguauuauuucaaacucucugucucauuuaaaacaaaacaaaaacauauuuugagugaggcugucauggugcccaggcugaaacuccuuaaguagaggaugacgaccuugcaguaugaucucccuccccaucccucccagaguggggaugaugggugugaaccaccaagacugcucuaccaacugagcuauaguucuggccuuaagaaauuuauuggggggggggguagagagauggcucagcaaccgcucuuccagagaaccuggguuuaauucccagcacccacaugucagcuuacaacugucuguaacuccaucugacacccucacacagacauacauguaggcaaaacaccaaugcacauuaaauaaaaauaaguucaaaaaaaaagaaagaaauaggcgggcagugguggcacaugccuuuaaucccagcacuugggagguagaggcaggcagauuucuaaauucgaggccacccuggucuacagaacccugucucgaggaaaaaagaaagaaggaaauuuauuuuguggcaggcucucccaguguggcucaggcuguccucaaaguuuucaccuacgugcuucagccucaugaauagcugggggugagggggugggggguggugcacagcagccacuguuccuggcuugggaauuccuggguagagugacugaucccugacauauuaccucucccacccaugccuuaucauucauucugcaucccagggcguggcugcauguucacagcagagcugucagaggagucaugaaacccuggguggggcugggugcuguguacugccacgggacagccugcuggacaggaugugcggugucaagauaugcagucaagaggaggacgcaguagccauguaccugugagauggcguagugcguagaggucugaugauuucaauccaguucuggaagccacauauaggagagauccaacuccuacaaguuguccucugacuuccacaggcacugugcccaugcauguccucccaaguaaacaaaugaaugaaagaaguagccauuggcugugcacaccagaggcuaagaccagccuuaagcuccagggcagccacaggcuacuucucaccucugcuuuaccucuuuggcacagauguccauuggaggguggggaggcccucaucacagggaacuagccugaccuuccuccagccuccuagcccuuauuuuuuugguguugggaauggaagccaucaacucgcacaugcuaggcaaauagcugaggacgguuuucuuugcugggaaauguaaaauugaaaagcauaccccuuuuggauuaagagaagccaauuuucaggcagguaugugacuguaguauuuaucagcauuauuacccccauuggacuggaugagccucaggucauaccccccuucccccgcaucuguuggggucccagaugcagcugugcucugguggggucuggcaggcauuuaccucuuggguuuuguucucuggggaucucucagguugucccuuucacuccugcuagcuuuggaaacuuggaauaggagcugguaaguggggcuauggcucacacuggaccaugugacgaauagagcauagcuuguggcagguguguaggggucccugaguccuuaucuuugccccugcaacuccagcucgaacagugugaaaaaugcaaggagaaggaggguucaggacuggccuccgugagucagaacuuaagaagcacucuuccccucaguuggggcccagggcauagggaugggagagacacacugcccaggacaguggcucaguccugguuggggagcagucagccccagcacucaacacagaaaccauugugacauccaggggugacagugucuugauguuuuaugaaucucaucucaucaggcagaaaaagaaaggaagggugggaugcugccaugagugugacugcgggugcaugagcagauguguguguuuauacaggagugcacuaaccugccaugaucucuuuaugguuuucugagauugauauggggcguucaguagagacaaccugagaugguggaguugcucugccugcuccucuuguuaggcaggagagaggcuggguuguccuucuaggccuagucaguagugcuguguucuugucuguggaaacgguugaggagaggccaguugacuccuguuugugucaguugacuggacuauggcucaagauccuggagcucagcaccugcugucuaaggacccaggcagugggggcagugaccaaggccgaugaugacagugauuguccagacugggaaggaaggaugggcuggccagcaaggcucagggugggugugaagaguccugucaguuuguaagcaucuuguagaggaggcugggagccuaggucaccugguagcaauugaugcucuaugcuuuccacuaguuccacacauggagaaaggacaaguggccuccgguuggggucgguacacucagcuagggugucucuagauuauucauuucauggaacuguuugggaaucuaaacauuuuccuggcuccacuuucucauucacuuugaauggaccaaguauucaaacacaucagucugggggccaaaccuacucaaaccacuaucuucuacccucugccagcuccuccagccaccuguccuauggacagagaaacaugguucaagguuggaacuccagagaacauggaagaggcaagccagcuacuaccaagaaagcccugucagaauggccccaccacaccauguguaguuuucaaccuuuggucuuuuucuguggcucuggagauggaagcaggaccuugagcugugguguggggcuccgugucuccuucuuuacuugaccagugcuuggcagcugugcuaucuguggcccaagcuaaggcauccuuucugcugugcucugucugucucaggagucuauugguuuggucaguccucaguggcuuaccaucccugucuguccauuucugacuucaggaggaaacagcccugucacucuuccugcccugcacaucuggacagguuuuucuuguguacuucacguugcugcuguagcuggggguucagaugugugcuagcacuggaacccagggccucacacaggcucagaacucuucuucccauaagacucauccugcucaaaauggcagcucuucaggguuggacaagagccuggucuuguugguggaaaaguucucucuucucucaacaucugcaggucagucaacagccuggcuguucugguuccuggcagagcagaaaugcuugaccauggucuucuacacagaggccugaugugcuagagggagaggaagggccgaaugacagcauaaacucaccacagguagccacacucugccaucucugcaccagucuuuccaagccccucacccagccacaugcacaauuuuuguuucgcuuuucauuguagaguagggucucacuauguggucucccuauauggcccaggcugaccuggagcccuucaucucuugucucagcuuuagcucacugagauaaggcagguaccgccaucccagcucagaccuauuucuuuaauucuaaggucuuuuuuuuuuuaaagauuuauuuauuauuauaucuaaguauacuguagcagucuucagacgcaccagaagagggugucagaucucauuacagauggaugugagccaccaugugguugcuggaauuugaacucaggaccuucguaagagcaaucuguucucuuaacugcugagccaauucuccagcccccccccuuuuuuuuuuuuuugguuauugaaauggaauugcaaguggcucggggugaccucuaacuugcuauguagcuaagaaugaccuugaccuuggcuuuagaguugggguacaugagugugugcaugugcauacacagacacaaaaagaaacagugagauuguuguagucaugugcaccugugacaguggucucccccucccucucaugcuuuccucuguccuccaguuccccagcaaucagcagcugguuguugguauagcaagcagucaccuuuugggacuggccucuugugcucagucucugguugcuuuguguggccauagugucugugugguaguuuucuagauuauccuguuauccuauuguauuuguauguguugugcuuaagucuaugguacauuuucacuuuaauuuuugugugugccuggguguauguaaauacauguguguacuuacgcauguggagccugggagaguaguguugagugucuccuauugcucucaaccuugucuuuaaaauuuuuaaauuuuguguccuauaugugcuuguccacaagacugucacgguguuccuguagaggucagagguuggcuucuaccuuggaggauucagcggucaaacugagguugucaaggcuuugugacagguauccuuacuagcugagccauaccacuggcucagccuuaucuuuugagaaccucuaauugggcccagggcucauugauagcuagaguggcuacccucucagcucuggguccccacagcuccuuacuagaguuacugauguuuucaaccacaccaaaccuuucuuuguuuucuuuuaaaugugccugcuagggaucugagucaagucugcauacugcacugcaggcacuuaccagacagcaccuucucagucugggcugugcucccagcucccacuuccuuguccauuucccucugccuuccucccagcuuguuuuuuuuuuuuuaauuuuuuuagaaauuuuuauuuauuauuauaucuaaguacccuguaguugucuucagacacaccagaagaggacgucagaucucauuauggaugguugugagccaccaugugguugcugggauuugaacucaggaccuuuggaagaacagucggugcucuuuaccacugagccaucucuccagcccccucccagcuuguugagcuauaucuuggccuuuaaguauguucuuuuggaggggggguggugcugagcuaguaauuccccugccucagccucuaaggaauggauugcccucgaacugugucuaauauguuccaucagugucugcugaguugacucucugggagccaugacucugugacuauguaggcuaaugacagggugcuuuacacaccagcucuuacuguugaagaguggaggcccuggacagcugcagcauuguuuaguuugggguuuuuagcagcucccugcucagcaguugccccaggggcauuuaguuucgguuucucugcuggcuccugucauccagcaucuuugcaccccccccccccaacccugucuguguauuuacuggaaccguccuuguguguuuugccacucauuggacagugcuguguaggaggaugaguauucuguagacacccugaccccuuugucucccacuguucuucugugagcauuugaauuccggcagcuugaguuagucuuucacuguaguaucaggucuaaggacucauuuuuauuugucacuucagugcuguggauggaaccugguaccguguaugcucaggaaguauggcucaugggaaccuggguuauggcaugcucauuaagcacuggagaugaaccggccugaaugugcagccuagguucuguacaugagcagcaggcaccccagcuucucugucuucaucuaucccugaauccuaaagauuuuuccugaauguuuuuuauauguauguauguuuauauauguguguguguguguguguguguguauauauauauauauauauuuuuuuuuuuuuuuuuugguuuuucgagacaggguuucucuguauagcccuggcuguccugucacuuuguagaccaggcuggccucuaacucagaaauccgacugccucugccucccgagugcugagauuaaaggugugcgccaccacgcccagcauguuuuauauuuuugcauuuuauacugaaugaagucaugaucauuugaguuuuuaccuguaucauuuauauaucaccaguguguaaucugcaggcugagagccacuuaguucuguguugcuccagcacugugcagaaaacucuccuuccaguuaccgggcuaccuccccccuuccagcuuuugaaugaggcucuugguguggcuucuacuucuuuaaaaaauauuacacuuauuuauguuagggcacuauauuguguucguggaggucagaggacaacuugccaagagguaggggucaaacucaggccucagacuugggagcaagcacauuuagccacugggccaucucuccugcucugcuuuuauuagacuccauuggaacagggcuagaaguguagcuccgugguggagcccuugccuagcauguacggaacucaaggucccaccucuagcauugcaaacauaggcugucauucaggcaguguggugcugccugcccaccugcagucccagggcuacacagagaaacccugucucgaaaaaccaaaaauaaaaaauaaauaaauaaaacuuuuuuuaaacauuuuuuaaaaauuaagaagcuacuaaaggugcuugcugcuaagccuguugauuaccuacaugguggaugagaacugacucuuaaaaguugucuucugacacccggaugcacuguggcauacacaugcacaggcauguuauuuagugcugccuuucuguaucagucugagaaugauuccauaguuaacagaagucuggcuggaguucagggaaguggcuuaagccugcacaucugggacacacaaguuaguauuugcaguugcauuguuugaccuccagagcaggacucagaauuuguuuguaugccucugccagcucuguuccauggcuggucuugacuuugcugaguagacagcaaggcuggcaccucauucuguucuauaaugcaggcuacauauuucuuugcuaaaaaccccaaguggguuuuuugagcuccacgauacaauaguucuuuaugggcaugacucugcaggcaguaaguugcacaccugaccuucugggacuggcuugcaugaaauaugcuaggaaguuugcuaggguaugugugcaaggcuccugggaacagcugaguucuguguuuagauuugagccuaauccagaagauggugcugugugauaugaaaaguacccauaaccugaaagagccccagguaggaagcccuguuggcuggacacuuugcagccagauguucucccagcacagcugcaagugaggaacgguguccuccuguccuagcaguguagccugacuucuuuauggucuaucuuguuccucauuuuuaccuuuauuuauuuguugaaaugcugagaauaaaaccuaggacugugucugugcaaauugaugcccugcuaagccacaggucuguuucuuuguuaauuuuaaaauaauuuuauccccucaacagaggaauggauacagaaaaugugguacauuuacacaauggaguacuacucagcuauuaaaaagaaugaauuuaugaaauuccuaggcaaauggauggaccucgaggguaucauccugagugagguaacccaaucacaaaagaacucacacaauauguacucacugauaaguggauauuagcccagaaacuuaggauacccaagauauaagauacaauuugcuaaaugcaugaaacucaagaagaacgaagaccaaaguguggacacuuugccccuucuuagaauugggaacaaaacacccauggaaggauuuacagagacaaaguuuggagcugugucaaaaggauggaccaucuaaagccugccauauccaggguuccaucccauaaucagcuuccaaacgcugacaccauugcauauacuagcaagauuuugcugaaaggacccagauauaguugucucuugugagacuaugccggggccuagcaaauacagaaguggaugcucacagucagcuauuggauggaucacagggcccccaauggaggagcuagagaaaguacccaaggagcuaaagggaucugcaacccuauagguagaacaacauuaugaacuagccaguacccuggagcucuugacucuagcugcauaugcaucaaaagauggccuagucggccaucacuggaaagagaggcccauugaacuugcaaacuuuauaugccucaguacaggggaacaccagguccaaaaagugggaguggguggguaggggagugggugggaggguaugggggacuuuugggauaacauuggaaauguaaaugaggaaaauaccuaauaaaaaguaaaaaaauaauaauaauaauaauuuuauuguagccaggcaugguggugcaugccuuuaaucccagcacccgggaggcagaggcaggcagauuucugaguucgaagccagccuggucuacagagugaguuccaggucagccagggcuacacagggaaacccugucucgaaaaacaaauaaaauaaaauaauaauaauuuuacaggagguaaagcaugugccacauuguguguggcggucagagugggcauaauguguauggcagucagauggcacaguguguauauaaagccaucucuuuucuuccaucuuuauguagguucugggauugaagcuaggucaccaggugugauaguuugaaugcaaauggcccucauagaccauauauuugauagaauggcacuauuugaaagaauuguauggauuaaaagguguggccuucaacuaaauagcuuacugggaugguccgaggccccuggcacauguguagcagaaaauugccuugucuggccucagugggagaagaugugccugccuaguccuguagagacguaauugccugggggggggggugggaaagagggggagcucccuuuuagagguaaaggggaggggagaugggguaaagaacucaacucugagaggggagacuaggaggauguccugacccacgggauagucgaacagggguuugaggggcaccuggaagagaauggggacaagaaacacaaaaaaaaaaaacgacagcaagacaagguccuguucaagcugacaaauuuuuauuuuucccacacagguuauauaggagcaggaagagggguggagggagggggucaggaacaagauauugacuggguaaacaguucagcagaagaucagaacagaauggguuguuaggcaccuaugcacaagauguauagcuauuuguucucggcugacuucaggaucuaugucuauuuguacucagcugggcuaguacuuucccacagaggccaagacuuucuaaguaagcacuuauggcugacuaggcaguuaacauucaaagagggucgcucccaacagaaggacgcaacauuuggaacauaaauaaauaaaguaauuaauuaaaaauguaauagaaaagagguguggccuuguuagagaagguaugucacugggggugaguuuugagguuucaaaaguccaagccaagcccugagugucugucucucucugcuuacagaucauauacagcuacugccucugcuuguguacugccaugcuccuacuauguugauaauggacuaagccucugaaacuaaaaacccuuuugcuaugguccugguauuuuauuacagcaauagaacagugacuuaagacaccaaacuugcaagaugucuuagucauugggccaucuugccagcccaguuuuuuuguuguuuuuauuuuuucaagauagggugucacuauguagcccuggcuguccuggaacucaaccuuguagaccaggcuggccucaaaaacugccucucuagugcuagguuagugugcaccaccauugcccccaguuuuuaaaaaaaaccaaaaaacauuuuuugaaacagguucuuauauagcugagguuggccuuagacuuacuaucuaaccagcaaugaccuuuaccuuucuguccugccuaccucuccugagugcugggauuauuuaugugguuguagagguggagccaggcuuuguguaugccaggcaagcacucugcuagcugagcuacaucaucaacucuguuaauuuuuguguguuucugaggcagggucuuaccguguagcucagguugaaagagcccaccauagcugcaggucauugcaugaccaauuucucuguuacuuucugcuuguccccacugcaaagagcugggaugacagccguggcacucacaccucugcaggccauuuucuaggucaugucuggguguccaugcaggacuucagacugugccuucuuccuguaccaagggcaguuugugcucccuggggaaacagcaggcuauaccuguuuucuuuuuuuuuaagauauauuuauuuauuuuauguauauaaguacccuguuguuucagacacaccagaagagggcaucagaucccauuacagaugguugugagcuaccaugugguugcugggaauugaacucaggacuucuggaagagcagucagugcucuuaaccucugagccaucucuccagccccuauaccuguuuucaaguagcuuuguauguucagucucuggccacuggcugcuuugauuuuauaaacuauacuauuguggaaccccaagaauguauuuuucucaggucacaagcccauguaacugcccagcucugccacaccuggguucucuuugcagcaaguuaggauggaaugaaggccucccagccuggggcuccuguaagucccagcauucacugucugcaugggaaaagauccauuguccuaccaauaaacaggagguaucauauugucugcccuguaguguugcccuauaggaugacugaaugaggagcucaaggccaggcaugguggcauauguauacuaccaguaaucccagccuuagggagcagaggcagagcuugcugagaauuugagaucagcccaagcuaaguuucgagugcuagauacacaccaagaagucuuugucugaaaacacagucuucagaugaaagugcuggaugcaaaacacugagugagcagugaauagugaggaguguggccucucacaggagggugagaugguuuuagguauuccagggaccugagacugcccuuguccugauccuccucccuugaggaaaguguuggaaugacaggcaugugcuacuguguuucacuguggucuauuuauuagaauggauuauacauacuuuugucauuuacauuuuuucuuuuaugucuuuucaccccugccaccuguugagagcuauagagcuccuagaauccgccagugaggggcuggggacauagcuuagguagagcuggccuagcauguauaaggcccuaggaucaauccugaguacuauauaacacaaaauaagcgcuucucaaagauucaaaaauguaaacaaaacaacaaagccacugugcaugggugugguguggacaguguaacagagcugucaggacagauggcauuggguauccuuccuuccacuguguaugcugcucuggcugcuucaagagcugccucuucucucacagaaggggugcugggauuauagcugcccuuacauagcuuuggagauccuaacucaggcucucuugcuugccuccugagcaucuccucagccccagagguccaagaucuaucuauaacugaagcucaguuucagcugagcauguaggaaguagauuuggcaggacgguguggaggcuuguaaggagccugcucuuggccaggcgcugccaggguuggagcugcugggaugugaucccuagaccauccccuccaaggggguauugccauuuucuccagagcugugguguuuugaaguuucuucagcagcagugugcaaaacugcuccauguucucucccugccgucucaccuagcugaaggaaaagugaaggaaccucagggaccugcaugcuauuuguuauguuuuguuuuuuaacauuuauuuauuauauauaaguacacuguagcugucuucagacaccccagaagagggugucagaucucauuauggaugguugugagccaccauguaguugcugggauuugaacucaggaccucuggaagagcaaucagugcucuuaaccgcugagccaucucuucagccccguaugcuaugguuuaagaagaaagugugggggcuggugagauggcucagugguuaagagcgccgacugcucuuccaaagguccugaguucaaaucccagcaacuacaugguggcucacaaccauccauaaugagaucugaugcccucuucuggagugucugaagacagcuacaguguacuuacauauaauaaauaaauaaauuaaaaaaaaauaaaagaacaagaaagugugguguccugacugugucgugggcuguggccaucuucaugcccugaagccucuugcccucaaagccuuguccuuuggucccuagacuuguguggguagugucaaaugugggcaaacggagggcucugucuuuguaugggaguucaacuugggggccacagacuguaucaugagcuagcugcuauugcaguuuuuguucauaccuguuucacagauuggccaaggcuguagacugagguuuggauggugucacagugaacacuuagacagccugcagcugugacuucacuguccccaggaagaaaugguaugaaaggaagcaugguucaugucugauguuuacucuguuuccucaucuguguucacagcauucuacuccccugccccuaggcuccuucuuaggaugcagucagucccaggguuggaacagacuugagugggccuggcuguggcagccuuucugaauguugggccuuguuucucuugauugaggaucuggcaguucugcuugguuuagguuuugucuuuagacauggaccaucaguaucauaggcaggccaggcuaaggaaguguguauuuguuuuuaaaagacagucucgcuggacgugguggugcacgccuuuaaucccagcacuugggaggcagaggcaggcagauuucugaguucaaggccagccuggucuacagagugaguuccaggacagccagggcuacacagagaaacccugucucgaaaacccccgccccccccccccaaaaaaagacagucuuauuauauuuggcccuagauagccuggaaaucacuguguagaccagucuggccucagacucacagagauccuccucucucugccuccugaguucuaggacuugaagacaugcuccacagaccuuaaggaaguguugauaaaccucucauaaugacucagaaggucccuccaucccccacagcuguguggacugcacccuucuccuucauccccccacagcuguguggacggcaucugucuccaucuccccacagcuguguggauggcacccuucuuuaaguuacccuacucacucucuucacucagcccugguguguuuugugauggguucccaaggcugguauauuuauugaucaagaacagauuuucuccuguaagcucuggugguugggauggucaagcaggauacccacauuuaggcaggcagacagagugggcaggacacauccucccuugggaaaucacuuccagggugauagcagacugaagcuucagguuauggagcccuugguugaacuggaaggugcccuuucccccacugcucacugggguuggugcucccugcaucugugcuucagucuuccaaaagccccaacagagcaagcucuuucauauagcggcuugcuuguuuaccugcuuuauuuuuuuguuugagacaggguagcacuaaguacccccaguuguccugacuccucccuuggcuaccccucccccaggacuggagaccaccuuguugcuuaguagcuaaugcacugcacuuccccacugagguggcuuccucccccagaugacuccuaccuccuuauagggguguccucuguugaggccagugagggagggaaugggauaagugggagccugugaacugaagcuuggaaugagccagacacauucuggcugauugugggguguccuugggcuuccugcacauugggagugguugcuuucagcacaaggcuguguguccuggaagaccccugcagcgugagucuguguacugucugcuguuaggcagcuguuagggggccugaaaacagccaaaugcaugcuggugacccagggucacaugcugacacuugcccaacacauggggcuuggaaggaggcaaagaaagggggccuuucuucugccauugccuauccuaugugagcccucuguccuggggaugcggggugcacacauccuuacuagaaccggggcauauuuuggugauggcaaaacauuguguauugucaccuccaccuaaggcuaaggcaagagaucacuuggcuugaggcuggguguggcaguuccuuccuguauaucaguauuugagagccugaagcuagaggaucacuaggacuuuaaggccagccagggcuaucuugcagugccuugucccaacaaaaaugaaacaaaacagcaaaagaccauccuagauaguaccugaagagaaagggccaggaugggagggugcuucucuguuggcaggccauacauaugucugcuugugagcacuuugugacucuucuguuuuguuuagauucccgguggaaauccguuauacgagucuuauuacaagcagguaugucuaaguguuaucuucuuuuucuuuucuguguagguauauauguucaccuguacuauagcaugccuguagaggucaggggacaacucgugggggucagcuuucuccuuuaaccaugugggucccagggaucaaacucaagccgucaggcuugguggcaggcaccuuugccaacugaccauuucuccagcccaucacugccuuuauauauguuguguauguauguacuccuguguguauguauguguugguguugugggcaaaacccagagccucuuacaugcagaacagcucagccacugaguugcaccuagccacacaucuuuguugaaguugggcaugcauuuaaagcagcuuucugugaguacacauggagauguuauuucuaaguggaugcgucgacuuuugcugucccuuuguagguggacccugccuacacagggagaguuggggcaagcgaggcugcgcuguuucugaagaaaucggggcucucagacaucauccuggggaagguagggaagaugaagcauggcuuccugcauccuuggaaugaaagcagcuaugcaaaucuucucuggggcaggaccaggacacccaagccucuuagcuguaacuggugggugugaagacaggcccuggaugaagcuguuagauaugaccuuccuugccuguccucacacuugggaggauaaggcagaaggaucagccuggaguacauaguaugaccugucuuugcaaagauaaaccaaagccacgaugccagguauagggaauacuccuucaaucccagcacucuggaggcagagagugauagauuccuugaguuugagacuagccuggucagucucaggugguagucaccucaaggcauaggcagcagaccagaacagagggcuuuugguaucuugauagcuauagguucauguugcuguguagugaucuaaaucacuacacccuggggagcuaagugggcacaggguauucuuugagcccuaccaccaaauaacccuggccuggcagggcuguuggcuauuggucccagugcccaugacagagaagugguugauaagacuccuguucuguguguuguuggugagcaguacucacacucacaggcacuuuuguguuuccacagauaugggacuuggcagaccccgaagguaaaggguucuuggacaaacagguauauaugcacauguggagcaggggagggggugggaaccccugaggcuggacuaguuguguguuucuucuacugucugcuaucacacauagcugccaggcucaagugaggaguucucacuguggaaugcaggucuuuaaguacaccuaggccccugacucaguggcaugccuuugacugucuuguaccugucuuaguuucuuuaccuauugcugugguaaauugccuagacagaagcaacuuggggaaaggguaccuguagcucacaguuccagauacaaccuacugcaaguguguguguguguguguauguuggggcagucaaggcaguaggaaccugaagcagcugaccccauccagucaggagcagguaauaaaugcaucaaaccagugcucagcagcuuuuuccuguucccucaguccaggccuaucccaggggugauguggccauaugcagguuggcuuccucaucucaggcaacccaggaaaacuccucaaaagccagccuguuugaaacugccccucaauugagacuuuuauucuagguagcucccauugugccagguagacuaagcuaaacaucaucaggagagagagcagguucagcuguuacauaguucaggucccagcacucauauuugucagcucaagcaucugcaauuccagucucaaaagaaucgaugcccucuucugaccacucagaacauacauacacaccuuuaaacaaaaccaaaacuguaaaugauuaaaacauuuuaaagaauuaagauaauuaaaugaauuguaccugauacggugguacacaucuuuaaucccaacagucagucaguggaggcagaugaauggaucucugugagcaucaggccagccagggcuacacagugagacugucucaaaacaaacaaacauacacacacccgacacacgcacaacacaggaugaugacacagcaacacagaaaugugugugugugcaugcauguggcccauauaugaguauacuguagcuguacagaugguuguaugccuucaugugguuguuggguauugaauuuaggaccucugcucccucuggucaaccccauucacuccagucggcccuacuggcucaggcccaaagauuuauuuauuguuauaaauaaguacacuguagcugucuucagacucaucagaagagggcgucagagcucauuaagggugguugugagccaccaugugguugcuggaauuugaacucaggaccuucagaagagcagucagugcucuuacacacugagccaucuugccagcccuucaagacuuaauucuuaacuagagaguuccuguguuaaauuccuagcaaccaaaugguggcucauaaccaucuaugguggaaucugaugccuucuucugauaugcagguaugugugcagacagaacacccauacauuaaaaaaaaauagauuaaaaaacacagcaaaacuaacuaaaaagaaaaaguaggucagcaagacaauuccucuggugaagguguuugcugucaugcccaacaacaaccugaacccaaucccuagacccacaugguagaaagugagagcuaaauuccccaagcucuccgauuuuuacaugcacacuggaugcacaugacccuuccuuccuaauaaauacaugcgguuucaucucaaaaaaaagaaaaaguuguuuaaauccaauaccugggcugcaguacugcuuuggaggaaaguucuuguuuggaauuccuaggcuacauccuauuccuggccccacagaaacagaaaacaaaauaggauagguguguuugauccaucagucauuaugaguguacgacugcuccagcguuuccugaucuagaagcucauucauucucucugggaaagucccuuuucuugggccucuucagugcucagugcucaccaauggccaccggcugugcuucagucagcacagugggacugaggaccuaugggcugccugccuuaugguguugaagccucuuuuuggguuuacaggguuucuauguugcacugcgacugguggccugugcacagaguggccaugaagucaccuugagcagucugagccucaccaugccaccaccaaaauuugugaguacucaugguacugugugugugugcauacaugugaguggcgucuccaugucuucucuugucuuuacuguguuuuagucaaggugaaaugcacauaaaaguuuccauuuuaaaaugcacaguucaccuagguucacacacccuuaaugagugcacaguuaggugacaguguugugcaccaucauccugaguccccguucucaccuccuaaaaggaaggcccuggaccauaccuuaaucuuuguuucucuaucacccaguccuuggcagccacccauuaucuuucuguguagauuugucuuuuggggacauuucucuuaauggagucauacaggauaugaucgccuugcauguggcauuuucucucagccuguccacaucauagccuggaucaggcuuuuguuauugccaugaccaaggauacagcucauguguccaccuuuggcuguuuggagccuugcauuacuaaacgaucauggaucugugugcauaccuguggcucacaccugggagggaagcugugggaucauagggcauccccauuugguggccuucccacuuugggauaagauccuuuugaucacaugugccuuucuuccucagcaugauaccagcagcccacugauggccacacagucaucugcagagacccacugggcugugcggguaagugaacggggacaagccauucauacuauucagaauguucuggaauauguuuuauuuagccuuuuuaugucuccacaguauugaaggaucauaucuguguuuugauuuuauuaguuuuuuuucuuuuuccaauuuuuuuauuagguauuuucuucauuuacauuucaaaugcuaucccgaaaguccccuauaccuccccgcuccccuacccacccagauuuuauuaguuuuugguuugguuugguuugguuuuugguuuuucgagacaggguuucucuguauagcccuggcuguccuggagcucacucuguccuggaacccacgcccggcugauuuuauuaguuuuuaagaauuuauuuuauuuaaauuauuugucuaccuauggugggucuuugugcucuuggagaccagcaguggugggauucccugcagcugguuguugggaacugcacuugggugcucuuaaccucugagccaucucuccaucgcuuuaauuuuugauuauuuucuuacugagaaauggucucaugucacucggacugaugucaaacucagacuauagcugaagcugcucuugacugcugacccucugcuucuaccucuccagcacagagaaaauagcuaugccuaaacuugacuuggaaaauugcuucuccagucucuuuacugcaucucgcagcugagucuuggaacaaggagcuaaggguuugagguugcaguugaaucccugagcucucagcaagcauuugaggcuguguugcuuguauugguucuuccaaguagacaggagacacccagcucaggcagucuuccagccacucuucccucucugagguguccacugaucugcaaaaacccuuguucagcaccuaagguguucucuuccaugcauaaugugauguggucuugccucuaaggaaggaaaauuagcaaacaaacgugguggcugucuuagucacugaagaagcacggcgaccucagcaaaucuuuucuuuuuuuuuuuuuuuaagauuuauuuauuucauguauguggguauacuguuacugucuucagaaggugacauuagauacccauuaucgaugguugugcgaaaccaugugguugcugggaauugaacucaggaccucuggaagagcagucagugcucuuaacugcugggccaucucuccagucugaccuuagcuauucuuaaaaaugaaagcauuuaauuggggcuggcuuauacuuucagagauuuagcccauuauuaucauggugggaagcaugauggugugcaagcagacaugcuggagagcuaaagagaaagccacuggaccuggcuugggcuuuugaaacuacauagcccacccacaaugacacuuccuccaacaaggccccaccuaccccaacaggccuuaucuccuaauagucacuaccuaugaacguuugagggccguuuucauucaaaccaccauauuccauucucuggccccuaggcuuauagccauaucauaaugcaaaaugcacgcaguccaacuucaaaaguuuucauugucuaucacagucucaagcccuguuuaaaaguccaaagucucuucugagagucaugcaaucucuuuaacuguaaugcucuauaaaaccaaaaugagaacauagaucucauuuuaccagcauacaauggcacgggauguacauuaccuuuccaaaagggaagaaaaggaauauagugaggauauacuggacagaagcaagacugaaaaccaucagggcaaacuccaaacucugcauccaugucugauagcaaagugcuuuucagugcucuaaucuguccugcuuuggugccugcagcaaguuucuuucucgugagcugguucuacucucuguugaaacuauaucccaugucucuggcaucugcaacauuuugaggucucgaaggcaauccaaacuucacuuucagagcuucacacagugguuucugugggcuucauguagggaccccccuacuaccugccgggccucaguggcuuuccuuagucguggagggggauucuauaacccuuuucuuguaucuuuuccucuaaagccagaaccacauagccaaagcugccaaguucugcuucuuaaccugggcuggaacauggccuccucauucaguuacaucuuuagcagcuuucuguuuuugaugguuuccuucacugccuaagcuugguuguccugggauuuucucuguaguccgggcuggucuugaacucagagaugugccugccccugccucugagugcugggauuaugggcagcacuaccaugccuaacucuaaacuuuuuuaaaauuucuuuucagaaguuagaagcuuaacuggaugaggucuugcccuuuaggucuugguaggcacgagacuccgcuccaucacacuucuugcaacuucucuccucaggcucuaccuuuuguauuuuuccuugcucagcuugcucuuuuuuuacaauagaugauaucucugggaggccugcccuuucugaagggaaauggaggaggaguggaugcggaugggggaaggauuagaaugagaagggggaggggaaacugcauggacauguaauauauaagaguuuaaaaacaaaaaaacaaaaaacaaaaaaaaccaccaggacagagucaauaauacuaggcugcccuggcauuuccucugccaacccuguuaaucccaaacuuuuuaauuuagcuucaggcaaauuuuucagagaagggccacuuuuuuuuuuuuuuuuuuuuuuuuuuuggucacguuauuacucuuuuuccacaguucacaucacccucagcacugucuucuaugcuccuacuaggaugauccauuaaucccccacuuaagucauucuacuacuuuccuaauccagaguuccaaagcucacgugcagcaauaagcagcaggugaggacuucacagcaguaucccaguuccugauaccaacuucugucucagucgcuguuuuaucacaguggcacgagcuugucuccacaacacuugggaacuugaggauggaggacagaucacauauucaaggccagcaugggucauguagggaagaaccugucucaaaaacaaaaaaagaugggcuggcugccaaguguggugauccugaauucacauaacgaaggagagagcuguccucugauugccacacaaguaccauggugugggugcucccacuuaaauguguauaaguaaguuaaaacuagagauacaugacuauaaaaccugugacuccugagccagaguugaacuacaagugugggcuguggaugcuuucagaauggcaguagccccacccucauggcucauguucucccuuuuuucuugauccuguuaggcaccucuuggacagcuuugagcuucuuuguuuucuuucuuucuuuuuuuuuuucgagacagaguuucucuguauagcccuggcuguccuggaacucagcuggccucgaacucagaaauccgccugccucugccucccgagugcugggauuaaaggugugcgccaccacgccuuugagcuucuuaggcaagggcuuugccaccaagcuacauccuuagcccauuaguuuguuuuucugaguuagggucucauguauucaaacuugcugugcagccaagaaugaucuugaauuccuaguccuccugcuuccaccuugaauugagugcuggaaucacaggugaauuauaugugcugcggauggaguccagggcuuuuugugcaugcuucaugagcacuccacccaccaagccacagcacuagcacucuuuuccaaaccuuuuuuuuuuuggguggugagguuggcacucaaaccuuuacugcauugagccccaucacagcuuguguuugcaaaaugaaaagcaaaauguuggcacugagauuuacaucugagacaggaucuccccauauaacagaggcuggcuucaagcccucuaucuuccuaggucugucuuggugcuggaaugagaggcugugccauugguuccacuagaggcugacuuuggucauguucauuccagaggggaaacaucacccugcuggccucugcuccccaugacccccagacucaaagugccagggagcuuuuccucccaagccauaaauuaaauucucccuggaaacccagacaucuugcucucaccaaguaggcagaccuggcuauggauccacacuacuugcucuuacucagucuggcuucuuuccugguagguggaggagaaggcaaaguuugauggcaucuuugaaagccuucuaccagucaaugggcuacucucuggagacaaggucaagccgguccucaugaacucgaaacuaccucuggaugugcugggcaggguaagguacugggcuggguguuuucccauccugcacugcaguaugcuugacuguuaacaaucacuauucucccaccaucaugcacuguacaccggaugcucccuguaugucaagacugcucuucugccccgggaagaugcuggcacccuuccauuuuauaaugggagguacaggcagagggagaagguuacauggaccuguaaccagagagccugcgcugagccuagcaggaauccuucuuuucuuuugucuauuuguuucuuucuacuuguuuguuuguuuguuuguuuguuuguuuguuuguuuuuaaaaagugucuucacaggaguguguauauaugugagguucagaggacaaucuuggaagcauuccuaaacugcuaucuacuuuuuuguagauugggucuuucagugggccuagaauuaacuaaguugcugagcugggcugacuggccagagaauccaggcaugauccugucucugccuucccagcacuggguuuacaagugcaugccaccacauccagcuuuaaaaaauaauuacauugaaauuucuuuuuuucuuucuucaguuucacaauggagcccuggcuggcuuggaacucuuuguguagauaguauuggucuugaauucauaaaaaucugcuaacuauacuuccucaguacugggauuaaaggagugugccaccaugcugccuacauuuaaaaacuuaguguguagaugugcacaguauguguacaccacuguguaucuaugaaggucauuggacagcuugcaugaucugguugucucuaugaggggaucaaacucaccuuuucaggcuucccagcaggcaucuuuaccugcugagccauuccauuggccuugcuuucucuuuuuaaggaaaugcuuuuuccugccugucagucuggagguuaaggcacuuucaacucacagguuuagaaauagucuuagauauuucauuuuggguuuuaucauuuugagaugggaucucuugccuuccauauuggcuggguguaaccuuaaacuccugaucuaccuccauaguacauuucuuuauuuauguuaaagccucaguuuuagugggugugcagugcacaccauaaucccaaaaggcugaggcaggaggagcaugaguuugaggccagccugguuggcuggauccuguauugggaaucccuuaucaaaaaugaacuucaaauuuguucuuaugaaugugaaguguuuggcuucaggucccuacugcgggcucuguucuucuagagggucauggcugcacccaaggcaucauccuggcaguuugcuuuaugguauaugugggucaggcaagcuugucaucuguggggcguugcuacagagggacugaggucuuucagaggcuccuaaacucuaguagagccuaaaagcaacaaacacugguccucaguggcucugagacugucucuuaaugcccacuagaugugccuuugucuuccaaguucuagaacuaugggcagaaccuguucaguuacauuucaaaagacuuuaaagucugugauauuggggcugggucuuagggcuuaugaccugcagaggacccagguuugagucaaauuucaguugaaaggguugccuaggaauugagcaugcuguaggaagggugcagaucucgaccuugaucuucagcacuccaucagagcaugguuuucagagagauguaggguuaggcugcuguuuugguuucuuguuuugauaguuuuagguagggucuuaguuacuguucuguugcugugaagagacuucaugaacaaagcagcucuuauaauaaagcauuuaauuggagacuuguguacaguuucggagguuuaguccauugucaucaugguggaaagcauggcagcaggcaaucagauaaagugcugaagcaguagcugagagauauauccugauccauaggcagagaggcagggaaagaccuggcaugagcuuuugaaaccucaaagccuaaguuugcaaauacuaacggcauucccacccagcccaccacagauaggaucuugcuauauagccaagacagccaagaacucucuguagcccaggcuggccuugagcuuccaauccucuugccucaaccucacagacuaguuuuuaaaugcuucuucuuuucuucucuuuucuuuucuuuucuuuucuuuucuuuucuucucuuuucuucucuuuucuucucuuuucuucucuuuucuucucuuuucuucccuuuucuuugugugugauguguguguaugugugugugcuuuguguauguucacuuguguggguauguuagaagacagguauagagcucccuaauggccagugauugccuuggucucaugcuugugcugggugagccuuaaagcucuuccuucucacaucacucuccuggaucugucuguccccuuuaggucugggaccucagugacauagacaaggauggacauuuggaccgagaugaguuugcugugguaaguccucugugucuuguccccaccuugcugagaccuaaggaagugcccacauugguuggugcugcagucuuguguuaaaguguuuauuuuuacaucuucccaguacuuaaaaagguucaggaguacucgagaguucagacucuuuuauccagugugauuaccuuacaaugccuguuucgcccuccuuucucucugucuuugugggcuagccuggagcuugcucuauagaccaggcuggccucgaauucagagaucuaccugccucugccuccugggugcugggauuaaaggcaugugccaccacugccccgccuauuuuuguuuuuuugagacagucucagguaauugaagcugauauuuuuguuuguuuguucuauucuguuuuuugguuuuuuuuuuuuuuuuuuuuuuuuuuuuuuuuuuuuuuuuuuuuuuuuuuuuugagacaggguuucucuuuggagaccaggcuggccucaaacucagagcucugucugccugucucuugaguccugggauuaaacaauuaaagccuuuagccaucacugccuccuugaagcuggucuuggacucuugauucuccuuucucuaucucucaaguucuagcauuguaaauguguacagcaccugacuuuccaguuacauuuuaaaauagacuuuaaaaucugugagauuggggcuggagaaaugucuucgguacugcagaccugguguugcaggccucuugcaaacccagcugagguauaaauaagacauggagacguuuaugugguuuacagcuuugggccuuuugcuggggcagucucuagccacuuaaucuaaccuuguaucgcugagacccacccuguagacccaccucuuuuaccucccugccccacuccaguccaugucuguucccuuccuguccuuuucaguuuuccugcugccgccgccaguaucucuccugcuaucuauccugcggcucccucuccaccuacaacuccugcccuagcuauugucugucagcucauuauugcaaccaaucagcaaugagacaacauuuccaaauuucuuagaucagucgccuuuaggcaauggggagcuuuccugaccuucauguuuugggcagaugggaagggacuaacauacaaauuagaagcagaugaugggccaaguuuuuaugauaaugccaaaauccugccagcauuuagcucucacaguaaucaacaguugaaaauacagagacacaucuuacuacagugugaauacccaaguugauucccagcuuccauuugugacuugguggcucacaguggucuguaacuccagcuccaggggauuugaugcacucuuuuggccuucauggacacuguacacauaaaauguccagacacagauaggcaaaauacucauagauaugaaaauuacccuucaaaagcugugauuuuugccagugugccuaucaucccaggacucagaaggcuaaggcaggaggauugggauucagguccagccucaacuuuauaccaugacuuugccucagaauaaauaaauacauagacaugacuuagaccaucucucuccucuugcagugcaguagcucccugcugucucacacuguccccucuaggggcauacugugucuccucuuggugucagugcaccuccagacuucagaacuuuggaaaucauaagcuuugaggcugguggucaaccugccugcugaggggagguauaggugccuagagacucaagcaaaucuguuacauaugugagcuucacuuuucccugugugucuuuaguuguuacagcuuugauugguaauaaaguaguaaugauuguagugagguaauuaaaacaaagacugggcuguuuacugaguagagugcuugccaagcaugccaaaauccuguggacacagcaggaaggucaggaguccaagggcaucuucagcuacuuggugagugugaggcuauccugggaaacuugagauaccugucucacacuagucauggcagugcacucuaguagaagugcuaggaauguguauuuuuguuuccggaauuuucuacauaacuuuugcagaccacagguaacucugaucuuaggauggaacagacaguggcugugugcugugucuggauggcugucuucuguguucacucagcugcccaaauuggacaugucuugaagaugcagaggaggcugaugagagagaaaagaugagcagcuuccuuagagccucuaggaauccccauggcucccagacugcaugaggcgcucuuuguguucugggccaacccccccagugccuuuuucuucucauugacaccacaggcuaugcacuugguguaccgcgcccuggagaaggaaccagugcccuccauccugcccccgccccucaucccacccucuaagaggaagaagacuguguuugcaggagcugugccuguccugccugcuagucccccacccaaagacagccuccgcuccacaccaucccacggcagcguaagcagccucaacagcacaggcagccuguccccgaagcacagcgucaagcaggucagugcccaaggccucuuguauaucauuucucaucagcaauaaagagaaagcuuugaucaaauuuuuuuaaaaccuuacuagagguguggggcuggagagauggcuuagugauuaaagaguacugaaugcucuuccagaggaccagguucaauucccagcacucacauggcagcucgcagcagucuguacuugagcauguggugcauagaugaaugcaggcaaaacaccaauacgcauuaaauaaauaaacaaacaagaaagaaccuuaaaaaaugaguaugguucagaaugagcuugcuuucagguaaguggaauuguucccugguguacgugggccuggacagugcucucuagugcucaaguccucauugaagugauccagugucuucacagaaccugugcuugcuuguggacucaccuuacugacaacagacucuuucaucuguuuaucuguuuauaugcaugcauuuguguaaguaugugcacacaucuuuauuuggaguccacugaggauaucagauguccuccuccaucacugucucuccauuccuuugaggcaaggucucuugaucucuggggcucuucuuucuuuccuagcugggcugguagccugcauaccugaguggucucccugacucugucucuugguacaggaguuguaggcacuugcaggauguccugcuuguuuguuacgugguucuagaaucagcacuccuguccucauguuuaugcaucaagcagucuuaaacacugaagaagcucccagcccuagccccuguuuucuaacugcuuucagugcccuaagacugaaugaaaggaugagguuuuucuacuguaagguguugcauugccugcuguuuugcuuuguuuacauugacugcuugagcacacauggguggguacaugccacagcaguuauguguggccugaguucaguacagcaccuucuaaccacaggccugcccucucacucaucacacaucagugugccuggcuccggcacugggacaagagcuuauuuuguugguacaguaccuaggacuuucuaugaagaacauuuggacgcuggaaaggcuguccuggcagaggacauuauuucccugucccaugagcauuugugacaaagaaauaauguacugcacagagcuguaacauugagucgggcauucuuagucauguuaagauggggaaagugcuugggaggauaugcucagggucuguguacacguaagaaagugcugagagcuuugguguccaugaaggcucaguagcuagcauguacugacaugccucuugagcccaaagagacugcauagggaauggcugugcagcauagagaagucaguagcagauaaauguaucccaugcucauuaagacugggucuugcuagcuacuugcuacugguggcgcacgccuuuaaucccagcacuugggaggcagaggcaggcagauuucugaguucaaggccagucuggaguuccaggacagccaggacuacacagaaaaacucuuugucucgaaaacaccaaaaagacugggucuuguuauaguuccaggcuggucaugaacuccuaauauuccugucucagacucaccagagcugagggauaaucauauagugaaaauaaacaacaaaaaauggaaacuggucagcagcugcaguuucuuccuggauguuucuauccugagacuaucuccauaugcuauuguucuggguuuacaggaagcagaaaugguagcagcagagaucccccacugacccgaacuucacuguauguguguauguuuaucugaccuuuuuuuauucucucugcuccuagccaggguccuggacugggcuguaugguccugacacugucagugagaaguauaagcagagcugagacugggacagggcucacaaauaagucacucuguuguaaccuguuucagccaccaguggccuggguugugccuguggcagauaagaugcgcuuugaugagaucuuuuugaagacagaccuggaccuugauggcuaugugaguggccaggaaguuaaggagaucuucaugcacucaggccucacucagaaccuucuggcacacaucugguaaugauggaaacauugguggaggugcucugagaggcugggaaagaggguggggagggcucccguuuuccaggugacaguauacagggagguagggucagcccuuaucugauacuggagagcuguguugaaaauagucuucuccacaagccuuaccuugucacagccaccuguaacgguuacucugccugccacuugaguaaccucaacaaggaccuugacaguuccagugaggucccacuuggacaugggcauuccaaguacauugcacugaagucgagugggucaccagagugugauuuuguggggggcaacugcauugccaguaaaugucagccagaugugcuggugaccccacagcugguccucuuccacauucuguggacccugguaccucuugagacccaaggccacaugagauuaaaucagaaugacauaaagggguugggagguguaggugaggguccaacuccuacucuccuauggaggauaguuuuaguuaggcuuucuauuucugugauagaacaccaugacccaaaacaauguggaaacggcuuguuucuguuuacauuuccagaucacagugucaggcaggaaccuggaggcaagagcagaagcagaggucauggaggagugcugcuuacuggcuuguuccccaugguuugcuuagucuccuuauacaacucaggaccaccuacccaggguuggcaccacccacaaugaaauuuccaaccccaccaaucauuaaugaggaaaaugcccccacagagcugccuacaagucaaucugaugaaggcauugucucaagagucccucuuccuagauaucucuagguuguauaaaguuuacaaagccagcuagcacagggacagucaucagcuauuagguugauuuucgggguucucuugcaaguuguuacagcuguucuaguguagaugguggccacugaauaacaaacacuuggugcuggaugagggaucugccuucauccuaccccuguuaagugcuggacagagcugacaucucagagcgaggauucuucugaacguaacuggugugguccaguaaguuagcuuguuccaaaccagagccuugaguagcuuccuggcugcuuucugacuggaucagggaacugaguuggucaccugaaagaaccaucuugaguaacccuagccagguagggaggagagccagcaccaagggucaggggacacucaguugccucuuuagccagccugccugcuucuuuagagcuuacuguugcacucaaguggagaagccucagcagccuaagccugcuuugcguuuaugcucugcagguagcugcuguagagugggcccaugaaggccuugugcccaccucuggcaagugacuguacuuuuaaccagcagucaaaagugcuugcccucaccaggccaugcagugccaucucaucuaggauacuucuguucucccugguuccacacaagacacaggcccaaggcaagcuccugcugucgaagacucuguggucagggagggugucuugagaccuccagagugcagcucucacuggagaccaugcacagccucaacaggaaugagaauguagcccugccccaucugcccaaggacucauggucugugcuggccacuugcaucucuggaguaccuugaacaaaaugaaccaagaaagccuugacccucacagucaacuaaagggguguguguuguggggagguguucuuccugaaagcagguucuguaggccagagcauugcucccaugcacucgugaccauccuuaaggaagugcucaucagcauugaugggaacauggaggcagugcccggggcuugcugugguccuggugggcuugauaaucggggagggcucagaauagguggcaagugcaacugugauguguaauugcaucccacaucucucccagggcccuggcugauacaagacaaacgggcaaguuaagcaaagagcaguucgcacuagcuauguauuucauucagcagaaggucaguaaaggcaucgacccuccucaaguccucucgccugacauggugccacccucugagagaggcacucccauuccagugaguagccaggcauccuuguuucuguucuucccaccacccaccagaagguggugcucaugccccaagacacccccccacccccaccccaccgcccucccuuccccccaguccucagucuccaggccacguuugggggugggacuaaggggauggggauccuuugauugggccaccuggaguguucucaagucaguggccagugcuuuggucccacugacauguaagcuacuuggcucccugugacauuucaaguuuuaauucuaggacaguucaaguacucuggcaucaggagaguucacugguguuaaagagcuggaugacauuagccaggagaucgcacaguugcagagguauguggcugccuacuuuuuggugagucccgaugcagcagucuuauguccguuuacccauaagccuuugaaggaggggaggacacaagucuucucagaucuauuucugcuugaaucauugaugcucugagucuauauuauucagguagccucagucaggcuguggcuacauaguugccuagggauacaaacagccgagaugagagucuagcacacagcuuaggugacagacuuaagucuggcacaccugcuguacacaguggagcaguuccucauugcccuuuuaccagaagccagcgacugucauaucacuccaugcacucccccuggcuccccuagcccagcuuugcuuucuauucuuguccuucaggaaauucuucacaacauaucuuugauucccacaguaccuccucauagcccacugucccugcaguacuggaugguguucaucugcaauucuuuguccccugugccccucuuuguugaguggcccaucagugucagacuacugagugccuuugauuggaugugggauauaggaagugguuucucuuagugugacagucacagaacuaaguaguuuggugacaugaguauaguagcucauagggagggugugcaggugccugugccagcuguccgcugguguuggagcccaaggagaagguauaugccuggacuucucgcuagguccuugcugcucuggauucaagcucuccauuuccuugcugacuugucagcugggagccccuugcuaaugcuggggaccacuccuacuccacccugucugccuccugaacuuccagaguuuuucauccauuguuuuuaaaccugcagagagaaauacucauuggaacaagacaucagagaaaaggaagaggcaaucagacagaaaaccagcgaaguacagguguggaugcugugccucagcucaggccugcugaauguaggaaaaagucagaauugugugcugaauauaugacaaugcuuugggauuucgauguguuuuuguuuccuuggugacauuggggauggaaccugggauuucacucauagcugguaggcagcgaguauaaaacuccaagccuagucugugcccaggugccagaaguagacccuagggccuuauacucauccuugacaggcacagggacggaggcccuccccacauagugucuaaggcugaaccacaguccagcccagggucugcuuuaaccucuuaucugggaacuguuguuaccagugccagucaauaccacccauuuccauaggaauuacaaaaugaccuagaccgggaaacuaguagucugcaggagcuugaggcucagaaacaggaugcccaggaccgccuggaugagauggaccagcagaaggcuaagcugcgggacaugcugagugacgugcggcagaaaugccaggaugagacccagacagugaguucacgguguggccaguguccccgagcuucccugacagcucuugccagcagaugacagaaugccagcugagaaauaucuaggcaccugaggccugaucugugaacaauccuucuguuccuagggaucagguugcaaaacugcauggcuucaguaacuaugccguggauguccuacaacagggaacagggcugcagaugccucugccuccugcugugaccccuuuuaucacauauuaucugcuuucucuaacugcagguccuguacacugaucucuggcuaugcagacuccuuaugcuuuauacuuauucauucgugugugugugugugugugugugugugugugugugugugugagagagagagagagagagagagagagagagagagagagagagagagagagagagagagagagaauuuguggauauauuugugugugaucagaggacagcagggagauuuuggucuggcacauuauccaccagcuauaucucuagcuccacacacagugagaaagaaagcuuggugucuuucugucuuucuguguccugacuuguaaguccuuuuggcucucacuucagaucucaucauugaaaacccagauucagucucaggagucagacuugaagucccaggaggaugaccugaacagggccaagucagagcugaaucggcugcagcaagaggagacacagcuggagcagagcauccaggcuggacgugcacagcuggagaccauccucaggucccugaagugcacacaggaugacaucaaccagguacuuuuacagggaugggucagugguacugugagguuagcugcugaggacuuuguagggugugacucgaagugccugccucccugucccaugagcgcuggcccuuuccagaaagccaggaggaagcucugagccugcccuguccuugugcauauguuggucacugguuuuuguguggucucugggauguaggcuacagacagugugaugcccuuagcauacagcaaagaaaccuguguccuauagacugaaacuaucugcuugucuucaggcuacaggcugacagggcaauguggaugccucuuugaucucaguggucaugucuuacauuguguuuuauaaacguuauuuccaagggguuauuuucaggguucuuccucccagccuucagagacuguucuuggagauggccuaacauacauugcuaauagaaggaaugguugguggugguuaacagaggaucucaacuggguggccucuacaggucuggaacucacuguagaccaggcuguccuugaacucacagagauccaccugccucugccuccugagugcugggauuaaaggcacauaugaccaugaccagcacauuauuuuuguuguugguuugguucgguuucagguuuuuuggauuuuggguuuuuguuuuuuuuuguuguuguuuuguuuugaacugugcuugagauagcucacaucagccuugaacuugugaucagucuuccugccucagccuuccuaggccgccuucuuccuuccuaucuuuugucaguccugcagguacuguauauacagaauuucuuuaugacaugagauccuuucacaggaccagugccucuugucuagugauacagcuugggcagggcaguccuucccuauguguaugaucccucagggaaggcaucuugcuggcugcaccuggagcuccuuugauguucaugguguuugucuugcaggcaagaagcaagcugucccagcuacaggagagccaccuagaagcucaccggagccuggaacaguaugaccaggugccugauggggucucugguaccagccugccugaccuggccaccuugaacgaaggcaucuugcuggcagagaggggcggcuuuggagcuaugguaaaggucgaguaagagucuccggguccacgagggcucugcugcaacuguagaucugcucacaacacuggcucccucaaugugucccuuuguuuuugcuaguugucugccugcccaggucccagggcugguggccgaguuccucugucaucuagaagcugugaggcccagguguuucaucuccucagaaguguuucuuuugggccagucacccaaauguggagggcaaaccuaaccaaagccaguuuggucccaugcugugggagcucggugcucuacugauacagccuugggugcaaguaugugucguucaagucaagugauucugaaagauggagaaacaggcuccagcugcagcuugguaguaagcacugcaggcucccaguuccaucacuaagcaccacagcacaucugcucuccagguucugugcagccagcuguuggcuggccucugggaggaagaaccucagcacuguguggccacacugcucgugagccauugaugcuccaugcgacccuucucuaagguugucagugcccuuguuggagucaucagccccaacucagggagggaugucucuguggccauaauccgggguauuauguaugcuacuuuaaccucucggccgccucaucuuccagggcucucguugcuccagcccugcugcuuuuccucuuuguaccuucccucuuguggucgccacucgccuugcacucuaaacacagcuaccuucccucucucuucucuucucuuucucauccaagaacucacagagaagccuguucuuuccuuggaccacuuagaaggugcuguuuauauuucugccugucccucaugucugcccaccuggaguuccccuucacucuuagacuuauaaguagguggcuuccugcccacagugggcaucuguuccauggaauucccauggaauuccuugcuuuuuggccuguagccaguguguguuucugucuucuuacuguagucuuugcuuuggcuccaucucaccauuguccccugugcagcuggcuuguccuauguccugggccagggaaaugcucccucuaagucuccccuuguggauuguuugguguuuucuuucuuucucucucuuucucucuuucucucucucucucucucuauauauauauauauauaugucugucugucugucugucuguauucuuucuuugcuucuccucuuuuucuuucugcaacagugucacugugcaacccaggcugugauggaacuccagagaucccuguugcagggauuaaaggugucuaucagguuccccuguagcuuuuaucacauccugggcugcaucuuagcaguuggugacaguuuacaggugguggucauuucugucacuaccagaacauuuuguacaugguuauuuuuguccaucguuuaaccaguuggaguuugagugguaaacugucauuuguacaguguaaccauaagauauauuaccuagaaacuuaagacuuguguccaaaggaacccacaucuuguauuuuuaaaaaaaugggggggggcaguuguuuccauuucuuaauaaacaguuugaagcgaggucuuuguucaguguuccaucuggggcuguggagcaaagaaugcuccguccguucucuucauggugugcagcuaggaacugugcuuaccagaauugugcagccaaaguggcaccucuggaacuuacuacaggugacucuugagccacugagcuaaauguuaaguucccaagguacaacugcccaaguucccaagguacaacugcccaagaggcaauaggauucuuauaggccauguucacuuccguguauauccuuaauuacuuuuuucuuuuacagugcuguagggggaaccugaggccucacacauguuagcuaggacucaccacugaccuuugcucccagcccaaaaucauguuuauuucuugugacugauagaagccucuuccuacccaggaagccuacacagcagagagaaagccgugcaccaucccagcuuaucacucugacuuaccaggacagauuagauacuugaccacuucuaguuccaguagcauggaagagccaagguuaugggcucccagcaagcauuuguaaaugagagccucuuagcuggcagcuugagcuaggacaaaaauuuacuucaggacaauuggugggagcaccagcauugggccucuacacaacacaguucauuuugauuauguuuuugagacaaggucucaugguguagccauagcuguccuggaacucguaaaugaagacuagacugcccuugggcuuacagagaucuaucuggcucugucuccaagugcagagaugaaaaggcaugcaucccaugaccaacucccagcacucuguaaaagccaggaaugucacagaaacuucuugaguauccuuuguggccaugucuauauucugaaaacaggcagagcuuaggacuagcuguuuugccuuugaaaauguuuucuguagcuggguguggcacagcagugggaggcccuggguccuguccuucaugcaauacaaguuaauaauuaaauaaaaguaguugcugggcggugguggcgcgugccuuuaaucccagcacuugggaggcagaggcggguggauuucuaaguucgaggccagccuggucuacaaagugaguuccaggacagccagggcuacacagagaaacacugucugggggggaaaaaaaguaguuaacauguucuaccucuaugaugguacucauugcucgcccuaguguaauaucuccccuuauaccaugcucagucaccgagcaaccacgugauucagugcacuaaaaagaugccaucuacuaguaacauuguagguuauaaguucaucaacuugucugcauggugacagaaugggucuucugugcugaagaaccauaggccuauacuuaacccuuauauuucuguccccuagggugauauguucuucauuuuccuggcugguggcugacuguauucauguuuggagggcagggggcucuuuucagcuucaagucuggcacaggcuguccccuuuuuuccuuacuucuaaugugaguccugccagggccuuggcugcagugcugagcugcgugcaugcuuagucagucuuugccacucagcuacacccagcuauuuuauggccccuuaggggaaggagccacagcugcaugaaauguagauuucuccugacguuaugguguaggcccuaacauuccacguacuggacugguaguauaguucccagacacauuugugcuauugaaaucuauuuacucacugucuuccccucagugauagaaacaccagauugucaguaaacuggcccuguccaucaacagcccuuuagugcucacugugagcuuccuuucuaagacugagcuguuguggcuaacuccauccuucuucccgcuaucuuuagaacacaguccauuccuugcccagggcuaguacaagaagguugucuuuugccuggcccaggguuuccuuaggucauaaccuucuuccagugucucucuguucuugaaccccgacagcugugugugcuuccuuuguccacaguauggcagaagggguuauuuccugccccagugcaugggcuuccuuuggucagauucucccauugagguucucccuguccuugaacuccagcagcugcacuaggguguguccaucucgggccuggccguacccaagcgucgucagcagcugcugugcuagcugcaucuguguuuaaccucccugagcaccaggccuggcuucccuaggaaggccugugcccagaagcucugaagaauugguuccagguaagaagauggcccacccacuucuucauuuacucacagcccaagucagugacuacugcuuauuauuauuuuuuuaaucuuuauuuuuuucauuuccugagaaugacucuugcuguguggcuaugcuggccaggaccuauugauccuccugccuugggcuucccagaaccagaguagcaagugugcuuccuguucccaucugguggcuuccucuuaacacuucuuccccugcccccagguuucauagaauuuuggacuuauuuuuggguuuaauagccuuuuagaguauucaugucauuuuucugaaccuuugucuacuuucacagaugccccagcuuugacaugacuugaucauugagcuccugccuuuaaaaacaaacacacacacaguuaaauagcccaguuuuguggaggauugugucucuuaagcagaacagaucccugauuucucagcccaucauucuguuugcaggguucacccaccccucaggucauucccacuauggaaaagcacucuucaaaaauguuguggauuuuuuuuuccuacugcuuugaguacacuugccagcuucuagaacugaguaccuuuaugcaaacaugcagagugucuugcaugcuuuagcagcucccacuacaccagugucaccuuaagccccacuuccuacuugggcagaaacggcccacuugguuuuuuacauagaaccgugggguggggguugcucccagcccuuggcuaggcucuggccccaucauucugccucugugaacguggcgaccuaagggugugcgcgggaccacaccacgucuaucgcugucacugaccucuuauuucacuuagcugcaaauccuuaaagcuucuccauuuacaguagaguguccuuccuuuucagggcugaguauuauuucacuucacggguggguagguuccaucuaucuacuuauucauuccgcucagagacuugauuagagucacuuuagauuuccugaaaaauugcaaagcugugaugcuugucuccaugugccaugccuggucuccacuuuuaccuuagcaaauagaccaauguccaggcuuguuuguagccaaaaucuccaccugggugacuccccuucagauacuguucugggucacauugcaaacagugcagaucugaguuaggugugaaauccugcacuuugcuuaaaucagaaauaacucagcaccuguccuuuccucaccauccuaggaugauccuuucaaaaacaaagccuuauuguuuagcaacaacucccaggaacuucauccagaccccuuccaggcugaggaccccuucaaguccgacccauuuaaaggagcugaccccuucaaagguacaccccagccaauguccccauaaaaaagacuguuguuucuuuuuaagauuuuuuuaugcauaugaguguuuugucugcaugcauauucaucaucuguguacaguucccccagaggacaaaagagggugucagauccuccagaacuggaguuaauguggacaauuuguuaacuaccauguggcugcugggaauugaaccuaaguccuaagcagaaugcacuuaacugcugagccaccucuccauccccuuaacuuucagagguuguuuuguuuugagacagaguagcccugccuguccuagaacuuacucuguagaucacucuggucuugaacucagagauucuccugcuucugccuccugaguacaugccugggaagcuuuuagauguugauaguagcaucuuagguguaagggacagauccagcacuuuggcaucauuguaggucaucaugacaugaccaggagagcuacugugucuguccucuucugaguaagguaggaggagguaaggggauccagaguggggaaagaaaagugaguucucuaaggcuaguucuaucugcugccagccaagcaucccagcucaccuugacugccugccugggcugcugcuuuucaccaugaccaugcuauagcagcaucaagugcaagaagacagacuaguuguuuccccugagccagacaaaaggccugccucugcuuuccucccuccccucaccugacugcuucucucuuugcuccaggugauccuuuccaaagugaucccuucucagagcagcagacagcagcuacagguaaaggcuggcuuccacagguaaaggcuggcuuccuugaguuccugacaauguccagagucucuccaugcucaguuuauuuggggacaggaucacuugugcccuagcugucuauauugaguauguggugugacugucacacauggugggacuccccaccacccaugcccgggacagugaugucauagcaauagacagccaugauaaaggccuuuauuugugaccuuuuuuuuuuuuuuuaaagauuuauuuauuuauuauauguaaguacacuguagcugucuucagacacuccagaagagggagucagaucuuguuacagaugguugugagccaccaugugguugcugggauuugaacuccgggccuucggaagagcagucgggugcucuuacccacugagccaucucaccagcccuuuuugugaccuuuauucuuccguuuuagauugccuaguauguccaaagaccuggguuccccaguaccacagaaacaaaggauuuggaauauuugccuccccacagagauccccaccugucacaguagcuucuacccuacucauugccugaugacagcaguguuuccugcccuggcaucacccacagugguuauuauuuuuacaugcagcuuuauuucagagcauaauguauauaccacaaaauucuucuuuaaaaaaaguuuguacccugagcauggugucagacaccuucaaucccagcacucaguaacucaguagacagagucguaucugaagaaacccuaauuauuagcaugugugugcauguguauauguguguguguaaauauguguguguguguuguguguguguguguguguguguguguguguguguguguguguguguguccguguauggaaguuaggaacaacuuacaggagucaguuaucuuucaccauauggaucagacuaucaggguuuacagcaaaugcuuauauccgcuuugccaucccucuugcccuaguaaagcuuuugacagauguauagaauuguggaagguuggagugcaauccaucgcccugaaagggucuccuaaccuguggccauuguccccauucugacuccuggacaacugaccacacagucaccacaauuucugccucauccugagcccucucuccuguugcuaucuccucacgucucccuggugccauuggucaccaguugugcccucuuuuuccagacccauuuggaggggauccuuucaaagaaagugacccauuccacagcucaagcagugaugacuucuucaagaaacagacaaagaaugacccauuuaccucagaccccuucacaaagaacccuuccuuaccuucaaaggugagugguuucugcagggccucugcaguguguugggaucgguucauggugucggggaggcuggcuggcuuggccaggagcugucauaacaagccuggucucauuccuggcugguaagguggcacccagcacugucacugagccaguguacauagugccaagucagaccagggcaucuucucacagcccuugucccuuccagucucucuucgugcuaugguucucugcucccaccacuacuccaucuccuacagcuauagcagaauaccacauguagcugggcaugguagccacaccuauuguccugggcagcacaguaaggcucugugucacacagacuguauuauuuuguuuuauaguuuaaagcauauguguguguguguguguguguguguguguguguaugagagauacuucauuguuuauauauauuuauauauguguguguaugcauauguguguguauauauauauacauauauauauauauacacauacauacacacgcacacauauauauauacacacauacauacauauauauauauaugcuuuauugugugugccuacaugaauucauaugcaccacauguguaggugcucugggaggcuagaagacaucagacccucuaacacagaaguucaguuuguugugaauugccugacacagauguugggaaccagacucugcaagagcaucaaguauuuuuaaccacugaagugucuacagcccaugagugcaugcgugggugcacgcaugccagagaacaaguuaaugucagaggacaacauacauugauguuuccuucuaccaaguagguucuugggaaucaaacuuagauugucaggcuugguagcaagcauguuuacuuaaugaaccaucucauuagcuaugcucugggaucuuuaaaucccugauauuuuguguguaaguaaauguguccauguggguguggaugugugugcacaugugugcauacaugcaugaguguacgugucucuguguuagauuugaguuagauaacuuagagguugaugaccugguuucuguuacucuaacacaauaccugaggcuggacacuuaauaaagcacagagugcuuuuauuuuauuuauuuauuuuauuuugguucagaguggaggcuaguguggcuacugguuuuggugugaauauaaaauugcagaagccagagaagaaaaacaggaacccgaaggcuaggagggaccaagcaugcuugccuuuuccccuccguguaacuuucagagaaccuagucugccccugccagaccugacaucaugauacaaaugcagaguuccacaccugaccucuuguggucagacacgccagggugcgguugcacucagaauguugugugaauuuuucuuuaggauguguacugaauguaagaaacaguuugaggcuaaccuggucuucauagcaaguaguugaguuauauagagagaugcugucucaaaaaaaaaaagcacagaguagggagugauccuggagugaugagcagauaagcacacccuguggaagcaugagcugccuucagaccuuagcaccugugaggcaaacugccugugcucuuggacaugcacagcuguaacccugucacugagcuggagagagacagaaggacacuggagcuuucugguuguuagcccagcggaguaaggcagagagagauggacuaggacaccagguaccucuggccuuugcaugcacaaucaccgcacacaagagaaacaaacaauuuucaugguaagacuggggccccauccccaguuaguucaccaugugugcacaguccuagagugcugucccuuugcccaacauacuggggcaugaagcacaaacaacugcauuucuguugggauuuuuaaaagauuuuuaaaauuuuuuauuuuauuuguauaaauguuugccuguaugucugucuguguaccaugugagugccuggugccuauggaggccagaagagggcaucagaucccugacccuccaguuauacauaguugugagccugcaggaagaccagccagugcuuguaacuacugagcuccagcucaggacuuuauuuuuuaagccagguacucuguguagcccugguuggugugggacucggagaaucugugugucccagccugccugccuuggcacuuuucuuuugauccuuuuuuucuggauaucucucuccauuucucucuauuccuuuugaggcauagucucucugguaagucccaacugggcucaaaguugcaagcauccuccugucuugccacaugcugggaugacaggugugaguuuaaaagaguuaaguuccucuuauaauuuuuauuauuuauuuauuuguuuguuuguuuucuuuuggcuuuuuuggggaaggguuuuccuuggagccuggcuguccugaaacuuccucuguaaaccagacuggacucgaacucagacaucugccugccucucugcuucccuagugcuaaugauuaaaggguuguaccucuaagccugguaaauuaagugcucuuagaauuggccaggcauguaucaguucugauucuuuuggaagacagacguuccuuauuuuauugaaccaugcucccaaacccucaccugggaauccuaggcaggggcuccacccuuaucucgucugccaaaucucagugcugucuaugucuggcugugguucgcuucucaggccuuucguucacuggucauuuguggggacuauagaauucaucaguguuaccugcagcaggccaucuguugagcauuaugcuccacugcccagguuugucuagucaccccacccucccugaggugcaguauuguuugucauuuaaaacuguuagggaaaguaugguugagaggcuaaauggcagaauaaacuuuucucuuuccucccucagcucgacccauuugaguccagugauccuuuuucauccuccagcaucuccucgaaagguucaggugagagagacuugaaacuccuguccugaccacacaccacaccucaguaauaccaucaguucccagauaagugugcucuuggguggaacuuuuagguccuugccugaggcucucaggccaaagugaaugccucuucccccaucucauccuucacagggcugucuuucucaucaugagcuggcuuucuuccagauuguaggaauugcucuguuaacaccagugcugugggggacucguucuuaauggggacaguccacaguuuuccaagcauggugguaccuacaucuucccagcacugagaaacuaaggaucauuaguuucaaaaaagacccaggcaugguaguacacaccuuuaauaauccuacuacucgggagucagaggcaggggcaucucugagucccagacaagccuggacuacagagugcggccuuauuugaaaaggggaagugggggaaucuuugccggcugaugaaccacacacacacacaaguggccauccucagugucucauucucuccaucuucccugcuucuccuauacugguaggaugccagcuucaggcagaaacugauccauccuuuacccacugugauccacugaccucauaggagccaucuucccagaaacauucacagcccugagucucuugcuuccuaggauugcccuagacuuuugggcacaucugcucagaccauaaccccaacuguguuggugccacucacagaucccuuuggaacccuagaccccuuuggaagcagcuccuucagcagugccgagggcuucgcugacuucagucagauguccaagguaaggccucuuacgaaggccuagccauggccugaguuccacaugcugcuugugugggcaagcagacaugagugcuguccucugugugugugugugugugugugugugugugugugugugugugugugugugugugugugugugugugugugugugugugugcgugcacaugcgcgcucacacgugcaccugcauuugucauacucuugagcacaacuguacacagcagugagaggacagguccccucaaagcugcuguauccaugucucccgggugccaucagccauugcccaucucgcucucauuagcaucacagaaggaucagcuuugagggcaugaaguuggcaccucuguguccaagcauacuuuucugucugccaaggcccuaggaaaggaagagauagacauguuggucccaggaggccagaauaacaggccucaggcuugagguaucugaauaaaguugacuacacaaaugccugaagccuccaugaacuaaauucuugacguuauugaauggugagcucaaaacgagugugaauaaauauguacaugaagacagccugcauugcucaaggacaaaagccguagcccugucuugagcuggagugucugaaaggcuuccuugucugcucuggcucuggaauacacuauggcuggcuucacucauuaaaagggacaugguuagagagccacaccgcagguagcaccccagaugaacugauggggugcaggucuuccucuaguacuagagaggcucagguggugggaggacuacugugacuuggaggccaaccugggcuccacagggagacagacauggcagagaagaaagcaguaagguucauccuuaucaggaccuugcugaccuggccuugcuuggugagagggauuaagucacagauccuggcccagcacaccaggugcauuguuucaguugguuugauauauguuggugucaucuuuggcaaugaauaaaaaggucaagccagccugugacagcaaaguauuuaaggacaguagugucacaggugugcugucucagccccugcacuugccugacucagcaccuugucuacucugcuccccuccuggcaaggaucuguccuuagagcaguguucugugccuugcaaaugcuccucaugggcaugguuuccccagcagaguccauccuucuacuccuggggucaugugguugguggugcgggagucauagggcagcaauccugucccauuaguucuguccaccugaaggaggcagugggagggaauucugagggugcagacaucccuugguauccauaaagauagguugcgugaugucccaggggauaucaaaauccucacuggcaucccuccugugacaugacucaguucauugugaauaugacagacuguaccucuggguggcuucaguugucuugcaggaugugagugcugcaugcauugucuccauuguagucagacugaaagaaacugccugcgugcacucaguacagaugcaguguuuuucucuccucagugugagguugcuugaaggaauucagguguggaaccccaagagauggagacaaagcacaaguggcagccagcacccaauccuggggucccugcccucaccaagcaugcccucuuuacuggugucucaguugcucaguaauucucaggugccaaaggcuggcaacaggagcaacacuugugcugcagugaaaaccuacacagugacaaacauauacagaggcauggggaggcauggcuucuagcaagagaccugcauuugacacacuuaggagcccugugcaugcagauccaggaacagccauugcuguacccuaagcagcaccuggcauuggagaggcagaggcagccgguggccacaggaccugucggccacaugggggcagcagccuacaagggcuggugaccaagauugucucaagcugucuucagugggcuccuuucugcucucuaagcuuagaacccgucucugcucauugucagccccagcaaaggccucaccaaguguacaaggugucugaaguuauggguucugauggaaaaggaguuuucuccauuguacuguggccacuggcugguugguuauaugcaugcaagcugcccuacuuaggccuaagagucagaaaaagaaccagaauaccaaagacauaggaggggaacuacuuaggaagaaaggguuccuugggaguuggagggaaugucagcuuugggaaugcaucacacauauguaaaaguguuaguaagcuccaaguguuccgugaguggccaugcacauugcugugggccggggccugggcuguucuacaccugaugugcugagagucgagacuggagaauguacuaguugccaaccccuacuuaauccuuccauggaucucugcuccaguugcauaggcccccuucuccaaaggaaugcaagccugugcuacuaugugcccucucacucucagcccccuggcaaggauaggaaaaccaggcccacuuucuguucuuggcucuaggccaggacaaaguggguagggcuguggaagaacuugucccauacaauauaugcaccauccuggggcuucuugacuucaugacacuuguaaggauugugccugcccugccccacccacuacugauuuuccucucugguuaccuugcuaguuuucaagaacaacaccugguauaaauaaauuugaagggaaaugaaaguagagugcaagggcuuuuuuuuuccucuuagcuuucuuuuuuuucuuuuuuuaaccaucaccaccagcccuuccgcaccugagcaggguggggcagcauaugugcuguuccucaguccucgaauuagaguguccuagcucuguacaucugugcugaggaaggugacaacaggcaucuuaccagcgguagagucugucuuaggguaaccauugcuucgaugaaacucuaugagcaaagcaacccggagaggaaagggucuaucuggcuuacacuuccacaucacuuucaucacugaggaaagucaaggcaggaaccugaugcagaugccauggaagaugcugccuacugccuuguucccaacggcuugcuugcucaccagcucagggauggcaccacccacaauggacugggcuuuuccccaucauucacuaauugagaaaauuccuucauggacucaucagcugaggcuuccuccgcgcugaugaugacuugaacuugugucaucuugacauaaaguuagccagcacagguucccagcugaauauucuuggcacuugcugagcaucagugacauuuguuugcuuuaaaaaugaguuucccagcagcagguuccagcagcagguucagucagcagcaugagccugcagagcaugaucagggcccuggguucaucccagcacugcagccagaaaggagaucaaaguaagugaguuuccuaaaguguguucauagagcacuugagaacauaaaucuaacuucuuacccuccccccaccugcaccagacaaaaggccaccugugcaauaguaggugggugcagccuaucuucagugacuucggccauaguguguuuuguuguuguuguuuuucuuuuucuuuuuaaaaaauguuugcgcuggugcugguagaacacagaggcuccaccccaaguccuuuuuggcuguuccucacucugcuccugagaagaugaacaaccuacuuugacaggauuugaggcaguuguagcgguuauuagcucauuccugcuccugaguccuugcuguuaguggaagcauaccuuguucuuccccagcucccgugccugugggaacacuuuuacaaacauccagcgcucgaguaggaaagagccaaauuccaaugcccaagaagccuaagauuguccaaacaggcuaaaagggggccuagaagcacagaccuuuaaucucagcacuuggaaggcaggcuagccuggucuacauaaugaauuuagaccaucuaaggauacacagugagacauuuccaaaaaaagaaagaaagaaaauaauaaaauaaaauaagaguggaaacuugccugggcauuauggcacuggacugaacagagcccuaugaagggagccaggcuaacacagcuaagccuguccccuucgagguaucaguuugguggacuucaacuccuuggggagaugacacgucugucuugccugggacauugcagccaccuggagagucacgcagcacuggguccuguguggauuagaaaguagagcugcuccggcuccuccuccuuccugugacucaggguuuccugaguccggagaccugucccaggacauaacuuauacccaggaagcaccccaagaccaggaaacgucaucuguacugcaccuucucuucaggcuucuggauuucacacccagacucaggacucagugcacacgggcuugagcucucauuugccuucagcuaacaagugccuuuucauuuucuuuauuaaguugcauuucuuuuggggcagggugucauggcacccaugugccaagcuugagucaauauuuuuuuuccacuaugugaacccagggaucaaauucaggucgcuaggccugcuugcaaguauauuaagccaucuuuccagcgucucucaugcugugucuugucuggaggcuagaguaacaugcauuugaaggcagccucagauuuauggcaagacccuaucucaaaaaaaaaaacaacaacaacaacaaaaacagccacuaaccuguagaugacccuuguccuaccuccuuccaguccccaaggcaggaggagcugagggucuguagacacaggcuucagaaagaggugagauccugcccacgugccucacgauacacaaguguccucuuagccugugaggacccaucuugggagccuucccccagugggugccugagccccauguucgcuguuccaucugcaccucuggaaaagugugacucaaacaaggcacagauggcaaguggaacaguuacagcaugcuguaauaaaaguuauuucagacccagaaacuguuuuucuggaacuuuuccucuucauguucucaguguuacggaucaugaugugacaauguggggcagcuguauucaaugugccaucucugcugcucuauccagugucugacaggcauuuuaccugacacuuccuuucuggggcauuccagacagugaaggccucucaucucugucacauuacagaugggaaaucaaggcacagggaguugggcugggauuucaguucagguugauuaaccuagcucaccucugaccacagggcucugcagccugaccaggcugauguucuggaaacuuucauggacaagcuuugaauuaauacucugccauuuguguauaaagacuugagaauauucuugguagaguaucaucugcuucucccugcacugcagccugccagcccaccaggccuuccugcaugaaacucccagcugcagggaauagggauugggggguugggggacuaguuaggaaguaaauauggagcuugcagagagcccuguguucuuggguauguaugugcacaugugcauaugauguguguguguacguguuagaugucuuccucaaucacucuuacuguuugagaugguucucacugaaccugcagcucacagcuucaccuagacuggcaagcaaguccuggagguccaugugcgucaccuccagacugaggacagggcuaguuuccauguuguggcccuaugccuacccuucagacagugucagggagcccaggccuagguaguggacaagguguacugggucaacacugauccgguaucgucugggcaagccacauugacuucugugccucaguuugucuguguguaaagcagggguaaugguaguagaaaucucucacagaccauauagaaguagccauuuccugcccaggagcuucuagaaagcauugaagggccugcuggugucagcuuagaugccagagccacuacaagucccugccacaccccuccuguaaggggucagugcauggcuagagcaggacugcuucucauacucuucccucagucugagucugccauggguccuggguucucuggcucgcuuuccguccuuggcuugcccuguggggaaggaaacagaaagcgccaaccccucucacucucugggcuccucugaagagucucaugucaucuuugggagaacccuucugcccaguacuugcagacacccugggauggcagcugugccaucaugccuggcaacacacuagauguuuguggcccauacuucgcucauuaucuuguauguuggguaaaacguguccacuuuauuaaacauuucacucuuuuugagaaaggaacugucuuaguguuaccauggcugugaugaaacgccaugaccaaagaaaguuggggaggaaaggguuuauuugacuuauacuuccguauugcaauucaucacugaaggaacucacacagaguaggaacucacacaaggcagaaacuuggagguaagagcugaugcaaaggccauggaggggugcuaccuccuggcuugcuucccauggccugcucagccugcuuccuuauaggacccacagugggcugggcucuuccuuauccauaaguaauaaaguguucuacagguuaaccugcagcccuaucuuauggaggcauugucugucuguaucucucucccucucucucuuccuuucuuccucucucugucugucugucuguguguguguguguguguguguguguguguguguguguguguguguguguguguguguguguuucaagacaagguuucucuguagcccuggcugucacacuguagaccaggcuggccucagacucagagcgcuaggauuaaagguguacacugccacuaacaagcuggaaaccuaaccuuuccuuuccuuucuuuuuuuuuuuaagauuuauuuauuuauuuuuauuuauaugaguacgcugcagcugucuuuagacacacacuagaagagugccucagaucccauuacaggugguugugagccaccaugugguugcugggaauugaacucaagagcucuggaagagcagucagugcucuuacccgcugagccaucucuccagccucuggagacauuuucuuuucuuuuuuuuuuuuuuugagacauuuucuuaauugaggcuccuucuccucucagaugacuuuagcuugugucucguugacauaaaacugcccaucacagggucucacuaucgcccuaacuggccuagagcucaaagauacuccuguacugcgauuaaaggcgggugccaccauacccgcccaaacaugucacacuaaaaacuguuuuuauaaauuauguaauauguaugaauguuuugcuugcaucuaugccugugguagaggucagaggaaggaguaagaugccugggcugcaguugcugggagccacacccaggaccucugcaagagcagccagcacucccaguuucacuuuaguucuuuuaaacuauaguguguguguguguguguguguguguguguguguguguguguguguguguguguguguguguguguugaaugcccaugugcauuugugauuacaagaguuuccucuuucuaccacacagguccagggauuaaguucagguuagcaggcuuggugacaacacuucccuauuugcuugcucuccaccaggugugguaacaccucccuaucuuccuagcucucaagagguugaggcaggaguaucaggaaacuccaggacuaccugacauaagaaagcaguguuucuuacccaccccuccccacacagcauauagaaggaaccagcucuuuucugugagcaccucagucgagcuugugugucacuagucuguccaggcugugucccccauuagucagaggcacuguauccuaugaugcugacacacgggccccugacagccacuguucagcacugaccuugaaccaugaguagacgaggccuguggcacaggaggaaugcccaggcccaccacugagauagugccaaggcagaguugugaccgacaggcagggcucagccacagugggcuucagcuacugaacuacccaugggaucucuaggauuuggcugaguccucagggccgcucucagagcucauaccaagccuuguuuguuuguuuguuuguuuguuugaggaaaugggcuuggggauaagacccaagacuuggccagaggaggaugggaccuuggaguguguuaugacgucagccccauggaugccauugucuucuguuuauccacccagcagcucucucacaaccucucuccaccgcacacccaccugucccucucuguuaauccauccaucuauacucccuucauccaucaguccauucaugugucuacccacuguccaucuacuccuuauucuauccgucuggccuaguuucuuucauguugcucuaauaaaguauccugucagaagcaacuuuaagggagaggggcaggcuaguccaucacuacccuguggaagucaggguagggcuugaaacagccagucauaucccugugaucucgacuguuuaagaucgggggauaaacacauguauauuugugcuuaguucucaguucucucacuuucaggauucccuacuuaaggaguggugcuacacacagugagugggucuucccaccucaaaucaugucauaaagacaguccuuuccccaugccuacaggacagccuuauucugacuuugagcccucauaauugagacuuucuuuccuggugauuguagauugugucagguugaggguuuaaacuaaccauuguaccauccauccaucuacucauccauuuacccucaucagucuauccugucaucucuccauccucucacauauuuaucuauucauccacauagccauucacccacccaucuaucuauuaccauugucuaccugccaauccacacauuuacccaccuacucaccaucugauugcaacugucuuauuucaggcaguggaaugggggcuacuuaaacugggcacuggauaagggaaacaagcugacauggcuaccaagaguggguggagauaguauugacuugccagcagauggggauggguagccauuggagcagacaugccagccugagagggucuggucuguuccaguccaguagaggcugagaccaugcaugucucugaucaugaacagaaagaagucccagggacccaugugcaguguugaauugggaaagaacccacaauguagcaagagaggccacaggagagcaguguuaccaucugcugcuuguauuggcuguuuucauuucauacagagguuuuggcuuugaggguaaaggaaagcgggggcuugagaggacccggguauugccagggcucuuggugcggaagcauuugcucagugccuucuuuuuaaugucuauuuuugccucuuucguguccucucuuacagcccccaccuucuggccccuucuccuccuccuugggaggcacaggauucucagaugaccccuuuaaaaguaaacaggacacuccugcucugccuccgaagaagcccgcuccuccacggcccaaaccgcccagcggucaguacgcuuccuccucucgcggcacccgccgguggggacagggcggcgggcacagggccccuccauugagcagcccagaguagagcagaccccaaggcagaacgucuccccucugccaaguugccucccuguugcuccccuucccccucagagugugcugugugugcugugcuauuucccugucccaugguccaggcuaugaugguguccucaucaauguuuuuccaucugcguggucccucaaugucuaucuaguagccuccuggccucgcgccuuucucguggggguggcuacagcaggggcucaggguagccuugacuggaugggcacuuggguaagauaguggcuuucuuggauguuuugaaugagcaggacggccuggcucuccauuauuacucuacucagcugguugagagaaggcugccugaggagcuuccugcccucuucccuguaacuucacucuccugagcccugcuuaccaaagagggccauuguguccucccccagcagauuuugaguacuugugacuucuguguuaagagcuagggacagagcugacuggcucagugauagagcacuugccuugugugcccaaggcccucacuuugauauccaauacugugaagaagaaggaacaucugagugacacaaauguguaacaucuccuuuccagucccuaauaagagcaggugccccuugaagggaccuagccugccccagcucacugaguccacaugauuaccacuuucuguauaguccaccugcagaagauggauagacggaagaaagccuuaggagucucuccuccugccucaucaccugggcccaccuguguuccucagggacaaugcccacacugccuuccuuauaaggggggucuggccagcaguauaugacuugaguagccugugugaaguacuggagaggagccuugcaaaugauguugacuccaaagugcaagggagcccuucugcuaugaacagcgcccugcacccccucaccucaguagcuucaugcugauggaaaaacacaagcauguacacaagcacacaugcccacacauacaugcccuucauucacaggcagcgugugugugcgugcacucacaccaucucauacacauguguguccccacacacacacacacacacauguuucuuuuuuuucaauauuuauuuauguauaggaguauaccguaacugucuucagacacagaagagggcaucagaucccauuacagaugguugugagccaccaugugguugcugggaauugaacucaggaccuuuggaagagcaaucagugcucuuaacugcugggccaucucuccagcccgucacauguguguuucaucacucaaggcucacauggaccuugaaagcaaaggcuugaacaugucugcaccuguguacauguuugcauaugugcucauggugccaaauguuugagugucaaaugagaauucauuccccuaguaugccacacugccugugucagguguacagucauucauuugcauguguucucauggagacacacaccaccaccccauacaucguuccauguccuucuguuuugucugcuucucgugcuagauuuauagaguaaggacagccuguaaaaugcugagaaagcccucaguggcaucagagccaagucucucaagaauaggaccagguugggaccucagggccaucagccagcccugucugaggcucucuggaccugacuuauuaaugaugcagagcugggcucugccacagccauuaugaccuugggaggccugaagcaacuguuaucucuuccuuugcuagugagaccaugagauccauggagcaggcaauaugaugcccacuuaccacagaggaaggugggcaugugggccacccagacucacagggaagauagcaucugcacuaggccuuggccccccacucugcccacuacuugucucuguuacuugccacuugcucguacaucagcaaucaggagaaccuagccaggagaguccucauccugagaacuguggcuuucguacauucuaacccaugagcagagcaccugugggccuaagcauuucuuauucacucuacccagaagcagcagcuggagagaaaggcacgguuguguacacacugcugggugguacguacagaugugugguggaugcaugucagcccagcaucccaugcuguugaucuuaucuuagucucuaacuauacagguaccacaugguaccugugcacagcucaggacccuccccugccucagcugaccuauuaauuagcccuguuugaugggaaagcauuuggcucuuugccccagcucccugguucaugcauggauuuggagcauagccgugcacuuccucugccccugacccauccuuaucacaccacagccacucacccagguucccagggcaacagugcacauugaccagcuccaccgcuacacucgcucagaagccaaaguggaaacuuuaucuuauuuuaugguguuugagacaggaucucuauggugacugggaacucaaccauccuccugccccauuauacacuguuuuuggauggugguuuucugccuacccaauuuccauuggggaaaaccauaugaccaguguacagcaauaaauaccuuuagcuggucacaccccauugcucagucccuugggaugucagacagauguggaacucugcagugggcuggucccagcauggcuaggaggagauagaugaggugagggugccugcccaaggaccuccagggauggucggccuucugauggagaaagcaugccacagugcuucccaagacaugcuuuaccuggcucaggagucaggagagacaguggcuucucugcaguccugcugcccugcaugugagagagcucuuaggccaccaccuuccuaccugggcuuuucuaaccugaaggagcuagugggcucugggcuaccuauccaacucuaagggguuguucagucaggcugcuuuggggaaugugaaggccccaggcagaugucccugggcagcccugaguccaagaugucaguaaagcacuuggcauggugguguugugugggaucuguauuguauuauguguucaccccccacagccaccugugucaccugggccugacccagaugaggugacaauucagaaaaaugucuucuguugaaaaguguugauguuuaaggugucaaauuuaaagccagcccuggguccccugagaaucauuacccaggaugagugucagugugggccugggguuauacacuacucugcuguuguguucuaucuuggaguucagucucugcucucacagagaucaguuuggucugucgaauagucucccuaagcaucuggacagucacugcugcugguagcagcugagguggcuagcagcuugaugcuaaggguauaguuuucuccuugaagcuucagagugugagccuuaggcugcugggaugugcacagaaauuggaugucuugaaagcucuacauucuccugccuggagaucuuuucuagaaagguccaucaauguauuaaauaaccugcaggugucugggacugaagcaguugauugcuuucagacacaugcaaaacagcccugaaacacgccaguuggagugagcacacgccucccucagguaaacagugguguauuuucuucaacggacggagauggagaucagucagaacucaccgcugaaguuucuagguaaaaguuguugauuugcaaagagagaaacagauuuuuuuaagcucaggaaacggcugugugggcgucagugauuggguugccugagauagcgggauccuggcgggccccacccugccacuuccugccagcgcugcccugcggcucccagcagagccuacccgcugccccagugacacccacucaccagccagucaccuuuaaccucucccuaaguuaaugaucaucuuuauaacuacucaugaccucuccaccccaucugcaaggccagauguccuacaggaggaagauuuuggcagcuuuuuuuuucccuuucccacagcaccacugagagugcuuguguuagugagcagcccauucccaagcuacauaagaauggucuagccuguguauugaauuccuccgcaaaaagucauucuccucgagcagaaaaguccucccccacccacaugcuaucuaugcagaauggccaaggcuuucucacagggucagcaggguacaggcacagggaauauuuaggauuguaagcagcccaauccugugaacuuucagccuuucugugagaucccaggaagaggauggaaccugcgggucagggcccuggugcugcuggcuguccugucuaugcccaagccccuuguuacuucguauugucaaauggcaucacugucugagccugugguuagcaccucugcccugaauauaacuacuuuaauuccguucccacgaugguggcaaagagauaaugcgcuggguacacuggagaguauagaaaggaauguacuuguuccauuucaggaagguucugguguucgcuagcagccaggauggccggaaggcauugaagcagcccccagcccccacacacucagggcacucacugcucugcuguugcuauggcacccuggagggucugucccagggcucgggauaaccaguggcugcuguagaucuaugcuggcugagggagggaggcacccauauacuguauggguuugccuucccaggcgguggaggaacccaugcuaauccagcugguuucagcagccugaggccggcuguuguugagggaagauuuggcagaacaguuugaaaauagaaauagugccuaccucagcacacccacccuuuugcacucagcaagguggauccaguggguguccuguggccugauauucauuaacgaguaaaugccucaccagaggugggucacaaucuggacaguggagguucugggggaccugcaggauguaagcccagaaagacugggccuuccuaccgggccucugugguaguaagugggugggaacaacucccaggcccucacuuggcugaagguccacucuuugaucaccuaaaggacucaggccaggucucuagguauauaaaugauugacacaucaccccuguagugagcucaguauaguagcucacgcuuguggucaguagagagccaaguaggaaaccccucccccaagucuacaugguccuguccaggccugugacccuuuccaccacggggcacacauucccacugcagacaucacagucuguggugacuuuauaaaugugccaaagugucuaccugcccauuguagagguaccguucuguuuauguuugcacccuguagggaggacaaaagugggagguccuggcagcccccguggcugugcauggcaagcaccuaggacucccuccacugucuggcuucuguguagauaccaucucccugugcacccacuugaacagaaggauuguggcaaaggugcuacuggagaacaagugggagaucugucaaucuuuugcacaaugaagacuuacaggugcacggccuggugguucaugccugugaucccagcacaugggggcugcagagugaagccugucucagagcacaguucaugucagccuugcccaugccuauuuucuucugcaggcuaauguccuucaucaguucuucaucagagaucauagcagccuugugugaaaacggaaagaaaguugucuuccucacuucaaauccauguguccuuuguggacccagagcaaguggccacuagauucccuugccauggaggagugacaucuuugucuaccggccugccagccccagaguuucccauggccccugcccacuugacagcaggcgaacauagugccagcauagguagagauaacaaauauuuguucagcuuuuccccucagcucagacccaaaccucauccuguccccuccaaugugccaagcuggucuucucaaaaauugguaaauauuuuugguggaaaaugucagcaccaugaugugaucugggaccucagacaucuaucaccugggcugcacugcucugcuguguuccaaccuaccuagucuucaggaccccugccugcaggcccucaguggccuggccaacaggcuuccagaacaagucaucgggaggauggaggugugggcaaaaaggauuccuuucacaugacaguugaaaguuugagucaggcaaucugauuuuucucuucucugccaucacuuacucuuauuuugcuguuccacuagggcagaauggauugaggucccuagugaccucuugaugucccugucccguguaugucccucguccaguucccaucagaaaccugauguauaagcaacugguacuguucuguugagaguaaaaucacugacaguguguguccucugggacaccuaacaguucuguggugcccgugucagggugcacagcagugugggagaguccuggguugcagaggauaguggcuaggguggggcagcugcccugaccacaaagcuuuagucuuuguuuuucugguugucuuuugggggguguuuuuccuguauuuaucucccaucugcagagcugcauuuuuuuuuuuaaguacagcaaugaauugugucaacagaacucgaagucugacaagagcaagcgcaugcucucucuugguuguauuuuguuuuauuugcauuuccacauacacccccucccaaguauagcaaaaucucucacacuguaccccaggcuggcuugcucagaacucacaauccccuuucgucagccuucgggguacugagguuagagcugugcaccauuccuuauauauguggugcuggguggagcccaggacucccuguucuccaaacauguugaguguucuaacauguggguccccaguccugacauuugauauucuugguaaucagauuucuaagaacccugcaccccaggucucugacuguccuccugcaucagcuucuugaauggagagacuacccucucgaagcugacuauuggcaguuccgauacauuucccaagccuggcucuuggcaauuccaauacauuguccaagccuggcucugggaauugcucaggggaaucccugaaaagcaagcugggaaagagauaggcaccuuccucccccauagucucugggugugcugccucuauugcugaggagauaaauagccuaggaaaccagagaaauagaaaaauuaaagaaauuccuaccaggguggggccggccacugaguaagguuuuuuuuuuuuuuuuuuuuuuuuuuuuuuuuuuuagcagaguacgcugugguaaaccauggaguucguguuguuuuugccgaagucagugcugugugugguuucgguacaccgcucgggcggcuguugaaacugcugugguuuccacauaaggccuacugugccucuccagucccucagcuagugcacugggggcaugggccaggggugccaugcccacuaugagcaccagccugcaaaguuuuuguguaacuuuuuuguuguuuguuauugugagagggcucucacuagcugucucagagccagucccuggcuggccucaaacucagagauagccuggccaaaaacuguguuuuuuauuauuauuauuauuacauuauuaauuauuauaguuaggagugcacucgccucuucccucgguguugguuuacuauauuuauuugcuucuguguauccuugagucaguggcauacagguggagucagaaacugacgggaguugguuuuuccguuguguacauuuuaggaauuuaccuuggguuaucaggcuuaggagcaagcaacucugucuacugagccauucaacagucccuuguuuugucuuuuagauacacccucaguaugucauccauacuguccuuagacuccagauucccuccucagcaguuuuuaguuuauuccaauuccuucucuguggccauuucuccaugcucauauccaaagagccaaaagcacugugaccuugcuuccuacaacugggguggacagagugacuuugucacacugagaaucaacuccaccucagaaaauagggaaagcgauuacagaguuagcagaagugguuacauaaaagcaggaacuagauucagccuuaacaauacagccaccaaaaauaacucagggugccaagucccaggcucaaaccagggccaugccaaccugcaaaugacagagaccuaaagugccuguacgccagcacacacauaccaaaaaaaaaaaaaaaaaaaaaaaccacccauaugaaaaccgucauccuccuuugaaaacaagagauaccaguuacugcuggcggguuucgugagcgcagucacaauuucuaaauaacgguuucagcuguaccgagucuugguguaaaauagucuuuucguuccugauuccccucaaugcucucagaagccugagcuucacauggcugcagccagcuggcuucccaccccucucagcaaaacucuuuguuucuuuguuuugcuuuauuuuuuuaauuccucaagccagaggagaaagaguucuccaucauagagaugagagagguucagaaguggcuagucgccggguagugguggcgcacgccuuuaaucucagcacuugggaggcaaaggcagguggauuucugaguucgaggccagccuggucuacagagugaguuccaggauagccaaagcuacacagggaaaaccugucucaaaaacaaacaaaaacaaaaaaacaaguggcuagucaccuccugucccugcucaggugucuucagaccuaccacaccacaagaaauguccuggucuuaaauuauuauuguucauuguuuuugagaaaggcucucauggaguccaggcuugccuuaaacucuagguagcuagugaugaacuugaacuccuagucuuucugccuuaaucccccugugccagagucaggcaugauggaccaugccuaauugcucguggguagggaaugaaaccuggagcuccacuccaggcuaagcaagugcccuacccuuguuuuuauugugagacaaggcuggcuauggaauacagucuacauagcauguuuaaggcuacaggagacccuuucuccaaaaacaaaagaauccuguuuccauuagugaccuguucugcauagcucaaggucagagcuuucaaccuuggacuugauggugugauguggagacagacugagagcagacaacacaggcuggguagggauguguaaggaggucccuccucuccucaugacccuccaggauccagcugcugcagucuugagccuagcaccuugcccaguacuaggccugcacaggcauguguuaguaugugugcauguaugauagggaugggcuucagaaaccaugguagcacaagaugauaucugacuggaaaagagugcccagguuugggcauuacugcagaaaucuaggagaguuguuacguuccuggacuuuccugguguucagauacguggggaacccagauuuugugcuguggagagccacauucagucaaaguccucccucccaccugguggggggcugaagauggagagcaaagacagacucuugaauaguuuuaaucccugagaagaaaaugagaaggcacagcaggcuuuagucacaagggccacaggcagugacaggaauguaugugagccaagcagugaguuagcaguaaguguggaugggagaaaagccugauggagaacaggugaggugaaucugugaguaugcuaggcuaguggggagaucugagcacucaaaugaggacaagcaccuuguccaugucacagucccuuugccugacuuccuuggcugaggcucucugcaaauaggaugugcuuauaguuguguucauagcagucuggggacugaagaaggaaacucagggcagcagcuagacccugucuccauaccaagcauguaucugguuugugagcauccccagccucuguugccugcuuccucauuucugguugagugggcuugcugagcucuggcuugcagggggcuggagguuggcagcagggcagagagaacagccgggguucuuaggaguaggagaagccuacucaaaggagccaggugugugcccacccuccugacagugucuucaggucuguaaccauggccugggcagaaaucuaaggagaccggggugguggugcaugccuuuagucccagcagucagguagugaacuucaggcuagccugcucugcauggugagauucuaccuuugggaggggggagcagcggccuucugaaaggacagugcagugauacucaacggacuccaccauggccaugcaucugcugugucccugugaguauguggaguauaacacuaugaaacuucaggaacccuuggcuacccuaucagguucuuaucuccuggugguggcaccagguuacugugauaugagacuuacuucucauagugcuguaccucuggccuaaguuaagcugagacacagccuggaucugaccuauugcacauuacagcugaggcccagcugccacagcugcuuccagaagagagcuaaaaccagggcucugucaggcacauaccaacaacggcugcuaaguaucacccacaggcagcagcacccccagucucuucauucuugcaccacacacaaauggggaaauuaagaccaacuagcccucagaacuuuuccuccaugagccccagaucagaagguggcagguucagaauaaacuugaagcccuagacaucuggaagcucagaaauugagguggggguuuuauuggucuggggaaacagaacacgguacuaagaucuuuucuugccuuuacccauuauugggagaugagggccauuguacgaacgagucagaacagccuuacaggaugucucucuccuuccauguuggcgccugggauggcucaggcuuuguguuguccccacaaccagguguccaaggucaacugcuuucgugucuuucuaaacgaugacuuugaaaccgugugagcuucuguggguaguucaguugauaccagggagcuaugcugaccuggcccuugggacuaaugugucagccauguuggaugucuggacucugcgugcucaggcacaacaccaggagucaagagagccaggcuggacauucauacuuuuuuuuguugugguuguuguuuuuuuuuuguuguuguuuuguuuuguuuuuuguuuuguuuuguuuuuucgagacaggguuucucugugcaguccuggcuguccuggaacucacucuguagaccaggcuggccuugaacucagaaauccuccugccucugccucccaaaugcugggauuacagacaugcaccaccacugcccggcuuggaaauucauacuuuucuggugugugccuggugcuugucaccuguagucauacccuguacucuagugaguugguggccucgucaccagggagaccuuccuacccccucuugcuauccuuagaaguuuucaauguguuucucugcucagcugugauggacuaaagcucaaguggaaacagucuaccagucucacucuaaguauucuuugaauggauacauaguaacuagagaagugugggccagugacacuguagaaccagaauguugguacugggaaccaaacacucugcaaaaacaaugugucuauaacuacuaaagacagguccaguguuagcugcuggugcaugugaccugaaguaagcuugggccaggugguacacaccugucagccuugagcuugguagucugaggcaggaagaugaguucaaggcccaaccuggccuacauaagacucugucuuaaaaacagcuguuaaaaaaaaaucacucuccuggcaugaccuugcuacacucuguuccagguuaauauagaauguaacuccauuguauaauaaguacagaaugggcaugagguccuggauuccaggcacacacaccccaaagucagaacccccagggccacccuucucuaaaucucccugcucucccuagagagacagccagguccccacucuaguccuaguaaguaacuuguauuucuucuucuuuuuuuuuuuuuuuuuccuuuucuguuuuuguuuuguguuuucccccuaaacuuuccaggucagaguacaccuguaagccagcuggguucuucagacuucccugaguccccugauccauuccagccacucggggcugacagcggcgacccguuccaaaauaaaaagggguuuggggacccauuuaguggcaaagauccauuugccccuuccucuucagcuaaaccuccuaagaccucuuccuccggcuuugccgacuucaccucuguaaguugaguccucccucggccaccuuccugccucgcuugcugcuucucggggugggggucccucugcagcuauggacacugcuuugcccugcugcuggugccucccaacagucaccaacuacuuuuguuauuuauucugcgauggcuucuguaaggcaaauagacuguugauaaagaugagagccaugguuuaacgaacugcagggagaguggcgugcgcacacacacacacacacacacacacacacacacacacacacacagcaugccugccucaguacucaguggcuugugaucuguggcccucagaagauguucuguucacugggucuuugagacaaggccuagcuauguaacacaggcuggccuggaacucaaagaguccaccugucucugucuuuaguugguacuaaaggugugugccaccacacugguucauugugucuggaggcagagcagacaggcacuucccgagaccaauuacaaacauuucaccaggauucugcugccuccaaaaagaccuuugagucagugguccugcccaagugcaucaugcaauuaggagcaaaagaguccagguaggguauccagagagugagagauuuggauacuguucauugugcuuuuaucugauuucuguuuauuagcuacacugaaaaauauuucaaccuagaugaccaccuuggaaccucuuuucuuuuccaaggguucagaaagaccacuuguccaaaguggcuagagacuuuguggaagcucccagggcucucacuagcacugccuugcuaucuguggagagccugccagugccuucagcauagccucagcauccuccagcaccucagggcagccgugcuuggugcugucuccuguaauccauuucgcccuucagguugaggccguuuuuuuuucaagagcucuccuuugugcuggugaagcuccuugcuuggcugucaggagagacuggagagcugcucuguuuacugauuuauguuuguuucuuugaaauaagccuggaccuucuuagucucuauccuagaaugaccuugagcuacuuacugauccuugcacccuaaccuauguguacuaugugcacggcuggaaugacaggugucaagcggaccuggagggcugaaguguguagcucagucaugauggacaggcagagccugcauauaacccuagcuuccauucccaguacaaaaccaaacaaaacccacuuguauugcacaauaaauacccugguccuccccagccaauuguccuguagcuuaauuugaauugccuaaggcauaccugggcccaguggcaguuaccucucaucccaguacugggauggaaggcugaggcaggaggaucucaaguuugaagccagccugagauacagaaggagaugcugccuaaaaauauuaauaguaauaauauguugauuccuggggucuuguaacuauuugucucuguagcccaucaguuccguugacagugccuacaaugugccuucagaaaagugacauuauuaguaaaaaccagagacaaaagcacuuugaguuguuuggauaucaccaggguuauuuucugguggaaacuacuaaccacaaaggccagagcugguauagugaguccagcgugugccuagcaugcccugcccugggcccauccccggggccacacagccuucucucucagcagcaggauuaggaguuccaguucagccuggacuacaaaaauaaaauaauccauuuuaaaaacaagcagugccggugugauggugcacgccuuuaaucccagcacuugggaggcagaggcaggcagauuucugaguucaagaccagccuggucuacagagugaguuccaggacagccagggcuauacagagaaacccugucucgaaaaaaaccaaaaaaaaaaaaaaaaaagauuaaaaccaaacaagcaaacagcacagcuguuggcacaugacuccagugcucgguucaggcaggggagaguggugauggagcugaaccacaguguagagaaaugacuggccuuucugaaaagccaguuuacuuccugugcccacacaggcagaacaccccagcccugcuguuuugucaugaacaccagguuccaagcugugacugagcuaacaacucguugccccagaguaguuacaggcuucaguuuuauuuuucaaguuuaucuguuuguuguuuggguuuugagaaacggauucacccagucuggucucaauuuuauagcuucuaaaugcugggaugucaggcaccgcaccauaccuaguuuaaauucugauuuaaacacucucaucuccagauaggaaaccaaauccugccuggccuggccuguggccuuuuauuguuaugaaguuguugucaccuucaccaccacgaggggcccuguguccccaucaguacacacggucuucucuggaacaggaccauguuccagaaaaaucugguaggauuuugaacuuccccuugcugagccauaaauauacugcccucccaggacuugggauggcccuccaugagccugcuuuccaggauccuugggacuuuaaugcugugcaaacucugaaaagguugucaucacguacagaaagcagccugcuuagcuugggcuuccagaacugauuucacccaagcaggauggccacugcuaucuuugguaccugcaguggcaccccagagcuuucugguaaugggugacugcccgcccucaguagcuccuuagcacucgcagaagcuucugggcugugacuguagcucagcaaugcacacuuaguacaccuaaagcccaagacuuuauccccagcacuguguaaagcagacuuggugcaggccugucacaucaggaggucauccucagcugguucaaguccagcauggguuacaagagacccugucucaaaaaaaaaaaaaaaaggacaaaggagccagcacuuuagucccagcauaugggagguggcagcagguggaucucugaguuggagggaagccugagcugcauagagaaaaauuuucuuaaaggcaacaaaaaagaauuuucuuuacauccaggcaagucuucugcuuagcaggugcgguggcgcccgucaaacuucuagggaauucagggccagcuuggguugccugugucccuguccuacagaacaaacagccucaggcugugauugugauccuccuuaaaagcaaucugguggggguuuuuuagccaaguagcuugcuguugucugcacagcuucccugagagccaagcagacaucagacugguugggcugggccuugcaaguacuccaugaacaagcugggaagugggggcagagccugucugcaugcucuauggaggggcauuuccaaauuuccaagaggcuucagaaauaaaauuuuuacuucuugacacacauucucaaugaugaugguguaugagaaagguggacuccugcuaucuuggggcaccuaagacacacagguuuagcucuggccugaggagaauuagagguggcccaauccaagcagggauagucaguaaaucccugagaaauucucuuucuggaaauuucucucagcccaagugcuuguugugcuuacagaguacaugaggcaggucuguguggaauucccucucuuggccuccagcucugaagcaccccaguguguggguugcaguauggaaggggccuugcugcuagacacugaugggggcuugucugaggcagggugaucuguaacccucuguggguacagacgaggggacguugucaguuacugcugucuguugauagaugaucugagggccaaaugcucuagcugaagaagcaccuacccucauuccuccacaccacccugcaaugcucucccuccccaaggaggcugcagguugucagucucacucacugcuggugucugucugcuccagaggacuggaaccuugucccuagugucacaaauauuccuuggaagagacagugguuaagaagacucuugaugucccuggacaagaaguaggcucccuuggggcuugaggccucucuagagggcauggagcagaguuaugaucugguagaauguggcugcagcccuaaagagugugggaguguugacaaucaggagggguggcugaggcagugggauugguuauugugcuaggccaaccugggcuacauaaggagacuguuucuaaaagagacagagaaaaaaaggcuauagaccgcacccauaguuauuggaucugccugcuagaaucuuccagcacuagguccagcugccucucucuguaaggaugggugccuagcccuccaguaggcagcucagguugaaugcacccuggcccuucuuccauggggugaagucaggccccagcaugggccucugguuguaucuucuuaggacccuccacucuggcucugagcccucucucacuauccaaucuuccuuuguaguuuggcaaugaggagcagcaauuggcuugggccaagcgggagagugaaaaagcggagcaagagcggcuggcgaggcugcggcgacaggaacaggaggaccuggaacuggccaucgcccucagcaaggcugauaugccagccuaggugacacaggggaagccgcagcuguauguacacaucccuucaaguugugccaugccacagccaaggacagcuggccacagggccucaggcuacagggaccuuguugagaggccucagacacugcucaccccugugggugggccaggaaggcagcuauagguaaaaguccuggaaccugccagucucugagguaugauggugaucaguuaggcucuuccuuccaaucauucaguggcugacagagaaggccuccagucuccuagcugcagacaagcuccacccccagcccuuccuugcauccacaagacaccccacacacaugauguaugcauucguuguauaaaaaugaaguuugaaugauuaauauaaaauauuuuaauacaaaacaugagacuaucuucuuuuuaaucagaaaguaugggucacgggcugagcccuccccaccagugauugggagaggagccgcauugucuguuuuuugguugguugguugguuugguuugguuuuucgagacaggguuucucuguguagcccuggcuguccucuauccuggaacucacucuguagaccaggcuggccucgaacuuagaaaucuaccugccucugccucccaagugcugggauuaaagccgugugccgccacugcccgacugcagugucuguuuuaauuggguaugaguggugagcauauauacacagguacuggcaaaggccaaaguggguguc

SEQ ID NO: 4531 - RNA, 978 nt, Mus musculus
uuuuuuugguaugugugugcuggcguacaggcacuuuaggucucugucauuugcagguuggcauggcccugguuugagccugggacuuggcacccugaguuauuuuugguggcuguauuguuaaggcugaaucuaguuccugcuuuuauguaaccacuucugcuaacucuguaaucgcuuucccuauuuucugagguggaguugauucucagugugacaaagucacucuguccaccccaguuguaggaagcaaggucacagugcuuuuggcucuuuggauaugagcauggagaaauggccacagagaaggaauuggaauaaacuaaaaacugcugaggagggaaucuggagucuaaggacaguauggaugacauacugaggguguaucuaaaagacaaaacaagggacuguugaauggcucaguagacagaguugcuugcuccuaagccugauaacccaagguaaauuccuaaaauguacacaacggaaaaaccaacucccgucaguuucugacuccaccuguaugccacugacucaaggauacacagaagcaaauaaauauaguaaaccaacaccgagggaagaggcgagugcacuccuaacuauaauaauuaauaauguaauaauaauaauaauaaaaaacacaguuuuuggccaggcuaucucugaguuugaggccagccagggacuggcucugagacagcuagugagagcccucucacaauaacaaacaacaaaaaaguuacacaaaaacuuugcaggcuggugcucauagugggcauggcaccccuggcccaugcccccagugcacuagcugagggacuggagaggcacaguaggccuuauguggaaaccacagcaguuucaacagccgcccgagcgguguaccgaaaccacacacagcacugacuucggcaaaaacaacacgaacuccaugguuuaccacagcguacucugcuaaaaaaaaaaaaaaaaaaa

SEQ ID NO: 4532 - RNA, 978 nt, Mus musculus
uuuuuuuuuuuuuuuuuuuagcagaguacgcugugguaaaccauggaguucguguuguuuuugccgaagucagugcugugugugguuucgguacaccgcucgggcggcuguugaaacugcugugguuuccacauaaggccuacugugccucuccagucccucagcuagugcacugggggcaugggccaggggugccaugcccacuaugagcaccagccugcaaaguuuuuguguaacuuuuuuguuguuuguuauugugagagggcucucacuagcugucucagagccagucccuggcuggccucaaacucagagauagccuggccaaaaacuguguuuuuuauuauuauuauuauuacauuauuaauuauuauaguuaggagugcacucgccucuucccucgguguugguuuacuauauuuauuugcuucuguguauccuugagucaguggcauacagguggagucagaaacugacgggaguugguuuuuccguuguguacauuuuaggaauuuaccuuggguuaucaggcuuaggagcaagcaacucugucuacugagccauucaacagucccuuguuuugucuuuuagauacacccucaguaugucauccauacuguccuuagacuccagauucccuccucagcaguuuuuaguuuauuccaauuccuucucuguggccauuucuccaugcucauauccaaagagccaaaagcacugugaccuugcuuccuacaacugggguggacagagugacuuugucacacugagaaucaacuccaccucagaaaauagggaaagcgauuacagaguuagcagaagugguuacauaaaagcaggaacuagauucagccuuaacaauacagccaccaaaaauaacucagggugccaagucccaggcucaaaccagggccaugccaaccugcaaaugacagagaccuaaagugccuguacgccagcacacacauaccaaaaaaa

SEQ ID NO: 4533 - RNA, 14687 nt, Mus musculus
ugagcggcgucugccggcgcgcccuccagggcugucccgcccccugcccgcguccggcggucguccggcgggaaggggcggccgcucgggcaggauggcggcggcggcaaccgcgggucccggcgcgggcgcaggggucccgggcgcggguggcggcggcggggcgcgcgagggugcgcggguggcggugcugugucuacuaugguacgcgcugagcgcgggcgguaacguggucaacaaggugauuuugagcgccuucccguucccggucaccgugucgcugugccacauccuagcgcugugcgcggggcugccgccgcugcugcgcgccuggcgcgugccgcccgcgccacccgugucgggccccggacccggcccgcauccggcguccggcccgcugcugccgccgcgcuucuauccgcguuacguacugccgcuugccuuuggcaaguacuucgcgucggugucggcgcacgucagcaucuggaaggugccggucuccuacgcgcacaccgguaagugcugaggcgggcuuugcgcgcugucuggggcuucgaaguguggguacgagugcgcgggccgucugacugagacgccgccaaggugcgucggauucucacguuggaaaaggucugaggaguuuaccgagcgccuagcagaauugacuccagcuauugggaucgagaggaagccuuacagaaggaagguucagggucgggugugcagguugccaggacugcccacugagugccuuuuccucucuugcagucaaggccaccaugcccaucugggugguccuccugucccggaucaucaugaaggagaaacagagcaccaagguaacucuggcagaagcccugggcuaggcgggauucccaguagcugaccagguugaugacgugguuggaccguggcauccuccugcuuccugucaaauaaggaagucaaggugucagccuuguccuguggcuagcaccuagcaucccgcacucaccuuucagacagcagaugugugugugaauggggcgauaucaccacauaaucucuugcuuguugucccugagcgccacaucccucuggcguccacuguucuuuucuguuaugauuccgacucugggauuggugguaggugaugucuuugguuccauuuuagcaagucaccaacaaauuaaguugggacaaguuuuccuucucuuauuuuauuuucuaauguuuauuuauguguguguguugugcauugccacguguauggaagucagaggacaguuuucaccuuguggauaccugggaucagauucaaguugucaggccugguccugacgaacuuacaaacuaucauguccuaguuuuucugucacuagacagaaugguugguagggguugucuggaucugaugugaguaggccaaaggaguuugaccguggcagaaucuagccaguuuguagaaacuaaaacuuuacaaagccuggcauggugccaugggucugucuucccagcacuugagaggcagaggcaggagaauaaggaguucuagacacacaccuuuaacacagcacucuggaggcagaggcaggaggauuucugaguuggaggucagccuggucuacaugguaaguuccaggacucuguagagagacccugucucaaaauuaauuaauuaauuaauuaauuaauuggaagaaagaaggggcaaaagaaaauaugguuguagcucaguguggagcccuugcuaagaacccaaaggccugggguucaacccccauuuugaaccaaggaaccuuggguugugauuaucuggacauggaucauauauagcacccagagcucagagcugcccagggaaggugccaagccagguguuuucuggccugggacuaaagaacaagcucacugugucgugugcaguagggaugccacuguucggcuggaaaccaucgaaccuuguacaagugcucacuuuccugugcccuauaauugaugcacauggaucaaugcagaaacuggaccaccucuggcugaguuuuguucucagacccaacuuuauccuggugagccuugucggcacucugcagucccugccaggaugauaccagguaggacuagccuccuggggggucagaguugcuggggaggcacccaggugugucaccugauagcacaccuuguguuuaucaguuuuccuggucacuggggauauuguaccuagcucagggccucacaagugcaggaucuggagaucagcccucuugggcgacuugcccugcaaagcagaugggucagucugggaauccuuguucucaggggaagauguaggacaaagaaagcgggcuauggccaggagugcagggccaggaauucaagucccaguggccacugcccuuuugcuccugaaugcugcuuuguuuguuucuauauuuauuguuuuauggguaugugacuacacacggaggucagaggacaacuugcaaaguugguucucucuuuccaccaaagaguccuggagauuaaacucagucaaucuuugaggacuuuccagcugcugagucaacuaacuggucuuccgauuggguuuuugauacaaaaugucacuguguagcccaggcugaccuaagacuggaaauccucuuggauuuuugccuuguuagguuucguuuguuugguguuuguuuguuuguuuguuugauacaggauuugaaauaacucaggcuagcaucagccuuuuuuccauuuauuuaucuauuuuccugugaacgugucuaucugccugucugucugucugugucuuuguguguggugguuagaggauagcucucuuaccauguggguccugggcaucaagcucugguuguuagacuuagugguaagugccuuuaucuuucagccaucucaccagucccagaccugaaacucuuaguaaucuuccugccucggcuuuccgagugcuagaaugcugggcaugaagcaccaugugaggcgcaggcagcauuuuccaggguagagggugcggucccccagguggggcccugagcuuuccugcgguucugaaugguggguagccccagcccaccugagccccucugaccuccugcagguauaccugucacugguccccaucaucagcggaguccugcuagccacugucacagagcuguccuucgacgugugggggcuggucagcgcccuggcagccacgcuaugcuucucccuucagaacaucuucuccaaaaagguguguuggcccugucccuggugcaagucgccccagggcgguggcuucaagcagacuggccagagcagcccuuccuaugcuuacugucugccugagucacuaucccuuguuuuauuuugaaaacuaacccuaaaccuaaccuacccugcuaucucuuguuccuuuucuuuaauaaguuuucuugcuacauuuuauuuauauucgugcucugugugcaagggcacuugccucacggugguggucagagggcaacuuaaaggaauaaugugggaccuuaacugaggucaucaugcuugguggaaagucuuuacaggccuuuacccacugacccaucucacugaccccuccauauuauuuuccacuaaaccuggaacccaaccuguucauuucccaugagccccuugccugcuguccccaccaccaagugcuuacauuacaaauaugaugccauggccagcuucuuuguggguccuuguaccuccuuucccuuuccagggucuugcgugugcugaaccugcucacaaaccgaguugugcucauugacccugucuugucuggccaugcgcauuggcuguugcuguguggugucaccucacugcagaacucucggucaugacuaaggcucagcacuaccuucagcacuguggguucacuuguugacaauacaggaaauauuuccuauauuucuuaugaacaugcuguugacuggggcaucgccuugcaguaggccugaaguccaugguuugggaguaguaggaucuguuucuggcauugccugauagugcucaggcaggcuaagccaaucuagauugcauucacagggauuucagccccuuccugucacgagcuuauuugggaugaugacaaguuuacucugagugccagaccagccugggcuacagagcaagacccuauuccaaaaacaaauggaaaaaaaaaaaaagagugggguugggguuucagaguaccuggauuacuauacccuccccagcauguuacuggguugguccugguuuuucucugucaccuucucauccauaggacagagcgcuuugucuaggcauggcuauguguuccuuuauaagcaagucagcuggucugagggccugagcucggaugucggaauccagucuuagguugggaacuggaaacgcagaccuuaaugcuggagugucaacagcucuaacaaggcacucuccccucagguguugagggacuccaggauccaccaccugcggcugcucaacauccugggcugccacgccguguucuucaugauccccacguggguucugguggaccucuccaccuuccuggucagcagugaccuggugaguugggacugcugagacauuggugugcuuuugccagcuucugcagcauguacuggguuggaagcuguagcccucuuguccauccugaggcauucuuuggccauccgugccagucuauuuucuguuccuguaacaagguaccagagacauaaguccugaccugaguuguaagaaagugaaaaucuuuagcucucaguucuggaaaacaaaaguccagcguggaguggguucuuccuaggguuccugccacauccugucauacuacaugaccgugacaggagcauaugugggagggagaaguuggucucugaauaucagccugagagccagugcuccugcuguccugugucagucagcuuucgggcacuaugauuuuuguuauagugccuaagguuauugcuuuggggagaggaaauguuuaucuugguucaggguuucugucuuuaugugcuugguccugaugcuuugggucuguggugggaguacauaggugacaaugucacuaaagacugguggagcagcugucuagaauagagcuucagcauuuagucuccuuaauucaacaaucugaauccaagugggcuaaaacccuaaauccugugaguaggaacucaaguucugggaagaagaggcuggcccacugcagucuuauauacaagcacuuuacucuucaguacauaugcacacgugcauauucauguguacacacucauaagaacacacacacacacacacacacacacaggcuugcauaugugcauguucuugcuaguguagcacuggucagucuggauguaacuguccuccaggacuuauguguggauccccccucuaaaaguuguuggugguaggaccugguggagguacaacuuaggaggaaguaaggaauugggacauguccuuggaggggaccucucucuuccuguuuuacccugccucugcuuccuguugaugaaaucaccucugcuaaaagagcuuuuugccaaauccaagaaguuugggccauaugguccugaacugcaucucuagaacugugauuugggacuaccuaugauaggacagcacuugcccugaccccacaagguccaggcuucacucagcaccacacucagaagacaagaugagggucaggaauucagucauuuuuggcuacacgguaaguuugaagacagccuagucuacaugagaccuuguuuccaaagagagcugacuguuacagucacaggacaugccuggcaaaguggcaccaugcugggaauggugagaggaugcaugggagacacaggaacccugagaggaaacccugaaaguacacaggggauuugaaggaacuugggaauccugggaauggcugggcaggaggguguugguagaaagcuaaagucuuuuuuugccagggcggggcucucaggagcagagcagcaucccaggugaccccagccagccucugucuaguaccuuggauauuuccagcaacuuggauaugacaauuccuaccccuuagaaagcacuggguuguuuuguuacaggaacagaaagugugcccauuuucugcucugugcaguuuucuuucccuuaccuuugggguguguguguguguauuugcgcacguguguaccagcaguaugcagguggaaaacagaauccagcuuccugcaucucccucaauagcucccccuugucuuuuugaaguaggaucucacuaacugccuaggauggcugccuggcccucuuuaagaucugccaauuucugucacccaagcuuccugccucugcauacaugcagcuacacccacauuuuuuucacaugggugcugaggcuuuacugaucagcuccaccuuuggugcuuuuaagacaggaucuauguccuguaauagguagccuagggugucuucagacuccugaucccucugccuccaccuccugaguacuagaauacaauguguccuccaugccgggauuggaagccaauaugauuugguagacucuaugguucauccuuuucagacuuccuccaagauccuucccuugguggccagcugauaugccuguuaaccaccaugucuaacaaagagccagcugggacuugugguuuccacaggaugacugaggacuggcagcaguccaggaaguugggugugaguugagaucugaggaagcugaugcccagggccuccuaguguccgagcugggccuuuguguucuccugaugucuugaggauaggugugcucuggggcuguguuucacucucuagaagcccugcccaccacugauaccucucgaagaaaguggcaguaguugauaaugucacccauauccuuggcuuugucugguuugauguuuucacuucuguuuugugugggguuuggagcugaaacccuuggcuucaugcaugcucagaaugcuccgccuccaagcuguggagauggcucaguggggaaagugcuuguugugcaguugugaggacagaguuuagacacuaggaggcaggggugggauccccgcaacacacugugccuugcuccugccagacaaacuuuuuuuuuuuuuuuuuuuuuuuuuuuuugguuuuucuagacaggguuucucuguguagcccuggcuguacuggaacucacucuguagaccaggcuggccucgaacacagaaauccaccugccucugccucccgagugcugggauuaaaggccugcaccaccacgcccagcucacacaaacauuuuugauugccuuuuuaagaaaaaguauuacauauauguuuggguauucuaccugcauguaacaugugugccuggguacccucaaaagucaagagaggccauugggcccgcugagacugguuuuccaggugauuaugaucucccauguggguucucugggagagcagccaguggucuugccugcugaacugucugcaacccuuggguggcugguugugcaucucugacucgggagauaguacucagccaccgcaucaugcaguggggcaguuaggaggguuagaggucauguguauaaagcauaaacugcugaaauggcucugaggguaaaaaugccuguugccaaaccugccgcccaccaguuugaggccaaacaggacugcaugaaacucuguuucaaaaaaaguaaccaccugcugcccaugguaauaaucugcccgaguauagaugugccccucacccacugaugcccccuguccaucuucacaggccuaugugucucaguggcccuggacgcugcugcucuuggcagucaguggcuucugcaacuuugcacagaauguuauugccuucagcauucucaaccucaucagcccacuuagcuacucaguggccaacgccaccaagaggaucauggucaucacuguuucccucauuaugcugcgcaacccagugaccagcaccaauguguugggcaugaugaccgccauucugggugucuuccuguacaacaaggugagcauugggugcuacuguccccuagcaggcacacccuugggacaaggagccaagggaaagagaggggagggauuucuagcuguaggucccaagggugccuuacaggguguguggguuguacgugcuagacagaagaguguggcaguaggcgucuaagcacaggccuucuagaacucacuauccuccugccucuacacccugaucucuagggcaaucggugcagaggccagaagccuucuuugugucuuacuuguuuuagaacagucuuguguagcccagaguggccuucagcuucugacccccugcuccaccucccuuggaguagaaugacaggugucuguaucuguaucuguauccugguuuauguagugcuggagauggagccucgagcauauaucuuguagacaagcauucuacuacagaagcaucccuaguccuugguuuuagggugaccuuuuuuaugcugauguucuucccuccccuccccucccggugacuucucuucguuuuuuuuuaagucucauguagccuggguuggcuucaaacuuaccauguagcuagccuuauacaccugcccuuccugacucugccuccauagagcuaggaugacaugcccccccauacccaaaguucccuugugcuuuucauugcucucuucacacagaccaaguaugaugcgaaucagcaggcccggcgccaucuucuucccaucuccacgucagaccugagcagcagagagcacuugcggagcccaguggaaaagccccacaauggugcauuguucccccagcagggugacuuccaguaccgcaauauccuccucacagaccacuuccaauacagccgccagggccacccaaacuccuaugcucucagccgacaugauguauaggccaggccaggccuucugcacccccuucuugagcucagaagcuucagaauauucuggcagccugacugagcacaugacacuuggugggccaucaggggagcucuggguccuggccccuggccccugaugggcugcaggaugugaucauagcauggacacccacaaacucggggcagaaaagaaccacagagagacccugguuuacgccuccacuaagaggccacucugcauuuguguacaggguugucccuggcauauuacagaggucugaucugaacuucuggugagaguagggacaugcucuacagaacuggcaccuccuggcugcaauccuggaagccaacaggagauggcaucugggauaucauggagaggacagcugggauacagcccagaaggauggagggcugacauggguggcauuaccugaucccaccaaugauacagagcccuagaauaccccaaggcaguuggccacuugcagcuagugcugcccaagggcagacuuauagugaccaucagcccaucagcugugaccuuccucugccuugugggugccaaagcagggccuggggggcccuuggacucuagaggagcagcuugucugcuccccacucuccugauggcacagaaggccaaggaguggugaugacaguuuccucagaaccuaaguuucucuggggaacaucuugucggccaugggauggaaaccaucuugucucauuucaaaauaugggauguuuguugcuggagccagucccucccaggucagugguagcaggcaaugccgaaggguacugaaguugcagccacagagguagaaggagguauucauacccgaguacaguguugcuugucagugaggagaccgcauguguaucaggguuuuaacugugcucuggcaaaugggacaccaggcaggucuugguuuuuuaguuaagaaucacuuugaggcuggguagagugccugucuagcauucgugcagccuuagauucuguccacagaaugccacgcagugguacaggccugccugccuuccuagcacucuuaaagcagauucaggaggaucuagaggacaagguucucuacaaaguaaguuccagaccagccugggcuucaaugagaagcugccucaggaaaaugaucaguuuagggaccugccauaguggcauauaucgaggggcugaggcaggaagauggccauggguuuaaagucagucuggguuacauaaugagacucucucugaaaaaguugaggggcugguggcccauaccuauggucuuagguacucuugaagcagaagcaagagacuuccccaagccugugagcucaaugccauuguggcaauugacagcagguaaaugauaggaagggguaucaaugggucucaggguuuuuugguuuugagagagggucuuauaauauagaccaggcugaccuugaacucaugggauauaucugucucugccuccugagugcuuggauucuuuaaaaccaugggcaccacauccagauggagucaucccacuaagccucccaggcugaccuuagcauuugugccuccucuguugcuaagaacugagcucacagguacaucauggcaccccaguccuuaacuccugauuuguugggucccucugcuuuugauuacuugggguuuuauauugaagguuaggguuuuuuguuuguuuuguuuuucgagacaggguuucucuguguagcuagcccuggcuguccuggaacucacucuguagaccaggcuggccucgaacucagaaauccgccugccucugccucccgagcacugggauuaaaggcgugcgccaccacugcccgguuuaucauauuagucuccugcuugccugagacuuggcacccccggccucaggacagucccgucugccuugccuaguccuagcugguuugcagaagaagucccuugguaaggccgucuguuggguucuccucacuggggaaggcuggccugagacaccugucacugcagaggucucuaugggugacccugacucagcucuggacucagaaugaauuaugucuuuuaagauuaccaagauguuccuauaauuuguguauuaaugcauuuuuccuuuuucagggagcaaaauggcccgucucacuuuucuuaacgguuuauaaauuaauaaaugggauauuuaguucuguucauaggcucacagcaaguaugaacacuggaauggaugagacaaucaggguagaccagauucucggaucaaaagacaaacagcuggggcugccgcucuggcuacagugcuuaccugcaugcaugaaguccuggccacccucagcacugcauacacgaauguuacuccauuacucaggaggcugaggcaguuaggaucaggaguucaguguaacauagugaauuggaagccagccugggcuauaugagagcaacaacaaaacagacuugauccacaguuuacaucuguccauucaaagucacauuagcccuacuccugugucuuacaucccacuacauucaccucucccucuccaggacugacccgauccaccucuguugggguuuauuugagaauuuauguugcuguucccacguacccuuugaaauugcuuagccaaaacgcugauccugaccuacccagcuccuucauuuuacagaagaagaaaaugaggcuuaguggaugucuucucacuauuagugcacuuggagcuuuuauuuauuucuuugagauaguaucugccuauuuagaccaggcugaccacagaauagaaggcacuccuccagccuuagccuccgugccuggaggagcugccauacccagcaccuuaauuuaugucauuuauucuagggaaacccaaaacuuucuugacagaguagaggagccagaugaacuaaggcagcaaaauacauggaacuugauuucucuguauguugggaggacuccaagcagugagcucuucauggcuagaccccagccccaaaaccuugggucugaaacaggaaaccugucaugcucuugcuuuccauugucaucuugaggcuccugugucauagacuguacuaugggaguagcugugcuccugguuggcauuuaccaaaaauaaaugguggucuccagggguuggaguuugguucugguuugucagggagggucuugcucugugcucccaucaggacaacccacaaaaauccagggcugggaagauggcuuggucagccuuugacuggcagauauggaaaucaagaguugggaucucuacaacccccaaaagcugggcagauccagcuccaccugccauccuagugggagagucagguaaagguuccaggaucaugggcaagagcuuacuauuggccagguucauccugaaaccaugccuuauguauaagguggagggccagcaagauagcuaaguagguaaaggcaauuacugcugagccucaaaaugugaguucaauuucuagaacccacaugguaggagagaaccaacuccuguaaguuguccucugaccuccacauuuguguuguggcaugcacacacccacacaaaaaauuuuaagugugcuaggcacagccuugcacaccuuuggucccagcacucagaaggcagaagcaaguggaucucagaguuugaggauauauauauagagagagagagugagagaagcaccuacacacaaacaagcacaagugucuacacacacaaaucacauguguaugcaaggcaaaaagauuguuuuugucuuuuuuuuucaugccugggugucuaacgaacuuugaguguauuugcaugcgagugugugcuuucauguguguauacaugugcauaaguguauguuuguguauaaauuuacuguugcuguggcuccuauagcaccucuauggcuucagcuaccuuaugcugcaccaggauucuguuccugcaagaguccagguccagcuacacuccuaaaggccagucagagcacccauuucuauagcuaaccucugcagcccagacugaccucuauugauccuccgccucaggcugaggugcaaauuuccuccuguauacuuggaggcugggccagugagccccauggcuccuccuccuccucccuccccagcucuggcaugaauaugcuucacuaccccuggcuuuuuaugucuucaugccuuuguagcaagcacuugaccucuauaaguagcugggcaacaacaggcaccuguacauggauguggaggcaagaggcuagccucauguccuugugugccaauaggucugccaucuuacuuuuugaagcagggucacucacugaaccuggagccccagucauccuccacucucaucucccacagcacagauaugacaguccuauccaguucuggcuuggggggggggggguagaauccaacucuuagccacucagcccagccuaacaacccuuuucauuuuuuuuaagguuuauuuauguaugccaguacauuguagcuguacagaugguugugagccuucaugugguuguugggaauugaacuuuaggaccucugcucguucuggucaacccugcuugcucaaucucugcuugcucugguccaaagauuuauuuuauuauacauaaguacaccauaccugacuucagauguagcagaagagggcaucagaucucauuacacucgguugugagccaaugugguugcugggauuugaacccgggaccuuugggagagcagugagugcucuuacccacugagccaucuugccagccccagcccuuuucuuucuuucuuucuuucuuucuuuuuuuucuuucuuuuguucuuuucacucacuuuguagaccaggcuggccucaaacucagaaauccgccugccucugccuccggagugcuaggauuaaaggcgugccaccacgccuggcugcccuuuucauuuuuaaccauuuauuuauuguaugggacgcggggaagguuacacauccuauggugcauguagaggucagaaggcuacuuauaaaagcgaguucucccacuaagucccaggucaccacgcuuaguagcaaguaccuuuacccacuaggcaaucuugcuguguuaagacaggccucaaggagcucaggcuagcuuugaauucacuguguaucuucugucucugauacugguguuggccacugaacuggagccaugcccuucaguucuaggaguuauguggcuggcugucaaaacagcaggagacccuggaccucacacaugguagggaagcacuuccagcccuguauuucuggcugcuuagguuuccucuguauuuuggaggauucugugagcagucagggaagcuaccacagugaagggaccaaaugcaaagcuuuggucucagccucaguguaugauucauucagacucccaaaggggcucaguagguaggcaagagccagcugaggaacacugccaaggggcuugaggggcaccuuaccuaggcaggaucuaguugcccagccuuauuagggagguggcaagagauggggccaggugugggaggggguguaccuuuaaccccagugcuggggaggcagaggcaagcaggagcaccucccucaacaaauaaaacagaagaaacuucuaagaauagucacccucugaauguucuacuggcccucucauuuuguuuuggucuuuuugagacaugguuucucuguguaauagcccuggcuguucuagcuuuguagaccaggcuggccuugccugcccugccuuagugcaagaauuaaaagugcgugccaccaccac

SEQ ID NO: 4534 - RNA, 12568 nt, Mus musculus
cacuugaggcuguggaagccgcgugccuggggcguagacagggcuuagaucuuuuagaagaaaagaaaccgauugcgguaaauccucuggacuacgccggguccucggaagcugugcgguaggugucaauuuccccucacagaccaaccgagagaaauccaggguuaagugucuccugcgacagugucuuaagagcucagcugaccgguacgaugcugggcaaaaccacgaaggcaggacuagacuuacaaaacucgauucccaagaucgugugcuuuuaagugagggagaauaguuguucgcgcuccuuaaaauguguucauuuauggaggcgggcacgagcguguguauacacauauugaggucagacgaguugagucuuuugucucuuuucuaccaugugcauccaggaaaagaaacuaacucuggcagcaagcguuuauuugcugagccaucucgccaaccucaauauucuccuuuacagcgucuccuugaaugccagggugucuuucuaccucaccuauguuuugguuugcuuuucucuguguaacagauuccuggcugucauggacucgauuuguagauuaggcuagcuucgaacucagagauuugccugccuccgccuccugagcaccaugcguagcuacucacccguucuucaagguagacuguguuguacccugggguuugcuggauacucaucacacauguggcaguccuuguggaucugaguagaaaauggccuggucccucccaaagcaggaguuuaagaauauggugauaggacgcugggcuuuguacccuaaggccuuugucacaaacuaaauacaagaggaauuaggaucuuuggacagagcagugucagauggccccacugauguguuuugguugcuuuuauuucauauuggauuuggcccuggcaacucuggaagcuuuuucauuucacaacagguacauguacucagggcaacccagcugugguuucaccuccucaaauggcccuguaauggggaguggggccauucugcaacaaaccucagaaauuccuacuggcucugaaacggguucuggguuggcuuugguaccaaccagaccaggagguauguucuaagacuuaaaccaugaagcugcuguuuuaugaauaacuguuaucuuugaaauuaagaagauauggaugagugaaaaaaaaauacuagacaccuaaucuuggcuuaauuguguaugugggagagaggggguagaucauuacuauauaacgaaggugacaucuuaguggacaccugucagguauggaggcagccuugggucugccugcagcugcuagcccagggcuagggccagaaaauaguuauguacaucugggccaugcaaucucccugaugggcagggaagguguacaccaugucacuaagaggcuccucuaggugggugaccaaggggauguuguugaccaugaaucaaugaaaagcagauagagaggcccugccugccgcuacaaaauaaagcuaaagggaugucaccaaggcuggcauaguagguauggaugugggcuccaggcacuuaccccuguaggaaaggccagauuuagcuauacaugugcaaaugagaaaugauuccaaaacugguuugugcaaauauuuuuuuuauuuccacauuuauaucacaaguuguccacuuacuggaccaaauagcaaaguugcucccuucugcgcgaacacagaagucuagguacuguacauucacuaaggcuccuuguuuuugcaaaucgcguuuaugaccauaaggcaaacgaaucuaaaggaaugguuaugaguguuuccagccaacagacggcucuucccuagcccaccagggcaacucacaccaguagcacccucgggaacuuuguggguuaaagacucuagaaagauggcauuuuucuagaguugugcagaaaaggaaagaagggaaggaaaagucauuuggcuggugguaggggaaaaaagagaaugaaauaaaugagaaaacucaaguuucugcagcauuucuuuuaagaacugggacugaacugaaaccauauacaaaugggcagacgacugugcagugugggugaggcuggcccacccacacaacaccaggguucaccacagcagagaagcuuccagcgcacaacacgagggcgacaaaaaaaaccacuggcucgagaguagccugugccucagagacaccagggccaaagagcaagagaugcaaagaagagaugugucuguugcuguuaagguaaccucuuccacaggguuccugugccugccugcuacugaggucccugccuucggugcuuagagugguucugcaccucuucugggaugggggacuaacgcuuuauagcuggcuuacuauagauuucagccaucuaucugccccucccccgagcggcccuuccuuugcaaucguuaguaaacugguagcagcauuucacaaaaggaugguggagagcgagccucaugcucgccuucucagcuggccagccuaacccuugcgaggugggaaugcacaugauggccaggucaggugcucaguccaagcagacauaaggcagaauguucaagcgcccaucgucaccaugagggucgagcgauauacacuguguccagucauaccaauuacccugugugucuucacacccguuaaccccuggccauugcugggccuggauucuguccagaucauccugcgugaccucacgugugagcccugguaggucagugggugugggcagugguagcagcacauggggcugccgggccccuugccgacugcucuccuccugcuucagguauucagccauaaaguggugcgcaccuggggucugugcgccugaggaggauagcaagcugcucuggcggcucagguaggacuguaugaucucauuucgugauagcuccuuccaguucgucugcucaaaagggcucuggaggcuggccuugaccuccugcugcuccagcucuguccuaggcagcugcucuguggguacugggcugucagcccgcaccggcucuuucugggucagaggccugaucugucuugucauggggucaaaggugagcuuccgcucuuuuaaccgcacagguuuaacaccagccucagccaccugcccguccaaguucacuguguagucucgaggucgguaccucuuuuucuuuuugcuguccgagccacccgaagagguagcaucacuguccgccuuggaggaaucuggagaaaauccagcccugcaggcuggccccguuagccguggguggcccucagacugcucuggccagugcacagggcucucagcauuaggcagcagcuccugacggcgcacagggggcguggguggcugggccagcgggaguggggaugguaccugcguguuguccgguggcuggggccauggggaagggcuggacaccuggcccuuggguauguaagagcuccgaugccgugaaaaggagccuucgugccgugaguuccgggggcugaaggagcagcgagaggacccccugggauagggagggccuggggacucaucugcccuguccaacugcugcaacugugcagccuuggucugcaggcagggaacuggggguuugcccaagccgggagagcuggggcgcggccgcacggcguucacgggaaucuuggugcugugcuucucauuaucacugggcuccaggcggcugccaucagggcccaagugcccacugccauccagggggcuggguaagcucucugggcucccgcugaucccauugguggggagaggggaugcauugggaaccagagggucaggacugccuuuggaaacuuugugggguggcccuggguggcccaggucacgcugguccccccugcgcuuacggcugcccagccuaucuagccguugcccagggagccuuuggaugucguugcgauucuucaggucauggaugcucuugggugcaccagccacucccaucucuggucggcaguugugcgcacccccauuggcagagccugcagcuccugccagugcccguagugccacuucguucugguguacaggcucgaugagcuucugccagcuucguagcagccucuuggcccgcuuggccagcuccucauucuugguuuucuugcggacaucauugaugagcuucccuagucgugucuccuacaagagagugacauacuuuuacaaggggccagcgucuuggauauaguuuggguauguccagcacuguggcagcaaugaaucuuuagaucugggacucaauggcuuucucagaaacaggucuaccgguuccaggugccuguagacucaggugcuaucaagaccacaaauauaaccguggguggcccuaccaggaugucugggugagcacauuauacagccuaagacuuccuacccaaagagagggcaguaccacuaaccaguugucuaaagcacaguucaggaaggagcccaguugugagauuagaagccuccauucuuggagaguugaguaagagccuaacccacaggaagaaaagcugucuggggcuaccuuuaccucccauuaugcccaggguaggggcaagggcucuuaccuccagugccucuuuggugaugggguaucucuccagacuggagaucacuuccaacacugccaccauguuccggaucugaagaaaaagaaccauguaucagcucagggcucugccuucucccauggaaagcccagcagccuagggcccugcaagauaccagcacuaccaaaaucccuauuacccuuucccaggguucagcauuacccauaugcaggcacaccccacugccaucagggugcucugcugaaggacauaccacauaaaacacaaagccucagagaaaaggaaaggaaagauaggcacaauaaccagugaacccgaugacuguaucaaggucuucauagagacucucaagaaagcaagaugucacaaacuauaagaucuguaugucacauggcuaggagggccucuggaacaccaccugagcaauaaugcagccccaugaaaccagaugagagaaggcccgagacacuaagaggcucuguacacaacaagcagggugaggacuagugcugagcuucauggugacaggaagcuaaugaucuacaggcucacauaugggaucccacucuaagccagccuuuccacugggcaggugccaggauugucauucuggaaagaguaggacuaaaaagcuaugacugaugugacuggacaucccagcagcacagccacacacaguagcaaagcaugagugggggggggugggugaagaggaguuuccagagcaagaggggacaaagcaagaugucacaaacuguaagauguauauauauggcuagugagacuagccauauuggugagcuccagguuugauugagagacccugucucagugaucaggcggaggagugagugaugauucccugcaccaacuugagcugcccuuuaugcaugugcacacauguauuccauacacauguacaugggaaacuacuucaaugaaccccagacagaaacauggaaguugaaaguaagcucuaaaaugguugcaggagaggaucugcaguugugggaugauagauguuccugaggaguucagagcacagggcagaguaacauggcacugcagguucuagguugacaagcagucaggaacuguggggguggaguuuagacagaauaccaacaaagcugauuguccauagcccuaaguccucucuaucuuugugccacaugucgaaaggguaugaugauaucaccugccacacuggguaacauggaaaaauagucugcaacccuaccgacuguucaugaggaaccgcccagcuccagcacuugggaggaggugucagcuaguagcccccaggagguuguuccaugugacauaccacaagcaaccuagugaccagaagaucgaccuucagguuuccugcugcugcccugaucuauguuggcugaaucccuucauguuuugauugucucaccuacccauagccuagggccagagagcugccuccuuacuggagguucuuggggaugauccauacucagagagauaccaacagaauucaaguccaggucccaauuuucuuacuggcugucaccuaaaaugcugcuccuagcuucaggaguacaucaugucccuguguucccagcccucuaccuaccuucaauaccagccccagaauccugaucauguauagcccagaauuguuccuguccgcaccuuagccaugucuugucagguaagguaccaggccuagguugguuuccagacuaggagguagauagccuauaggccauggguaucccccagcuuuucuagucuguccauuuccagcggaaggcagucaccaugucucucuugcuucagggcucugccuccugggagagaagcuguacugagaagagagcagucagcagcccuuguacugucgcacagcuuucacuaagccaucccucugucaacaaggcaggcccuuccuugggaacaaggccuuccacaugugauauuuccucuggggcuggggcuguaaacacauccagauuacaacauugguccugcugccccauggauggguggccuaccuagagacauggcugucguacucaccucugaaaugggaugggcagggauuccaugcaaagagugugcaaugaggagaucauuccuaagagaagauaaaucaaguguucccuggccugggaucuuggugccacugggcuccugagcuccauggcuucaucuccaucuagugaccucacucugguauauuuagagcccuggguccccacauacuccugacccagcaguccuugaugaaaggaauuugcccaagccccaauggccuggcagcacagaguguccuuguccuaggacagaaaccauucugcucccagacaggaagaggggacagaacaccuaggggaaccagauauuggguuggugcauaggaaaacacacacacacacaaaugcuaagcugugcacagaccagccauagugccuucugggguuauauggaucaaggucuaagggccuugacuaaggggccacuuuaucagugugggcuuccaggaggcccugagggaaaugccauauccuccguguucuccugcagcuguaggucauucaccuaaggaacugccugccacacuuacaagguccacacugcuggagccacacacuggagccaguguaaguagaucaaccaucagagcagugagugaguuaaggugaaccuaccugccuagguaaaaaaaaaaaaaaaagcaaggaagagcuagaagaagugauaugggcuggcagguaggcucaggugcucuaccacuaggacaaagcuguuaaggcuaauccacugccaccaucauaacagacacccugucuuuucuugguuguuccucuuaccugcaugucaauaccuacccacucaucuccugaaugcuguucugacugccuggggagcucuuggcagugcucugccuuaagugcucugcccugaagacagcuucagggcaggucuguagcucaaaguccuaguugcaggccugagggccauuuacaaccugcugcugucaaaaauagccugguucuuuucucucuuugggacucauucccagugcccaaauauucccaagcacccugccaaaugguuuucccaucaggagagcuccggcaccaggccuugagccauacacuuguacauagugcugccugaauagacacagaucuaucuguauuaccuuaacaagcaguauggccaagcuugccuccccucccuucuccaucagugacaggcucuacccauucauuugcauugcuggacaucuaguguuguagugccugccuguguacaguggcuccaauggagaggcuuauuagcaguggccagcagaggcacuaaggaagcagguggcaucucugugggagccacacaaaggugugucaaggaaccaccacagguccagauggaacaugaauauucaugauagaggaagaguguagaggacaaagucaggccaaugggugcaugccuuagggcaucuaaggagacaucuccuuuguccuucaucacucuucuuccugguugccaugagaugaucaugcucugccacaugcucccacuucaauguggcaaaccuaaggggcaugugcgugcgugcgugcgugcgugugugugugugugugugugugugugugugugugugugugugugacucuuuccuacuauuaaauugauugugcugggcauuuugucaugguaaugggaagguaacacccuaaggccuguucugaguauuaggcgggaaucuaccuauauacaagauccaagggcucaaaaagacccucaguuucauucccuauuaggccacagccugugcugacucaauuccugcuaggcaaauccaugacaucugcagcucaauucacugugagucugagaagagaggcaagccaggcagaaaacaccaggucuggcacugcugagauccagacauggugaauaacacuccucagaagcagugacuauucucucuacuaguuacuauucccuuuuaugcuuaaauuuggcucuaggagacuaugggagguggagguacaaugagugcuuuccugucagugccuccagggcuggggauagucagcaagacuuccuaacuuaacucaggguacaaggccuuccaucuuugcagacuccaggacucauagaacccugaaacucccccaccacucauagaaccaggagacucauagaacucuugaaugcucuuagcugcuuugaccugagccaaaaaguauuauacccuaggagauaaggcacugggacagcucaccaggguucaacuccaggcaggccuccugcauuccucugacuggauccacagagucccaagugggauggcacuaacucaagagcuagugugacucuucccuaacagaggguggcuacccauggggaauuugcugccacaagcugaaacagggaaccaagacaccaaccaaaucuuaagaguccuaguauccccucaggucaucucauacauuggcuugccauacugugaagugggagcauguggcagggauaccugcacagucuuggccagguucuuggggccaggcacagcaaggaggaaucagcaaacugaguaguaaaggagccaucauuucugauccauaggcaacaggauuucaaauauuacuauugugugguacauaaggcaagguggaggaugccaaaguugggggcuucucauagaggggugguguaaccuuguccuguggggacugcugccugcccagcacugccuccuaccauccucuagcagugaaggcccauucacaucuagaaccagcucacaucucugaccccucuagaggaccagacugucuugcaaacucuguucacagcaaaggcuuagaguccucuuuaaaaugaagcccagcaggagaaacuggauaucauggugaaucucaguucugugaguauaucagcaccaccagauuccuccuucccgacugugcucauaaacuccuggggccugagaaaugacuaccuauggggaauuuucagcuaccagcugaaacaggaaaccaagacaccaagucuagucccaguauccccacaggucagcucaccacucucuuuuucucuccccagcuaaccaaaauccccgacgcuggcaguugccauuguuccccagaggcauccacacuaaugggacccaaguauugugcagcuucauuuuacagugaggaaacucgguguaugcaggauagggaacucuacauggaccacagaaggcaaaagccugcugcuuuccugugcaggguggaguguacuaaguuagcauccugugauguacuugccccagccagcaacagcagagaagcacacagguaacacagcuccuugaaguuggacccuccaguguugugucauuugccuuucuuuucucaaggguuguugaagaaccaagaccagguacauuucagcaguuucaugcccaaugguauccugaagcagacguauacagugauggccugagagucaucuggccagugcucccaggcacugccugccaguagccccaaccacaucugugcagcacaguccucaggaccuacaccaacaucccuugaaaaaaaacaacagugucuuuguggguuuuagggguuuuuuguuguuuuguuguuuuuuacaugaagaguagucuaaacaaaaauuuacaaagcucacugaacuuaaaauacucuggaaguguugaucagcaagaaggcugugcuuucaaaccaaaacaugccacagauggcacccaaaagcaggcaaucugugagccuucagugugcuguacacuccuggcugauauuguuuaggacaccugugaacagaaugagugcuacagggcaugcucugggagaaacagucucuucaucuuccuugccuaaugccucaauaagccagggagccuggugggcuucccagugucauuagccguguggaucauguggucuccugggaugccugguuuagguagccucaaaguuucccacucacagcuuucuuggagaaaggacaguggggcagaucccacaaccacugucaccacuuauaaaaagcauuucccuuauaaaugggacccaccugcucccuaaggaauuucuagcaccuaaguagccuaucacaauccaagugucucugccugcccugaaauaagccaagaacucugauaagcagaacaugccacaacuuggcccaggagaugagaaacccagccggggugcaagcugcaugcagacuacucacuguaccccauaaagcaccccagagcauggaacugcagcagaaauugaaaucugcgugcacagcuaaccucuucagcaacagaagcuaccugagagcaaagagaauggcucuguacaacacccacacacuguccuuuggcuuuuggucaggacuccacagacuguccagugcacaggcccuucuugagugcauggagcucccaugagugucaucugugaguuugccacugcucuacccauguaacuggaaaacuuguaagccagacacaacuuuccauuucuaccaucaauccucacaggaggguuuuggugucuaagugucugaggacagcaaguugggugggaguccucuaccuggccucucuuugauagaagaguugcuaagaacaccagcugcaggagacuggaaaugacccaacaccaugggaggaaacacaguacuugguccacaccuugugcagaaggcagaucucaaacaagagcaagccagcuuuccaggaacuguuuaagaagcaggcuccagagccagcugaauacaggcagugaagcuguguguauacucaggcuguuaagaacagauggugggagccaccugguauccugcacuagcccaaagcacaaccaggugccugccugagcccagcuccucucccaggagccugggaaaccacagacaacauauugugcauuaaccaggccaugcagaaacacccacaggaaccuggccuggcuucuagggcagcuucaugauacagaaagucccuacaugccugccuauguacacaucauacacaugaauaaguaaauaaauguuauuuauauaaauagcuuuuacagcccauccugcuguccucagacacuuggucaccauaaccccaucugccugagaccaauggcauagaacuuacuacacaauucaccuagaacugucuucagagcagcugagggugaccaaagcacuuuggaggcaccacacaaggacagcucccugucaccuaguggaaacaagaugcauuaacuggggacaggcaggcagugcucagggaccaagcaccaugagcuccagcaugacaugugucucuauacacaccagggugccagcuagccuggcucaugaccaaccucauuugcucccugugcaguuggcacauaccugccuccauaauguuagugucaucaguaagauguggacacuugugugaacaagcaaggaaagaaagcaguagagaggagaggagauggggcagauagguggcuaucaucugaaaagcagguuaaguggguagaguaaggccaaaagggaaagcccaaaccacaguaaacagauaaagcagcuagcccuggagaaccccagucacugaaaagagcaaucaguucuaaucagcucuggacaggagguucuggccaaugcaagugggcaagaaaaagacagaagaggccuuccaaacaggaaugaggaaugagugcccacacccugcauucauguuaguucuugggaagcacuuagggcaucugagcagagcuacaggacagagcauuuccaccacagguucacaagcuaaagacuccaagucaaacccccacugacaaauaaauaugaaaggcccaagaggugacucagugaguaaaaguguacacaaccaaaccagacaacccaaguuuaaucccauauccccagauugucccaugaccuccacuuaugcacaugcacaaaauaaauuaauguuaaauua

SEQ ID NO: 4535 - RNA, 61389 nt, Mus musculus
cacuugaggcuguggaagccgcgugccuggggcguagacagggcuuagaucuuuuagaagaaaagaaaccgauugcgguaaauccucuggacuacgccggguccucggaagcugugcgguaggugucaauuuccccucacagaccaaccgagagaaauccaggguuaagugucuccugcgacagugucuuaagagcucagcugaccgguacgaugcugggcaaaaccacgaaggcaggacuagacuuacaaaacucgauucccaagaucgugugcuuuuaagugagggagaauaguuguucgcgcuccuuaaaauguguucauuuauggaggcgggcacgagcguguguauacacauauugaggucagacgaguugagucuuuugucucuuuucuaccaugugcauccaggaaaagaaacuaacucuggcagcaagcguuuauuugcugagccaucucgccaaccucaauauucuccuuuacagcgucuccuugaaugccagggugucuuucuaccucaccuauguuuugguuugcuuuucucuguguaacagauuccuggcugucauggacucgauuuguagauuaggcuagcuucgaacucagagauuugccugccuccgccuccugagcaccaugcguagcuacucacccguucuucaagguagacuguguuguacccugggguuugcuggauacucaucacacauguggcaguccuuguggaucugaguagaaaauggccuggucccucccaaagcaggaguuuaagaauauggugauaggacgcugggcuuuguacccuaaggccuuugucacaaacuaaauacaagaggaauuaggaucuuuggacagagcagugucagauggccccacugauguguuuugguugcuuuuauuucauauuggauuuggcccuggcaacucuggaagcuuuuucauuucacaacagguacauguacucagggcaacccagcugugguuucaccuccucaaauggcccuguaauggggaguggggccauucugcaacaaaccucagaaauuccuacuggcucugaaacggguucuggguuggcuuugguaccaaccagaccaggagguauguucuaagacuuaaaccaugaagcugcuguuuuaugaauaacuguuaucuuugaaauuaagaagauauggaugagugaaaaaaaaauacuagacaccuaaucuuggcuuaauuguguaugugggagagaggggguagaucauuacuauauaacgaaggugacaucuuaguggacaccugucagguauggaggcagccuugggucugccugcagcugcuagcccagggcuagggccagaaaauaguuauguacaucugggccaugcaaucucccugaugggcagggaagguguacaccaugucacuaagaggcuccucuaggugggugaccaaggggauguuguugaccaugaaucaaugaaaagcagauagagaggcccugccugccgcuacaaaauaaagcuaaagggaugucaccaaggcuggcauaguagguauggaugugggcuccaggcacuuaccccuguaggaaaggccagauuuagcuauacaugugcaaaugagaaaugauuccaaaacugguuugugcaaauauuuuuuuuauuuccacauuuauaucacaaguuguccacuuacuggaccaaauagcaaaguugcucccuucugcgcgaacacagaagucuagguacuguacauucacuaaggcuccuuguuuuugcaaaucgcguuuaugaccauaaggcaaacgaaucuaaaggaaugguuaugaguguuuccagccaacagacggcucuucccuagcccaccagggcaacucacaccaguagcacccucgggaacuuuguggguuaaagacucuagaaagauggcauuuuucuagaguugugcagaaaaggaaagaagggaaggaaaagucauuuggcuggugguaggggaaaaaagagaaugaaauaaaugagaaaacucaaguuucugcagcauuucuuuuaagaacugggacugaacugaaaccauauacaaaugggcagacgacugugcagugugggugaggcuggcccacccacacaacaccaggguucaccacagcagagaagcuuccagcgcacaacacgagggcgacaaaaaaaaccacuggcucgagaguagccugugccucagagacaccagggccaaagagcaagagaugcaaagaagagaugugucuguugcuguuaagguaaccucuuccacaggguuccugugccugccugcuacugaggucccugccuucggugcuuagagugguucugcaccucuucugggaugggggacuaacgcuuuauagcuggcuuacuauagauuucagccaucuaucugccccucccccgagcggcccuuccuuugcaaucguuaguaaacugguagcagcauuucacaaaaggaugguggagagcgagccucaugcucgccuucucagcuggccagccuaacccuugcgaggugggaaugcacaugauggccaggucaggugcucaguccaagcagacauaaggcagaauguucaagcgcccaucgucaccaugagggucgagcgauauacacuguguccagucauaccaauuacccugugugucuucacacccguuaaccccuggccauugcugggccuggauucuguccagaucauccugcgugaccucacgugugagcccugguaggucagugggugugggcagugguagcagcacauggggcugccgggccccuugccgacugcucuccuccugcuucagguauucagccauaaaguggugcgcaccuggggucugugcgccugaggaggauagcaagcugcucuggcggcucagguaggacuguaugaucucauuucgugauagcuccuuccaguucgucugcucaaaagggcucuggaggcuggccuugaccuccugcugcuccagcucuguccuaggcagcugcucuguggguacugggcugucagcccgcaccggcucuuucugggucagaggccugaucugucuugucauggggucaaaggugagcuuccgcucuuuuaaccgcacagguuuaacaccagccucagccaccugcccguccaaguucacuguguagucucgaggucgguaccucuuuuucuuuuugcuguccgagccacccgaagagguagcaucacuguccgccuuggaggaaucuggagaaaauccagcccugcaggcuggccccguuagccguggguggcccucagacugcucuggccagugcacagggcucucagcauuaggcagcagcuccugacggcgcacagggggcguggguggcugggccagcgggaguggggaugguaccugcguguuguccgguggcuggggccauggggaagggcuggacaccuggcccuuggguauguaagagcuccgaugccgugaaaaggagccuucgugccgugaguuccgggggcugaaggagcagcgagaggacccccugggauagggagggccuggggacucaucugcccuguccaacugcugcaacugugcagccuuggucugcaggcagggaacuggggguuugcccaagccgggagagcuggggcgcggccgcacggcguucacgggaaucuuggugcugugcuucucauuaucacugggcuccaggcggcugccaucagggcccaagugcccacugccauccagggggcuggguaagcucucugggcucccgcugaucccauugguggggagaggggaugcauugggaaccagagggucaggacugccuuuggaaacuuugugggguggcccuggguggcccaggucacgcugguccccccugcgcuuacggcugcccagccuaucuagccguugcccagggagccuuuggaugucguugcgauucuucaggucauggaugcucuugggugcaccagccacucccaucucuggucggcaguugugcgcacccccauuggcagagccugcagcuccugccagugcccguagugccacuucguucugguguacaggcucgaugagcuucugccagcuucguagcagccucuuggcccgcuuggccagcuccucauucuugguuuucuugcggacaucauugaugagcuucccuagucgugucuccuacaagagagugacauacuuuuacaaggggccagcgucuuggauauaguuuggguauguccagcacuguggcagcaaugaaucuuuagaucugggacucaauggcuuucucagaaacaggucuaccgguuccaggugccuguagacucaggugcuaucaagaccacaaauauaaccguggguggcccuaccaggaugucugggugagcacauuauacagccuaagacuuccuacccaaagagagggcaguaccacuaaccaguugucuaaagcacaguucaggaaggagcccaguugugagauuagaagccuccauucuuggagaguugaguaagagccuaacccacaggaagaaaagcugucuggggcuaccuuuaccucccauuaugcccaggguaggggcaagggcucuuaccuccagugccucuuuggugaugggguaucucuccagacuggagaucacuuccaacacugccaccauguuccggaucugaagaaaaagaaccauguaucagcucagggcucugccuucucccauggaaagcccagcagccuagggcccugcaagauaccagcacuaccaaaaucccuauuacccuuucccaggguucagcauuacccauaugcaggcacaccccacugccaucagggugcucugcugaaggacauaccacauaaaacacaaagccucagagaaaaggaaaggaaagauaggcacaauaaccagugaacccgaugacuguaucaaggucuucauagagacucucaagaaagcaagaugucacaaacuauaagaucuguaugucacauggcuaggagggccucuggaacaccaccugagcaauaaugcagccccaugaaaccagaugagagaaggcccgagacacuaagaggcucuguacacaacaagcagggugaggacuagugcugagcuucauggugacaggaagcuaaugaucuacaggcucacauaugggaucccacucuaagccagccuuuccacugggcaggugccaggauugucauucuggaaagaguaggacuaaaaagcuaugacugaugugacuggacaucccagcagcacagccacacacaguagcaaagcaugagugggggggggugggugaagaggaguuuccagagcaagaggggacaaagcaagaugucacaaacuguaagauguauauauauggcuagugagacuagccauauuggugagcuccagguuugauugagagacccugucucagugaucaggcggaggagugagugaugauucccugcaccaacuugagcugcccuuuaugcaugugcacacauguauuccauacacauguacaugggaaacuacuucaaugaaccccagacagaaacauggaaguugaaaguaagcucuaaaaugguugcaggagaggaucugcaguugugggaugauagauguuccugaggaguucagagcacagggcagaguaacauggcacugcagguucuagguugacaagcagucaggaacuguggggguggaguuuagacagaauaccaacaaagcugauuguccauagcccuaaguccucucuaucuuugugccacaugucgaaaggguaugaugauaucaccugccacacuggguaacauggaaaaauagucugcaacccuaccgacuguucaugaggaaccgcccagcuccagcacuugggaggaggugucagcuaguagcccccaggagguuguuccaugugacauaccacaagcaaccuagugaccagaagaucgaccuucagguuuccugcugcugcccugaucuauguuggcugaaucccuucauguuuugauugucucaccuacccauagccuagggccagagagcugccuccuuacuggagguucuuggggaugauccauacucagagagauaccaacagaauucaaguccaggucccaauuuucuuacuggcugucaccuaaaaugcugcuccuagcuucaggaguacaucaugucccuguguucccagcccucuaccuaccuucaauaccagccccagaauccugaucauguauagcccagaauuguuccuguccgcaccuuagccaugucuugucagguaagguaccaggccuagguugguuuccagacuaggagguagauagccuauaggccauggguaucccccagcuuuucuagucuguccauuuccagcggaaggcagucaccaugucucucuugcuucagggcucugccuccugggagagaagcuguacugagaagagagcagucagcagcccuuguacugucgcacagcuuucacuaagccaucccucugucaacaaggcaggcccuuccuugggaacaaggccuuccacaugugauauuuccucuggggcuggggcuguaaacacauccagauuacaacauugguccugcugccccauggauggguggccuaccuagagacauggcugucguacucaccucugaaaugggaugggcagggauuccaugcaaagagugugcaaugaggagaucauuccuaagagaagauaaaucaaguguucccuggccugggaucuuggugccacugggcuccugagcuccauggcuucaucuccaucuagugaccucacucugguauauuuagagcccuggguccccacauacuccugacccagcaguccuugaugaaaggaauuugcccaagccccaauggccuggcagcacagaguguccuuguccuaggacagaaaccauucugcucccagacaggaagaggggacagaacaccuaggggaaccagauauuggguuggugcauaggaaaacacacacacacacaaaugcuaagcugugcacagaccagccauagugccuucugggguuauauggaucaaggucuaagggccuugacuaaggggccacuuuaucagugugggcuuccaggaggcccugagggaaaugccauauccuccguguucuccugcagcuguaggucauucaccuaaggaacugccugccacacuuacaagguccacacugcuggagccacacacuggagccaguguaaguagaucaaccaucagagcagugagugaguuaaggugaaccuaccugccuagguaaaaaaaaaaaaaaaagcaaggaagagcuagaagaagugauaugggcuggcagguaggcucaggugcucuaccacuaggacaaagcuguuaaggcuaauccacugccaccaucauaacagacacccugucuuuucuugguuguuccucuuaccugcaugucaauaccuacccacucaucuccugaaugcuguucugacugccuggggagcucuuggcagugcucugccuuaagugcucugcccugaagacagcuucagggcaggucuguagcucaaaguccuaguugcaggccugagggccauuuacaaccugcugcugucaaaaauagccugguucuuuucucucuuugggacucauucccagugcccaaauauucccaagcacccugccaaaugguuuucccaucaggagagcuccggcaccaggccuugagccauacacuuguacauagugcugccugaauagacacagaucuaucuguauuaccuuaacaagcaguauggccaagcuugccuccccucccuucuccaucagugacaggcucuacccauucauuugcauugcuggacaucuaguguuguagugccugccuguguacaguggcuccaauggagaggcuuauuagcaguggccagcagaggcacuaaggaagcagguggcaucucugugggagccacacaaaggugugucaaggaaccaccacagguccagauggaacaugaauauucaugauagaggaagaguguagaggacaaagucaggccaaugggugcaugccuuagggcaucuaaggagacaucuccuuuguccuucaucacucuucuuccugguugccaugagaugaucaugcucugccacaugcucccacuucaauguggcaaaccuaaggggcaugugcgugcgugcgugcgugcgugugugugugugugugugugugugugugugugugugugugugugacucuuuccuacuauuaaauugauugugcugggcauuuugucaugguaaugggaagguaacacccuaaggccuguucugaguauuaggcgggaaucuaccuauauacaagauccaagggcucaaaaagacccucaguuucauucccuauuaggccacagccugugcugacucaauuccugcuaggcaaauccaugacaucugcagcucaauucacugugagucugagaagagaggcaagccaggcagaaaacaccaggucuggcacugcugagauccagacauggugaauaacacuccucagaagcagugacuauucucucuacuaguuacuauucccuuuuaugcuuaaauuuggcucuaggagacuaugggagguggagguacaaugagugcuuuccugucagugccuccagggcuggggauagucagcaagacuuccuaacuuaacucaggguacaaggccuuccaucuuugcagacuccaggacucauagaacccugaaacucccccaccacucauagaaccaggagacucauagaacucuugaaugcucuuagcugcuuugaccugagccaaaaaguauuauacccuaggagauaaggcacugggacagcucaccaggguucaacuccaggcaggccuccugcauuccucugacuggauccacagagucccaagugggauggcacuaacucaagagcuagugugacucuucccuaacagaggguggcuacccauggggaauuugcugccacaagcugaaacagggaaccaagacaccaaccaaaucuuaagaguccuaguauccccucaggucaucucauacauuggcuugccauacugugaagugggagcauguggcagggauaccugcacagucuuggccagguucuuggggccaggcacagcaaggaggaaucagcaaacugaguaguaaaggagccaucauuucugauccauaggcaacaggauuucaaauauuacuauugugugguacauaaggcaagguggaggaugccaaaguugggggcuucucauagaggggugguguaaccuuguccuguggggacugcugccugcccagcacugccuccuaccauccucuagcagugaaggcccauucacaucuagaaccagcucacaucucugaccccucuagaggaccagacugucuugcaaacucuguucacagcaaaggcuuagaguccucuuuaaaaugaagcccagcaggagaaacuggauaucauggugaaucucaguucugugaguauaucagcaccaccagauuccuccuucccgacugugcucauaaacuccuggggccugagaaaugacuaccuauggggaauuuucagcuaccagcugaaacaggaaaccaagacaccaagucuagucccaguauccccacaggucagcucaccacucucuuuuucucuccccagcuaaccaaaauccccgacgcuggcaguugccauuguuccccagaggcauccacacuaaugggacccaaguauugugcagcuucauuuuacagugaggaaacucgguguaugcaggauagggaacucuacauggaccacagaaggcaaaagccugcugcuuuccugugcaggguggaguguacuaaguuagcauccugugauguacuugccccagccagcaacagcagagaagcacacagguaacacagcuccuugaaguuggacccuccaguguugugucauuugccuuucuuuucucaaggguuguugaagaaccaagaccagguacauuucagcaguuucaugcccaaugguauccugaagcagacguauacagugauggccugagagucaucuggccagugcucccaggcacugccugccaguagccccaaccacaucugugcagcacaguccucaggaccuacaccaacaucccuugaaaaaaaacaacagugucuuuguggguuuuagggguuuuuuguuguuuuguuguuuuuuacaugaagaguagucuaaacaaaaauuuacaaagcucacugaacuuaaaauacucuggaaguguugaucagcaagaaggcugugcuuucaaaccaaaacaugccacagauggcacccaaaagcaggcaaucugugagccuucagugugcuguacacuccuggcugauauuguuuaggacaccugugaacagaaugagugcuacagggcaugcucugggagaaacagucucuucaucuuccuugccuaaugccucaauaagccagggagccuggugggcuucccagugucauuagccguguggaucauguggucuccugggaugccugguuuagguagccucaaaguuucccacucacagcuuucuuggagaaaggacaguggggcagaucccacaaccacugucaccacuuauaaaaagcauuucccuuauaaaugggacccaccugcucccuaaggaauuucuagcaccuaaguagccuaucacaauccaagugucucugccugcccugaaauaagccaagaacucugauaagcagaacaugccacaacuuggcccaggagaugagaaacccagccggggugcaagcugcaugcagacuacucacuguaccccauaaagcaccccagagcauggaacugcagcagaaauugaaaucugcgugcacagcuaaccucuucagcaacagaagcuaccugagagcaaagagaauggcucuguacaacacccacacacuguccuuuggcuuuuggucaggacuccacagacuguccagugcacaggcccuucuugagugcauggagcucccaugagugucaucugugaguuugccacugcucuacccauguaacuggaaaacuuguaagccagacacaacuuuccauuucuaccaucaauccucacaggaggguuuuggugucuaagugucugaggacagcaaguugggugggaguccucuaccuggccucucuuugauagaagaguugcuaagaacaccagcugcaggagacuggaaaugacccaacaccaugggaggaaacacaguacuugguccacaccuugugcagaaggcagaucucaaacaagagcaagccagcuuuccaggaacuguuuaagaagcaggcuccagagccagcugaauacaggcagugaagcuguguguauacucaggcuguuaagaacagauggugggagccaccugguauccugcacuagcccaaagcacaaccaggugccugccugagcccagcuccucucccaggagccugggaaaccacagacaacauauugugcauuaaccaggccaugcagaaacacccacaggaaccuggccuggcuucuagggcagcuucaugauacagaaagucccuacaugccugccuauguacacaucauacacaugaauaaguaaauaaauguuauuuauauaaauagcuuuuacagcccauccugcuguccucagacacuuggucaccauaaccccaucugccugagaccaauggcauagaacuuacuacacaauucaccuagaacugucuucagagcagcugagggugaccaaagcacuuuggaggcaccacacaaggacagcucccugucaccuaguggaaacaagaugcauuaacuggggacaggcaggcagugcucagggaccaagcaccaugagcuccagcaugacaugugucucuauacacaccagggugccagcuagccuggcucaugaccaaccucauuugcucccugugcaguuggcacauaccugccuccauaauguuagugucaucaguaagauguggacacuugugugaacaagcaaggaaagaaagcaguagagaggagaggagauggggcagauagguggcuaucaucugaaaagcagguuaaguggguagaguaaggccaaaagggaaagcccaaaccacaguaaacagauaaagcagcuagcccuggagaaccccagucacugaaaagagcaaucaguucuaaucagcucuggacaggagguucuggccaaugcaagugggcaagaaaaagacagaagaggccuuccaaacaggaaugaggaaugagugcccacacccugcauucauguuaguucuugggaagcacuuagggcaucugagcagagcuacaggacagagcauuuccaccacagguucacaagcuaaagacuccaagucaaacccccacugacaaauaaauaugaaaggcccaagaggugacucagugaguaaaaguguacacaaccaaaccagacaacccaaguuuaaucccauauccccagauugucccaugaccuccacuuaugcacaugcacaaaauaaauuaauguuaaauuaaauucuuuaaaaauuaucaagauaauuacauauagauuaaccuuacugcauguaaaacucagcacugaaacuuagaaacauagcuaaggaaauaaagcagauaucaugucagagcagacaccaagguuuugcacuucacugucuaaaaccaauccacagaguggacucaggcaagaucaaugucaauucaagcagauacuuuuggggaaaguggcaagaugauucugaaaucacauugagugcagagacucaacacauaaagccuugucaccaagugugucccugggacacacacaguaaaaggagaaaacuucuauagauaauucucuaaccuaacccccuuccaccuacacacacacacacagauaugcaugcacacauaugcccaaaugcacauaccacagaaaccaacaaaaacaacaguaacaagaaccuuuuaauuuaauaaucaggcaaaugaggcaggugccaaggugucaaugauaagcccuuuuaucacagaagauacaaaauagcagacauacacucaggcaaccaauaccaucggcuauuaagaaacgcaaaguaaaaguccaauagaaaccaccacauacucucugaacagcuaaaauuaggacuaacuuuaucauauguugacaagguuugagcaaaugguucccccaccccuuucauucaucuggaugacaucaaacuccugauccucccccauccacaccuaggaauacugacaugaugagcauguacugcaacaccauuguugggaauaaaaaguuguaaaauuaucuuagaaaguaaaacaaaccaagggguuaacaauaugacucaguagguugagaugcuugucacagaaagcccugcugccugaguugauccccaaaauccagacuccaaguagcugucaucccgucucuaaugcauauccacacaagcaugugugugaggaaauuaagaaaccaacuaauccaaaguguuaauauauacacaaaguguggcuaguaagauggcucagcugauaaagguauuugcugucuaguuccacucccuggacaaaaaaguagaaagcaagagaugacuccauaaaauuguccucugaccuccacaugcacacuaugacacaaugacacauccucaacacacaacacacacauauucucucucucucucucucucucucucucucucucucucucucucucucuccccccucccuccucuccucccuccacacuuuauaauaaaaaagaauggauuauuacuuagcaacaaaauaaaccaugacauaguguaacauggauaaacuucaaaaucaauacgcugaaaaggacagucuuccaccuaacccaaaaaggagugugugcaugcauauuguacaauuuacacaauucuaauaggguuaaaccaaccuacaauugcugagaggagaacagcacuugucuggggguugggaaaggaaaggggaauaaugcuaaggaacaggaaaaguuuuuuuuggcagcgauacauuugucauuucacauaccuaugguaaauggcacuacaaauguaccuaguuacagacuucagauguacaguuuauuguaugccaauuauaguuuaauaaaauugaaaaaauaggggcaaguuauagcaaagaagguauuguacaaaauuaagagcaguaaagccaacacaggaacacuuuuuguugcagaagacaggaaugagcacccuacaccuuagaagaaaaaaauccuuugggcuguuucucuccagugaaaugaggaaggauaacaguugagccuaaggacccagaaguuuggaggucuucuaaagacugacaacuaaacacagaaacagaauacauugccaauuucauuucugacucugcccaacacugacaagcaccagcuccucuuucuggaacuuagcacaucccuauggauaccugugcacuagagagaugauguguccacagcagaaugggaauggcugaccuuggauuaggcaggucucagcacucagaagcugugcuguagcuauacuggucaagccucagccaggugcccuagucucuaacuugccuccacuacaccuagaacccaggagaaggagccaacuacccagcuucccagaaaagacagacagcucuaacuuccagacaaacaucagugaguuccccauaacagcaccugcagccacccugggcaaaguagcucagugccuggcacacugccucacccugggugugcaggggcugugucuagccaucuggaguuccaguuuccacauuauucuccaaacaugggaccugggguaggcacccagaagcucugggaaaagccccagacccagcacuagcgucugugcucaauaguggucugagggcuccugucucaaccccaccagaucucugugacaacccuaaacacacaaggaguguacagagcucagguucacaugcacaaaagaaugcccucuuaugucagcaucagaguccuccagaggagggaggguaugacaagguucagaagagcuaccacaggauaaaaggcaaaggggugccuaggguaauggaagaaaagccaucaccaccuagcauugcccagucagaaacaauggcuccuggcaagcacaggcccucaagccugcauguuuggcagccaaaagcacuaacuccaugugucagggaguuagcuggucaccuccaaguauugaucacaucuguggcauuccccagccucaggcacucaguuccagaacucuaggcagaaagggugcuucccuucuccuauccccugccccugucaguaucucuaagggcauuugccuagguuccagcagggaugcugguagcuacuguaaguaggaccagcaacaagccuuaacacaggguggggguguuucagagggccccagucaacuguuucacuaacuacugccucacaacaucacuacauauuccaacuuuaaaauggcacaaaaaauggcacagacaugucacauacagccugccugcacuuugggugggucauugauccacuggugcccaucacaaaccagcaugagacaugguacagggccacugaucacaggcagcaaggagaaaagaacaaauuacccacacuggcucccagugacaucugucagauaucaacaggauaaagucauggccauuucaccagcagcagaucccccaggcugggcucaaggcaaagcuaguacacuagcuccccauuccuaacaccaugaaagcaugcccauuccagcaagggggaagcucacugagccucucaggaugacagacccaccuguugauucucuguacccucaaacccucucagccuaccaacauagguuuugcuuacuuccacuucaaaacugcccaucacaauaauccaucagugugucguagagagaugaggucucuuccuacugggugccugccauguuuacuucaauacuacaaauauuuggagucucuauuucuggggcaagcugaucccugaauacaccaagucaguaucuggacaucacccuuugucuuguacccaauugcugcccaugaggggugacagggacagaagugauucucaugaagaacacagagaaugcugucccagaguggguuggggagaccuuagccaggcacagugaggucacuucuguuccauugaggcccuggucaauggugugggccaguacucuuucaagccacacuugcuagcaaggccaaauggcuuuugggagucuucauuuucaaagcagugguccugucaaggccauaaaaauguucuuuggucuaccuucuuggaagccaugagcugauuccaaaauguuauguuaugagguauaaaguacaaagccaaauagggaagucucaaggcaguggacauagaagcuugugcugcacuagcaagccaucucagcucacuaggcaauguggcacugagagaccaauggcaccugacaacuucugguggaccaggacaagacuggccccuaccccugccagacuaaggaacuacauaccagcacucuguucuggcccagaaccaaauacaugcccaacacaguuggggcugcaaaacuaauccaaagacaaguagcacaccauggcuacaagcuguuggagagagcccugugcaagagagcauacaauaaccugagcauguuaguguaaaguacagucuguagagagaccaguaucaggccuaaccucaaaggucaugcuggguagggaaccaagucaccccaggggccucccuugucuuagugcaggcacugcaacaaucuuucauuguguguccucaacaucucggucucacaguacacaaaccugcuauccuccauccgcagggagacauucaacccucaccguggcucuaccauuuggucccacuuucaugguagucagccagcagcacagccacuucuagaaagcaugccuucacacuuccuuccuuucuuuaguuuuuccuuacgaaucugaucccgaaagcucaaguuggcuggaagcauccaaauucuuuucuggcaacugcuaguguuucaaguguuuucaguucucagcugcacacagugcuauggucccauuauggggauggggguauaaauguguugucuucuaaaggaucccaggaagcuaagaccuccaauuuggcagcacugucaaagcaucuggacuguccccuguccuugucacuugucccugacacuacaaaguauggcaguauauaucuaaacaccagcaggggauggaaaagcaaugcccagggucuucuacuguaguauuucugauccagccucaaccagacagaaagaaaaaugaggcucagccaccuguccacacuaggagccuugcaugccaauuccaugucuuauugagcaaucauccaucccuuuggggacaugauggcaugguguggggaugcuccuggaauuuggggcagaucggugggcuuaaguaaauccucaucucuccuaaaggaaaggggcgacuaggccuaauuuaaucuccugagaccuuucacauuugcacugguuaagggaggcuuaggaugagacuccauagcucauugucuaugccuucccaucugcccacccuucuuugcugcgguccuccugagucucacucuaugcuguagcccuaaaucuacaaacuaaucaagagccaagcuaacccaaacguugcccagacuugucuuacauccugcccuggaaagcuugguuuuccucagcacaaacucaagguggcagaacugcgagucuaccagacauaccuaagauauggaggugccuagaacucucucaaggauagcuggguuguuucaggacauuuauauggaaaccaugaccugaggacugacugguggcugugaucuccaauggaaagcacggucuacuuuuccuacuucccagggaaggauguguggccccagcuaugccuagcaugauccuauauacaacaaagucagauuauuuggcagcuccuccuggauggaagcaacugucacuacuguuucccauuaauacugaagguaauaacagguaauacugaagaugaaacuuagaaacaaucaacaaggcuggauggugguggcacaugcuuuuaaaucgcagcacucaggaggcggagacaggcaaauuucugagguggaggccagccuagucuauagagcaaguuccaggacagccagagcuacacagagaaacucugucuuagaaaacuaucacaggccagcauggcucagcagacacagcgcuuacugugcacuaugcaaaccugaugauuucuguuccauccccagaggguagacuggaacagauucccuaaaauugcauauacacagacagacagacagacagacagacagacagaaaaacacacacauaaaaacauaaaaagggaaauacgaccaaagucacaaaaauauaauauauucacaggaaauaaaauagaaaccaagguccggauuccauucaaaauuccugaguaaaugagggugacaaugccugcuuucucauguuggaaugcagaugacugacugcagugcaugcacagcccuugcuauuuaauccuugccuaguacuuaaucauguugccuucaucagguuaaacaacccaaugcccgaagcuuccaguauucugaaauaguugucuugcuauguauguagcccaagcugaccuccugcuacagccuccaggcuggcacauugaggccucccauggaguagggaauagcagucuucaagcucugccucccagcaucccuugcugcugguagaggcaacaaguacaguguuccagggaguaaaagcuaugcacccauagaacuagguugggggaggaagguagaaagcagggcuaaaguagagaaauaagggacagagagccuguggugugccagcuugugucauagaggaccauacuucauuugguccugagaaagcuggguaccucaaaaauucacaguacagaagaugcaggugaggugggcuguaauucccaucuucucugagaagcacuccaaguacaaacaauuuccuuagcuccagguaaccccagcaauaccccucaaagcucccuuuaccuguaucacugggcuggcuagaaaaaggucucacugcaguaccugagggggugaggguggguuuucugggcuauucucuuccccagcuguagucagugccccaugccucuaagcacugcagagaaauagugucauaggcugcccuggagcacacacacacacaagauauucccaccaaagcacauaacuaaauccccuacacagaagaaacucuuuucugcccccagcugcucaagagagaagcagcacguccugugguagaagcaagcacagcagcucuaaagcacccagcccaaaagaccaagacaccuacccuggcacucuggggucugccucuagcuauaaacuugugucuggacucaugaugcaccuuuuucuaaacuacacacagcuggugggaagaagacuuggccucucaucaaaguuaacagaaaucuucaagguucuuaaaauucacagugacccuauaacuuuugacuaagaacugucccacccugucaccaaccccugaaauuucuuuucauuccccaagucccugccaauggauccaacacuaccuucuuuucaugucucugcacuagccacacaugagccgagaggucucuguggcucagccucaguggaagcaagcaccacuuuacuaguaagcaucuccuccagaacuccacaaauaacagugucuucuuaaaguagccaaccaagaagggccugaggccaccugacugaucuggcugagaucacacagcuggguuuagggcacagucagucugguagccaaacauuggcucagucuaugaccuugaagcacagcucagugcugaccucaaggggcacagauaccucugauuacaagcccuucaaacagugaggcagaggugggaugggaaacuggaguguuuugaggccucccaugaaggaagggaaacaagagggaauuucaugagugcuagagagaaaguaggaguguuccagcuguacagcaagggucagugggcagcaaagagcaccagguuaggugggauucuggauucaggaagaaaccugaggcuauacucugccugagaaguaacaagcucagucuaaaauuuuaaauaucucacucuggcuaccuaguagagaaugcugggcugacuacucagcaggcacuggcuagcuucacagaaugaaaugaugaagggcaggaaggaguuaggauaugagugggaaugagguuccaggcacaggccacagagcccauacuacacaggcugcuaggauacgaggcuggauauacaggccacacugggagugguggagggugacuugguuaucuuugccccagcuguggaacacugaggaacugguguuaguacaugccagcuguuccuggcagcuuaugugguacuucacuaaaugaggcugagcucagacugcuugggugaugagguucucacaagacagaaaugucaccagaacagagccuagaauccuccugugccuucccugugugcuuaggccaccuccaggaaccaaguuugcuacuuagaacuuaccucauuagccaugacugaauagggccuaagauggguacccucugcuuauacccucccccaucaugagacccccacacugugugcacacuaagagagcucaaggaccagccccacaucccuccuugugcuuguaauuuaaaaucugugccuucaacugcuguucuaaccacacuagccaucucuggucccuuugcuccaccaucauggacucuggguucucuggaaccauaaaccugaauaagcuuucuucuguguguugccuuggucaugguguuuuagcacaguaaaagaaaaguaacagaugaagcugguaccaaggauugaguuacugcugugacaggcuugaccaugcuauugggguggggugggguugggggggagauaugaaagacuugaaauuuuggacuagaaaaguuguuggaugcuguuagcgggacuuaugggucacccuagugggggccuggaagauagcaaugcucagacuaauauggacugugaagucucagcucaagagauuucagagggaacaauuguagaaacugagcuagagaccaucccuggaauguuuuggcaguaaaaguggcuaccucugucuuguccuaagaauuccuggggcuaaacuggaagauaguggucuccuuucuugguggaggcaauuucaaggcagcacuccauggcugucagccaccaugcuuucagacaaugauauugucaauucaccccuccuaacuaccuaccacccucccuggguuuucaagacaggguuucucuguguaguccuagcuaucccggaacucacucuguagaccaggcuagcaaacucagagacagccuccugccucuacuuuccaagggcuaggaucaaaccuagcuggaugguguuauuaaacucuuaggucucuggauaggagggucaaacaaacuucugcaaguugccuuggccuugguguuaucacagcaacagagaaguaacuaauacacagcacacagaacugaaagaagaaaccuagaccagcauggcuagacagaugauuacaucuccacuuacaguggcaccaucugcagcuaccaaucuauagauguagccaacaucuauucauacugagguauagacaaacgaugguccacccagacaguggaaugcuacaguucauccugaaaagggaaaauggggagacaaaauaugcugugggugaaucaugggugcaauucugcuaagucaaacaauuuguguauaaaaaacaacauaaaccagucugugugauuccacuuauguggcacaccuggaggggcaagguuugaacaccagaaauaaguaaaaugaggguggcuguugggaauaggcaagaggaugaggcauguuuaacaggcgcagaguuugggcuuuacaaaauaaaagagauggaacacaccuguaaucccagcacuugguaaggcaaaauagaauuucugugaguccaaagccagccuggucuauacagugaguuccagcacagccagggcuacaaacagagagagauccugugugggugggauggaguaggauacaugguauugacaguugaauauuacaguuggcacugcugagauguacacuuaaaaaugcuuaaggcagugaaagcugaggcagcagacaggcgagcugggugcggacggacaucuugggauccaagaguggccaggccggccuugugggggcugcugacuccaggucuguucucugagcaaugggucacagagacugagcugccaccaugauuggaggcuuauucaucuauaaucacaagggggaggugcuuaucucccaggucuacagagaugacaucgggaggaaugcuguggaugccuuucgggucaaugucauucaugcacagcggcaggugugcaacccugucacaaacaucacucgcaucaguuucuuccauguuaagcgguccaacaucuggcuggccgcagucagcaagcagaaugucaaugcugccauggucuucgaauuccucuacaagaugugcgauguaauggcugcuuacuuuggcaagaucagcgaggagaacaucaagaacaauuuugugcucauauacgagcugcuggaugagauucuggacuuuggcuacccauagaacucagagacaggugcacugaaaaccuucaucacccagcaggguaucaagagucagcauuagaugaaggaagaacagucccagauuaccagccaggugaccggacagacuggcuggcggcgagaaggcaucaaguaucgccggaaugaacucuuccuagauguucuggagagugugaaccugcuuauguccccacagggguaggugcugagugcccuuaugucaggccggauggugaugaagaguuaccugaguggcaugccugagugcaaguuuggaaugaaugacaagauugucauagaaaagcagggcaaaggcacagcugaugaaacaagcaagagugguaagcagucgaccaccauugaugacugcaccuuccaccagugugugcgacucagcaaguuugacucugaucugcaugaaggggaaggccaaguacaaggccagcaagaacgccauuguauggaagaucaagcgcauggcaggcaugaaggaaucccaaaucagugcagagauuugagcuccugcccaccaaugguaagaagaaaugggcucggcccccccuuuccaugaacuuugaggugcuauucgcaccuucuggccucaaggugugcuacuugaagguauucaaaccgaagcugaacuacagugaccaugaugggugcaauacauuggcugcaguggcauuuaugaaacccgcggcuagcugccuaguugcagcuggcccaccucccuacccacccuuuccacagguccaauuaccccuagugaccacucaccagugucguuccucccuccugcucugcugucuucccuuuccaauagccccugaguauaagucugaaccagccacaccacaguggaacuggucagguagugccuggcuuccugggagggugguuuuugaggcuucucuuccgucugucuguccuggcuuagugccaggcccugaguuuugugaccaaagccaggugcucuccucuucucucuacccuuguggccacaccucugcagugggaagguugucuaccccucaccucagagcuuccucaaagaccaguaacagauccccagucuuuaguccccacucugcuuugggauaguaugagcuucguuuuguacacgugugacuuuguccaguuacaaacccaauaaacaauagagugaaaaaaaaugcuuaagaagccaggcagugguggcauaugggaggcagaggcagucagaucucuguaacuuugaggccugccuggucuacagagacccaguugcggaagagccagagcacuuugucuugggggaaaaguguugaagaaaccaggccuaguauccaaugccuuuauuccacacugaggaagcagacgaguaaacaaaucuuugugaguucaaagccagcuuagucuacacagugagacacugccucaacaaucaauuuaauauguaaacaugcuugcagucaaguuuuauaucuggcauguacauauuaucccaagauaaacacacagauuaccuagguguaggauccuagcugggccucaguaccugagcaccacagguucuucugcuaaaacuuuaauacccugagugguaugguccccaggaacuccuaggcucucugcucuuuugcauagggaacuacaacugauagggucacaugacccaaaacaggggcaaucaaaagagggugcccggccuugaauccugacaaaaccagccucugcugugagugccugagcacaucaucuuccuggaagcaaguuugucugcucuccuacccagcucuggaaggcauggaaacaucagcagggggccacaauuaaacagggauuugugagcacuccagaauccagcaggagcuauagauguaggcaguggacuguggggcaauggacuaugcacaggcagcuuggucuccagucaagcugagguacggaaccccggugaaacccgguggugguaauucaccuacaugggacggaagauguucccucaugucuccuggaccccuggcuccugucgaaguuacagcccccucacagcccccacaggagaggcucguggcuagcagucacguacacacugucccaagcuucugaccuucaggcuagacuccucccaguuaccuagcaacagcaagauaacaaguccacuauaagaggggcugcuuggccccacuucccccucucucucuuacucucuaagcuuuuaccucucucucuuuaagcuuucuuacucucuagccuuucuucucucucuccuuuucccccuucucuguucuuggccauggccugucucucucucucucuuucuaccuuuucucuuuuccucugccuuucuacaauaaaacucuaaaaccauaaacugucucuguucaucaaggcuugcugugcuuggacaaugggauaagcuuucuccuaacgagcugcgccuaaucucucguuagaaggccuuucugcuccagccacagaccagacuaaggacucucgccuacgugggaaccucucucccucugcccucuucccguaucucuggggucaagugugucgcuccggggccccuauucuguucucagcuucucugcuguauccagcgugggaugccagagacugagaaccugguaccggaggcugcccccuguccaacccccaccguguggggucaguggcuucacacagccagaugcccacccgaggccgcauggaaaucguccagcaguccucccaaguccgccugcccagagcacaggaacucuggccggacgugggcucucuuccaucccccucucccccuacacccacagcccugcaguggaccucagcccuaguuauuaucuucauacccauguacaaguaccuaaugggaacugucuuggugucugggggacauggacaggcacucuuuccaagagccacaccaacuccaccuaccuuugaguucccuuccacaccugacccugcugcuugaguaaagcagaggggaucugugagguggggccccuaugacucagugacggugacagaacccaaagcuuccugugcacauccugcauguauaggcucugaguagagaauugucaaggccacacacaaugcuuacaagggauaccaacacuagcugucccugcaaaccuauuucugcagaaucuaccacugaaauggaaacuuaaggguucuuuggaaagugaguuguguugguguuuugcuggggcaaacaaaugaaagaguguuuuucuuaaguggacacaggugaaaaacuaaggcaggcucgugaaggaacauuuggcugaagcagacacaguagagagaggauguucuuuaaagcaagcacaugaaaggacauaugaugaaggauucuuugcuuaacaacacaaauguauugcucugccuuauauuguauaguugagcuacacuugucaggacuacauaaagagaaacgcaccaaaaaacaacaacaacaaaaaaacaaaaaacuggugguaugcugcaguuucuugcugcuuccucggacucaggcugauuggccagagugaugucagcuaagacagauacacuacugaggcaagacacauaaaguuuggagcauauaauaaaaaggacucaaaggacagugacagaagcugagcuaggcuugcuuacagaacuagcugugcaacaggcuuguggguuucgaaucuuugcuuccuugagagaggcauagcccagaccuucuccuggcaucccuuuggguaauaccacugcugcugauuuguguuugcuaucccaacucuaccgaacuggacugcuguugcugaccugugagcugaauugcugauuuccagacaagccagacaagaguugcuccaaagaaccuuucuaaacaggucuacgucuucuguauccuuuuccccccaauaacucugguagguggugggcuacaagagagauuaaaacauuuaagaacuuucauuaaaaauuaaaauuugaaaaaauuaaaauuacauaccaccagacauuuuuagugcccacgaugcacaagagacuccuucugucaguuugccucagaaagccacuccaggagccuugcucuuggaacuguacgccacuagaagucuguccuacuaaaggaccagagcuuucacauagacagggcuacagaaggugaggaggccugguuugcuggaacucacugcuuccaccuguugcucaucuauguuaacucuguccacaccucguccugcuaagaggguccugggguagcuuuuccacaggaaacagaaacuacucaguuacuguggcuuccuucaacuuacccaucccaggaagcacacacuggaccaccacugcaaagacacggucccaaaucuacaaggaaggaggcugaauuuuuacaaauguacagcaaucaaggccugcccaaggccacaaaguuuacagagcuacacugggggugggagccuugguaacuuguccauccaggaccacugaacuuugucuucuucaggaaaacacucuuuacugugaaacagaaccagcuaccuggacaggauguugccaacaggggugcugugugugaacugaagugagugguggcugacugggauauuuuuuagggaacgagaauauuuucuaauccuagacaacgcuaggcacacaggugucaggaugucagauggaucaaaauguaggaucagagucuuauccuaagacucaagacauacaucaagauucuaucacaagccggguggugguggcgcacgccuuuaaucccagcacuugggaggcggaggcagaggcaggcauguuucugaguuugaggccagccuggucuacaaagugaguuccaggacagccagggcucuacagagaaacccugucuugaaaaaccuaucacaaagucaaccugaaacaaaugccugugcuguaaggaaauaacagguccacaaaggcaacuguggcaacuggacagacaaacuaggaaagcacaggaaaguaaggaaagcccuccuaaacauauauucuuacucuguaaaauuuauuuuuaauuucguguguguguuuugucugcauguauguaugaagaccagaugcaugccugguaagagggcauccuggaacuguacugguagaugguuguuagccaccauuuaggugcuaggaaccuagguccucuuuaagagcagcuagcuccauauuucuuaauuuuggcaguacuggagucaggacccugcguaagcuaggcaagugcucuaucaaggagcaucuccacccccacccccaaguacggcuuuagcuacacagcuuuggacacaagaguaguggcuaaggcggcagugaagccaaagaucucagacugacuagaauugacagggauaagugacugguggaacaauuagcuacaaaagaaaauauguaagacacaagacaauggagagcuaaagagccagcuugcagagaagagccaggaaccugcuugcaggagaaagggccucuuugcuggacccacacuucacccauggugacuaggggcacaccaccagcuacacacacacacacacacacacacacacacacacacagaugggauauagcaugaauagcaguuuagcuggucuuggcuacuuugugaguucuuuuuugccacccuuuaucccccaccuccuguuucacccccauaacacuauauaggagagagagagaaauuaggaaaauuccugaaucuaauuucuuuccuuuuauuucuuuuguuucuucuuugaauauggcuacaaacaaaccacaacugauaucccuaaaugacugaccaccaccacccccucucucaggacccuagcauuuauaaagucucugaaaacuucccagaauuccaaacaucacacaaccacaggaauuaucuacagcuggcaaaaccacgcuccugcuagagcacaaggcaaaucaaggucagcuacuacagacaguccgaagcagucccacaucccuacaccugggauuaaaaugaaagcacuuauuuauuuuuugguuguucgugacaggguuucucuguguagcccuggcugugcuggaacucacuuuguagaccaggcugaccucaaacucagaaauccgccugccucugccuccagagugcugggauuaaaggcgugcgccaccacgcccggcuuauucuuauuuuuguguuguaaauguaacuuuuauucaccugagguaauuguuguuuuagucuuacuuacugccucuaucugcuucucuaugucuaguccuggaagcuucuagccuacauacaaucuauucuaggccuagaaaguuuucaaccugugagacuuacugcugaauaagcucacccuuucuaguucugagcugauucaacucagcuguucuggcucaacuuccucuccauacuaacugauucaaucuggcuucuuuuucucaacuucuccuaaauugcucuacuugguuucaaacuaacucuagcaaucuguucuaaucuucuggcuccuucucauucucuggcaagaucugucuuuaucugugucuagcuuugugcucucuuccaccuguuucugcaaaacugccuccucuuucuuuuuucuuuuucuuuuucuucuuuuuucuuucccucuauaauuagcuucccuuuucucuccuugggagaguuagacauaucauauccuauugucaaauuuuucugauucguaacuuugucugccacucaauuagacaacacuuucaaauauggauguuuccuucuacaaacuuauuuuucuucauuguuugggauuaaagcuguguacuaaggguguguccuuauuccagccagagcaauuaaagggaugugcuaagggcugagccacaccacaacuagaaacaaguuuuuuucaguaaauaacaaaaucucagaguucaaaaugcagucaaauauccugaaacacuguuuuuuuuaaagaauccaaaauucccaaauugucaccauguuucuccuuucuguuuuaagccauuuauuaugcuggguggaaauuauaaacagagacauuuucaauggaauaggcguuuuucaggucagugacaagguuuucaggugaccucaccugcuauuucuacuggaguggcuuugccuuugauguagggauauaaaaacagcugagcaauccuauuaccugcaucaaauugcaucucucuacauagaccuuaauuuuauuuucuccuuugaaauuuucauuuacaauccuggauguacaaugaaucguugggaagucaacccaccgcugcucuuccagagguccugaguucaauucccggcaaccacauaguggcucacaaccaccgguaaugagaucugaugcccucuucugguguguuugaagucaguuucaguauccucauauacauaaaauaaaucuuuaaaaaaaaaaaaagauguuuaucuguggccaagucuagagcagauuugccucaguguucugcauuaauucuccaaggcugaguggagacuuuuuuagucugcauauuacuccuuggcugaacuugcuccuagaauugguuguggagcccaaccaaggccacuucugguuagaaauuacuuugaauaaucucuuuuggaccuacacucuuuggucaaguagcaacccuugcuacaaugccuauacgucccuggaagccuacgccuccuuucugauuuauacuuagaaaaaccauugcccuuagagaugccucauucacaauuuuauuacaaaugccuguauuucccacaauuaaagcaccuggcauuugagaucuuagaccuuuggggccuuggucucugucucuuugcaaaugaacauauuuucugcaauuguagcacugggcauuuugauauugaagaccuauaauuuuagcauaguacauguuacacccaauaucgguuguauccuuuauccauuuguccauaggcauugcucacaucuuuaauggucuaguaacuuuuuuuacauucuguauucacauuuucaaacuccagucucuauuaacaccugccuugcuucagaguaugauaauggcuuuguucacagcuaagacuaauauguuuaaaaaaaaaaaucagugaaggcaggcuggagagauggcucagcaguuaagagcacugacuguucguccagagguccugagcucaauucucagcaaccauacggugguucacaaccaucuguaaugggaucugauguccucuucuggugugucugaagacagcuacaguguacucauauacauaaaaauacauaaauauuuuuuauuuauuuauuuuuuauuagauauuuucuuuauauacauuucaaaugcuaucccgaaaguucccuauacccucccuccgcccugcuccccuacccacccacuccugcuucuuggcccuggcauucccuuguauuggggcauauaaaguuugcaauaccaaggggccuuucuucccagugauggcccacuaggccaucuucugcuacauaugcaucuagagacacgagcgggggguggguugcggugggggacugguuaguucagauuguuguuccaccuagaagguugcagaccccuucaguuccuugggcguuuucucuagcuucuccauugggggcccuguguuccaucuuauagaugacugugagcauccacuucuguauuugcacuggcauagccucauacgagacagcuauaacagggucccuucagccaaaucuuucuggcauaugcaauagugucuggguuugguggcugauuaugggaugaaucuccaggugguguagucucuggauaguccauccuuucgucuuagcuccaaacuuugucucuguaacuccuuuccuggguauuuuguucccaaucuaaggaggaaugaaguauccacccauuggucuucccucuuguugauuuucugguguuuuacaaauuguaucuuagguguaaauaauucuuuaaaaagaaaaucagugaagguuucuucugagccuuguauaaucuuuguaaauaaguuggauuuuuccccaggcuccuuaacuuugucucaaagccacuaagcgacauuguucuauaguagcaucaucaaauugaaucuguucuuguauaucagaguacuggccuugauauagcacuggucuuuuacuauaugcacuccccuugcucuauuucacuguucaauauucaaggcuucuuccuccaccauuguaaccacuguaacugugaacuggucuuuaguauagcuucuaccaaucgcuuccagucuuggggaauaauucuauuuugaguagcccaguuauuuagaauuuguuucacauaaggcaagugcaucccauaugaaacauggccucuuuaaacccgccuuagaucuaccauuucuauaggaccauccuaucucaucauaaccucauuccacaccauuagcaggcauaugcuuuaugauuacuggcaaaguagaugguguuaaucucauaacccugguccaccucuccuuccacucugguggcucaguugguucgacauuaccccuuucucuggaaauaggcuguuucaucagauuguccucccacuuugucagcuggaagaguugcuuucucuuuucuccugcaggaaauucgcucucucucgcucagucaccaggacugacccuuuuuguuuucucuuccugauguuacuugcuucccaagugcuuccaccucuauccccagccucuccaguugcacagccaauucugcgacccuuuaagagaaagugaccccccccacuuuucaagacaggguuucucugugcaguccuggaacucacgcuguagaccaggcuggccuugaacucagaaauccaccugccucugccucccaagugcugggauuacaggcaugcgccaccacugcccggccagagagugaccccuuuuguuuucccauuucagccauuuuuuuguuucucaggucucuccauuuccacuuacagcuuuuccaacugcuuagccauucucccaacuuuuuuuugaaacagaacaacaaagaaaaagaaaaaucagaacaccacucugggaacaaagcaggggauaucccaguggcaguagucagaauaaauuuuuuuguuggugucuuguuaaaaaaaaaaaaauuccauaccuuccucuccugccauuuucucuauugcaucugaaaucuaauuuuccauuuuaauuuuuuagcuuucacgccucacaguagaugccacuuuuaaccggucuuugcuacuuuguggguucuuccuacacuuauuccccugguuacagccccuaacauuuaaaacuagaguagcaaauauaaaggagggagggaggcagaaaggaggggggaauuccugaaucuaaugucuuuccuuuuguuccuucuuuuaccacagcuauugacaaauggcaaccaaccucccuaaaugaccaacuaccacccacaccccuucucagggcccuaguauuuaaaauaaccuccaggggcuggugagauggcucagugguuaagagcacugauuccucuucugaagguccugaguucaauucccagcaaccacaugguggcucacaaccaucccuaacaagaucuggcgcccucuucuggagugucugaagacagcuacaguguacuuacauauaauaaauaaaccuuuaaaaaaauaaaauaaaauaaccucuagaagguuuuauuuuuuaaaaaaauaaaauaaccucuagaagguuuccaaaugucacacaaaauugcagaaauuaccugcagcuggcaaagcaugaaguaaaucauggccagcugcugcagacaaucugaagcagcuccauaucuccacaccuggcacuggagagaugacucagcaguuaagagcacugacugcucuucuaaagguccugaguucaauucccagcacccacauggugguucacaaccaucuguaaugggauccaaugcccucaucuggugugucugaagauagcugcaguguacucauauaaguacaaaugggaugugugugugugcaauauauauauauacaccaaaauuccagauuucucauuauauagcaacucacagauacagucaaauggggauaagagcagguccaagaugcuguguguggcacagggcagaucccagauggaagcuccucagaaggaagaaguggcaccugaacacucuguggucacccaguacuucacauuuucgucuuagcacaacaagcucaagccugggugugauggcuaccugugcauggaagaucugucaucccacaggccagcucugccuucacaucauucauuccaaauacaagccugucaaaguccggggcauccacacaagagcccacgagaaaacugagcagaaguauguugcaacuucaccucucccagaguacaccauucagauccacugauccaagccaucucaaggugggcaaggucaggaggagcacaauugacugaaggaaaggacccugugacucuaggcauucaagacuaaccagaaaaagaaacccauucugucagcacaaagcaccuugaagauacaaugaggauugguuccuuucuagaaagcagggaaacauaugguaugccuaggcccagucaauuaacccauauggcaugaguggcccagucaauugacccauauggcaugaguggcccaguggugaggucagccaccuggguggaguggcucaggaaauaaacuccugacuucccugggugggggugugugugcaccuacucuccaacuugggggaaagucaucuacaggugcaaguccaaagccauguggguuauacucuagcacagugcugacagguauucaaugauaacaaugaagaacaccaaaauccaccauuccuguuuugagaagcaagcagauacacagagcagccuguccuaccccuuccucgaagaacuagaauuccuuuuuuagccaaccauguggaugcacuaagagccaugcugccguuccaggacagcaggccaccuuuaagucccauauuccuagaugccccagugaagcugcaaagcaagcacaaccaccugugccucagcuuacacacucuacaaugaauguagucaagaagaaaugaaacauuccagaagucguuguaaaagcagacacuguccuacagccuaaugcccagcaagaaagacaucagggcagccaguucuccaccugcacauaccaaagcuugugcuaaucuuuaguacuguggugcugggugcuggggcuguucucaggaaucuuggguaucaguaugaagaacuaaauuacauaaacuuaaagaaaauaaaacucgcgggguggugguggcacacaccuuuaaucccagcacuugggaggcagaggcaggcagaucucugagcuugaggccagccuggucuacagagugaguuccaggacagccagggcuauacagagaaacccuaucucgaaaagcaaacaaaacaaaacaagcaagaugaagaaaauaaaacucaaaacacuacuuccugucaauuuuacaguauuuuaucucaucuuuguuucuguauuuagguuccaacauauacacuuggagcaaaugguguggagcaggcugcucuucccagcucuacuuagggcugaaagcuauccacuguugggaguacagcaggacacuagcagacaagcuaacagggauauaccuuaugaccuugggaaucugaaaacuccugagcaaaggcccuaacauuguuauuuguaaaugaagcuagauuugguuuuuauuucguguguguguuugcauguacuugugaaauguauggaggucagaggaguacuugcagacaugaguucuucuaauaugugugucuagaaggaagaagucagguuguuggguagcaccuuugucagcauuuccucaacacuacaauacagcaaccaugcauacuauuuauccuguucuacauacaaaacacucaaagaugauucggaguguauguguaugcggcuagcaauagcgcugcauaccagccaccacaacacuugggaggcuaaggaaggagugguauugaguucaagccuagccuguuucaaaaugucaaauacauaaaucaauuauuuguggguacuuauagauguguacagacuacucauuuuauauaagaaacuucgauaucugaguacuugguacuccugguucuggaaccaaaagggaauuccuggaugcaagugugaaacuuuguccagugggacuucucugaaaagcucaccacugcuacacugauuccacacuaaaauacuagaaagucugaaugaaauuaaaauccauuugugcuacuguauuucacauucauacaaacgaagacugaaggaccuagagucuuuagauuccccccucuauauauaaauuuuuuuuugagacaggaucucacuauguaaaccaggcugaucaaacacagauucuguucaccuccaugaucaugauuaagguguguaucgccauccuauaaauucuccaauacugacuaaaaaggcaauucuaaaucuuauccuuauuugaauguugcaucucuacaguaucaucaaagccgcgucuuaacccaaaaaugauauuuauagacacaauuuucuuaccaaaaacugacaggguguggagguggaacaagccuuuagcuccaguacugaggcagaggcaggaggaucuaaguucaaggcuacuggugcuaacuggcuuuuugcgacuuuguggguucuucuuucuuccaccuuucucuacccuuuuaaccuccuaacacuagcuaagagagaaaaaaguauagagaggaaaggaaagagaucccugaauaaagucaguggucaaaaacagggugacuggggcuggugagaugguucagcagguaagagcacucacugacugcucuuccaaagguccugaguucaaaucccagcaccaacaugguaguucacaaccauccauaaugagaucugaugcucucuucuggugcgucugaagcuacaguguacuuaaguauaauaauaaguaaaucuuugggcuggagccagcagggagcgacagggguugaccagagcaagcagaggaccuaaauucaauucccaacaaccacaugaaggcucacaaccauacagcuacaguguacucauauacauaaauaaauaaauaaauaacccuuuaaaaaaauaaauauuuaagaaagaacgaaagagagaaagagaaaggaaggaaggagagugauguuacuguuagaauauuuccuacugacuaggggugcugaguuccuuggggcaaguuugaucuucacggucaggauauuauuauuucuucccccuuuuccucuuccucuucuuccucuuccuuuacacauggcuacuuaacaaaccaugaccaacagcaaccaaacaacaacccaacaaccucucuggguccuagcauuuauauauccucuaaaaagcccagaauuccaaacaucacacaauuccaaacaucacacaauucuaucuguagcuggcagaauaauguuucugcuagagcaugaggcaaaucagaguuuugcuguggacagucugaagcagccccaucucucacaccugggaucaaaaugaaaacacauuccaauauuauuuguuuuucaaaaaacccaaaacuccaaaaugucacuauauccugauguacacagugaguuccaggacaaccagaacaagaaagagacccuuuccuaguuaagaguuucuacugcugugaugaaacacaauaaccaaaaggaagucaaggaggaaaggguuuacuugacuuaccauuccaucauauggugguccaucacugacauaagucagaacagagacucaaacagggcaagaaccuggaggccaugcagaagaagugcugcuuacuggcuuguuccccauggcuuugcucagcuugcucaaccagaaccaccaucccugggaugacaccacccacaaugagcuaggccauccccaucaaucacuaauuaagaaaaugucuuaugugcuggccaauggccugaucuuauggaaguucuuguuauuuuauuuucaguuuuuugagacagguccuggcuauucuggaacucacucuguagaccaagcuggcauuaaaagcagagaucaccugccugaguccugagugcuggaauuaaaggugugugcuaccccacguggugcauuuucuuaacugagguuucuccucucagaugacuucagcuugugucaaguuggcauaaaacuaccacacaucaugucucaaaaaagaaaaaaggaaaaaaaaaaaacaaaacaaaaccccggcuggguuuguugaaggacaucggcugcggaguuugggguucggauggagauugaagucauggcuggugcagaaagugaugcccaauuccaguucacugguauuaaaaaauauuucaacucuuauacccucacagguauaaugaauuguguccuggccacauacagaggcauugcuuugcuggucuuauacuucaaguuaaggccuaagaaaacuccagcugugaaagcaacauaaauggauuuugaaaugucugaccucaccuguuaaguccuaugccugaagaagcugaugugaacucaucauguaauacucaauuuguacaauaaauuaugaaccuaaaaaaaaaaaaaaaaaaaaaaacaaaccccacaagaaucaauauugcgccaggccugguggcucaugccuuuaaucccagcacucgggaggcagaggcaggcagauuuccgaguucgaggccagccuggucuacagagugaguuucaggacagcuagggcuacaaagagaaacccugucucgaaaaacaaaacaaaacaaaacaaaacaaaucaauauugcuaauucuguugacuacaauuucaggaacaauacauucccuaacacagugguucucaaccuuccuaacgcugcaacccuuuaauacaguuccucauguuguagugacacaccaccaccauaaaauuauuucauugcuacuucauacauauaguuuugcuguuaugagucguaauauaaauaaaugauaugugacgccaccgccggccccccuccauaugaaaggguugugacccagagguugagaaccacuucuguacaagcagucaacugucuugcucuaucauucaagcaugugugcugggauuugaagucucuuacccugucccucuuugcuccagcuucucccaugucagcaaugaacacaaucaaugauaugauuaacccacugcccccaccaacacugcuacugaaaacacuccugcauaguaaacacauuucuacugguaaaauuaugaagucaaaggaccagaauguguccauggcucuuacuacauacuuuccaaaagagugacaguagcucagagcugcaggcaggguaccuaggagauguagaaugguauggucagucuugaacugccugccaacaccaaucuuuccaugugucugaguaaguauguuuccuuaaguaucaaugauuccaacauucuucugucccuucaacuguuaacugaauacauucucaauauggaagggaacuacuuccuaaacacccccccccaaccgccccaacauuucuauuuuaaucuucugucugccacugcagcacagaggagaggcacugagaauuccagucaggucuucaagcugaguguacccaucuuccaaagaaaugcaccuugccugaaugcaguaaguggcaaaugccuaccauccaaacaauaagaggcugaggcuugagguuucaggccagccuggacuaaagagcaaaccccugugugaaaacaauggaaugaagaacuauccugugguaguuugcauaugcucggcccagggagaggcucuauuagaaggcaugauccuguuggaguaggugugucacuguggguaugggcuauuaagacccucauccuagcugccuggaagucaguauucuguuagcagccuucagaugaagaauagaacucucaguuccuccugcaccaugccuaccuagaugcugccaugcuucuaccuugauaauggacuaaaccucugaacuuguaagccagucccaaauaaauguccuuuauaagacuugccuuggucauguugucuauccacagcaaauggaaaccccaacuaagacacaucccuucuuucuugaagucuuagugucuucccuuuucucuagauggagucucuccagcggguggaacuguguggcagcacugacaccccuaaauacuaucuuuaagcaagcaaacacagcaccuguagaaaccagccagcuguguacauucuagggacugauccuguuccugaaaaagugggagggggcugcccugguucagcuccuauuuggggaacuacugacaggacagacuuguucuuccauuugcaaagaccuaaggugaugcaaauguaucugaugugaugugcucaaagcacaaagcucuaagacaaagcugaagagauccaaugcaggcugaacccccaauuucuuccauauuaaauguuuuucuucccaucuauagaauaggguagaaggagagccuaagaggauuuuagcugaugucaagccccaacaucaacccauacuuaaagaguaauauucucauuacaagaccccacugacuggcucaggaccuccuagaugucacagaaaccacauuuggcuaaaagggacagcagacccucugcaccacagaagccuaaguagcucaaggccacagaaauauuuaucuggcucaggacacugguguccuagguaccuuucugugugagcagcuguaccugaugagcuaaagcuccgaggguggauagagcaggcucacagccccacccuggaaaguggucagcugcagagcuucacuaagucucauugucuuacaucuguaaaauggccugccuaagacaagugagugcauugugggaacugacacuguccuuguggcccuuucucucaugucccuuaagaggcuucuuagcaaggaccuagaugugguugucuucuaaaggccccucccaccuggucacucuggcugaaauaggaguaacauaaguuccaggccaagcaugaucuacacacuaaggcccaguuuaaaaccaagaguuucaggaaggaugugggcaauuugggaacagaaguccauccuguacgucuacuggcacagguagaauuaggguccuaucuuggcuucuuccaguugucugaucucuagaaacgagcccccaacucucuuauggcgacagaaaggcaauagaucccucacaagcaggaugacuaaaaagaagccaggcacuguuaccaucaucacaccuaggaccccacagaaugacacuagccccuuaucacaauagacacccaagcuuauaaacaguaagacacuccaaggucacuagaaagcaagugagguaaaucagagcaugugcacucaugcacucaaggcccaagagguucaacaugucagguccugcccaacaguaugcacaauuugacacucagugagaguagguaacauacacaggucagaugaacugcaggaggaaccaagguaguaagcagguccuccaaagggucuaccaaguccugcuaccucaaaauccacacugcuaaauguaagucaugcccaggccucaugaaaccuuaauuucuaccccacacccaacccucagaaaggcaggcacuacugugcuuagaaagauggacccgcugggugugguggcgcacgccuuuaaucccagcccuugggaggcagaggcaggcagauuucugaguuagaggccagccuggucuacaaagugaguuccaggacagccagggguauacagagaaacccugucucaaaaaacaaaaaacaaacaaacaaaaaagaugaacccaaaucugccuguaacuuggucacaggaugaacagguucacuccacucuagcaagacaagaaagaggccaaccacuauuccuucccucaaugggaacuggggagggguaaagcacgcaugucagugguugaaggagcacaagaugggauccaauuaccaaaagcaacuaacaugcuguauugcugagaacucuugauccaaagcacaggagaaaaguaaaaaagggagaaaagccaagagagcagugaucagggaacagagcaagagcucacgugcugaccaccagccaaggccaguaagagucugcccaagucagaaccugggacccaaaguaagcauauaauucucuccugauucucauuguuuugggggacagaaaagccagauccggggggcuuggggggguguggaugucaguucaaugagcuggccugacucagcagcaagcgucuuuuaagccuuucccauuauugacuccaauuccaucaacaaagugcuaaaacuugcacaagcgcauguugagucauagugcuucccugugcuagucacugaccaggaagauaaagcccuaagauuggccagacuuaggugcuggaguggacuguagggagauguuuccuuaggaaguucaggauggcaggagagccagaugaaccuugucacuuguguguuauuagcaugcuagcaacuaagacuaagaccacuguaucucaaucucaauagccuccagugucaguggugucuacauccuccuuagaagaaaaggcuacgaacuaaguuuacccaaggcagaagguaaacggcaaggccagguuacaagagaaauagugucuuccuugugugccauucaagaagcugaagcucaguaagcagcagguuccaucagguaaacaucucaaucucaguuuguagcaacugcucugaguggagacaagaggagaugcagaagcauguaacuggcuacucuagaagccccaaguuucagccucccagaauaggggagcccaggauaacucaaguagcccagaauaguaagccacagcaccaaagaacacaguccggcauacccagggcugaggugaaggggcaccaccuguucaagacugggcugcauggacaugggauguccaggaaggaugccggacagauggggcccaacagcacaaggacagcuuugaagacagaugaguguauaaauggcgcugguaaagccaaaaugcuggacaggagacaguggguacccuggaaggggauauacacagaaagggaaggcuaauauaguaagaagacggucaagacucacuguaaggcuacaucaugauggacacaggagacaauguagcaauccaggaaggcauucuggguaacuaacacagcggcacuccagugcccacagauagcccacucuacaaagcagacaaugccacuuugcauucugcaucugcuaggcuagaaaccacauacaagacaggagccaggacaugucucuagucucuggaagacugguacaguauugaauucuaaccuuccacagaagcacccccaugcaaacauaagcagccaaaugcaccauggugugguccccuaauccuagccaagaucaggguggccaaccuguuggcucugcagucuccaauuucaugacuaccuuggggaaccuacuguuugccagguuugguuggaggaggugcugucuuugccacaauguggagaaagcccgcacaugcucgagcacacacaugcacacauucacauguauguacauacaugacacugaggacaacauaaaauguaauucucuuccuuucucccaccacaauguuaggcugaaacugcaaugaugacucugcuuugggaggugggaaagggcagccuggcaaagcaagagcuuggcagccuggacaggauacugugcaccccuguccugggaagucaguuccagauuucuuccuuaguggucaccaacugucauuguggaacucaguuucuuuagaacuaguaacagcaauguccauuuauacaccuugcuggugguaccagcuaaccccaggcugccaacaccuaggaaaagcagacagcuacuagcucucauguugcccagugcaccaagagcacaggaaaagacaguggccauuuaacaagcaucucuuggaccugucauuuggucaacugaaaggaaguagcagcccagaagcagagagaccaauuucugguucccuagguuaaccagagggaugggauaaacauaggaaacaggcaagauagucagaccaaaccagacccaagucugugggcucuggcuugaggcccuugcuuguguggacaguaggucugaacagagacaaucucucaaacauaagaggagaucuaucagaaccaaggaagacucacccacaaugagggacaaaacugcaacuugccacacuugcaccagaacaggcuaacagcucaacaccgggagugauaguaggcaaauccagagcuugaaaugaaacccuaacaaguaacauuuaggccccucuuccuacaccacucaacacuuauucuggacuuucaucaggucucacuggcccucuaggggcagcuccccagacccaguccugggcccagcuaauugaugguaguaucgcaucaaauuuugggguaaaacaaucaaagugcuguacugagggagcccccuaccccaacuuaaagcagcaagcugcauagaugacuuagacaaggauguaaggauggguucuuggccagaagccagccaagugaaugcuggaggaaauggugagaaguaaugagccaaaggcuaccuuccauuuaacaacagcacgcuaguccugcaggccccaagaaagauaccaugcaaguaaagcccggcagcauucacccuaccugaauucaaggagggcuagcccugaaaacagacaggccuuagucaugugcuugcuacuaugcaagccugacuaccuaaguuugauccccuaaaaccuacauaaaaauaggagagaaccaaucccacaaaguuguucucugaccuccacacaaguaucuugguaugccugcccccugcauacccaguaagauuuuuuuaauuaaaaagaaaauguugggcaugguagugcaugccuuuaaucucaacacucaggaugccgaggcagaaggaugaguugaaggcccaucuguucuacagagugaguucuacgacugccagggcgacauaagagaaccuucucuugaaagaaaggggggaggcggaagagagagagagagagaaacuaacuaacuaacuaacuaacuaggcaggccaacccauuaccauaguaacuagaguucaccuccaaggaaagauuuggccacccaaaccugagccagcucaggacuuaaugaagaagguaaggcacaauaagccauucaagaaacaaaacuccagcccagccaaagggacugugucugauauauacacagucccucaauggcuuguuuuguuguugcuguuccagcucagauuguaaugguuacaucuuugucccucagcuaagacucggcacaggucuacccagagaguacagugacugaccacacagaagggaaaggagacaguguaguaccaucacuacauagauauagcacucucaguaacuuaucaaccacugaagcacugaagcacaugaaggaagcacugaaggcugccagccaguucaaaaccagccccuuucccugauagcccacuaggcacugggaggagcuuguaaacggauagaaaggcagaaaacaagacccuuagucaaaggugugugugaugccacuaguuacagaaaguuagaaggcuaaggaggaucaauugagcuuagacagucaaggcuagccaaaauacaccaaccagcaggaacagagaggcucagugguuaggaacacuugcugcucuucuagcguucuaaguuagagaccagcacccaugucagaugagucacaacugccuguaacccucuuguauccgugugugugugugugugugugugugugugugugagagagagagagagagagagagagagagcgcuugugagagagcgagcacacgcaagcaagcaguuggcauacugguccacaccuuaauccaagcacaauggaugcagccuagucuauauaaugaguuccaggacaaccagagcuacagugagaccuugccaauaaacaaacaaauaaauaaacaaauaaaauaaggaaauacaaaagccaacaauggaaacaugcuaugaucuuagcaggauuuuaaaagauguuacacaagccauaaggauuucacaaggaaauuuuucaaaaaagggagaauaggcuauggggauaaauggggcuccucaccagagggaguaccaaaguugauucccagguaucacauacaggugagaccagcuuucucaucuaagaagauucucagcugaaaacaagagccacacccaaacuuaagaacuuuaaaaaaaaaugaaaaacccagcuacacuuaaaaauacaccaaggcgccgggcggugguggcgcacgccuuuaaucccagcacuugggaggcagagacaggcggauuucugaguucgaggccagccuggucuacaaagugaguuccaggacagccaggacuacagagaaacccugucucgaaaaaccaaaaaaaaaaaaaaaaaaaaaaaaaaaaaaaaaaauacaccaagggaagacuggaaagcuaaaaugaaaacuggguucuugcaucuaaaacaguuuggaacucagaguuaaagugaaggggagagaugccagaagcuccagggacucaaguccugcuccaccacagcucacaucaccuuacagcuccaacuccaggggaucugaugcccucuucuggccuccucaggcacuugcaccaauguggcauacaccacucugacacauaagaaauuucucuuaauauuuuuuuucaagcaaaaggggaaaguugcaugaagagggaagugaacagaauugcaaacuaaacacuucagaucucuaagauggagccuuugaaauagaccucagcucucagaaguacugcaguaggaaagugggcugggcagcacugagcccacuugcuuuggggacaccuagcacugguuuaagacccacagauugcuuagucuuuccuggccccuuaguugaagacaaaugucaaccuucagacugaaagagcaagcaaaugcuaauugaugugcauggaagccagugugcucaucuagugguacugaccgguuaacugcugcugccaacacaagacauuacaccuaccugagcucgagagaaauaauuuuuaaaaauauauuuauuuugagacuauguuugaguauaacccugguuggccuggaauucacuauguagacaaagauggccuggaacucagagguuggucuaucccugccucucaagcacugggauuaaaggcacacuccaccaagguccaccagaacuuugauggcccugggcuucccugggcucacaggcucuagugguuggaucuaggaaaaugcugaagcuccagcaacucagaagcuggaaccacagcugccuggcaagccugcauccccagaggguacaucaccucaccugaagugacccuuucuucaacaauccauagagaaccaaggaauaugggcagcugacaacccaagacuuacaaccuaagaagaguagggcuuucuuccaggauuccugcccuucaucuauauccacacaguaccacaccauuucagauacaguacucaccuaucaaaccagcugccuggaaggcugaggcagcaguuccaggcuagcccagacagaaaagcaagaugccaacaacaacaacaacaacaacaacaacaacaacaaaagaaagaaagaaagaaagaaagaaagaaagaaagaaagaaagaaagaaagaaagaaaaaugcaauauuaaccuuaaccauaucaaagcucuccaggagcucucuccaagagcuugaaauguacagagaccaaucuuggaguccaugagauaaacuguucagugacuaaccaacccaacuauuccuuucaagucuguuccccucgcagcagaaacaaacaagagcuaaccaccugcacuuucuauaaagcauuuaauuccaaacuuccagaugacagaguauuccagagagccauuucaugcucucaagaauucuaucuuggaccagaugaugguggcacacacacuuaauuugaacacuucagaggcagaggcggguagaucacugugagcuucaaagccagccugaucuacagagcaaguguucaggacuauacagagacccugucucaaaaaaaacaaaacaaaacaaaacaaacaaacaaacaaaaaaacaaaccagguguggcggcguauaccuuuaaucccaacacucgagaggcagaggcagguggauuucugaguuugaggccagccuagucuacaaauugaguuccaggacagccagggcuauacagagaaacccugucucaaaaaaccaaaaaccaaaaaccaaaacaaaacaaaaaccaggcaguggugaugcccaccuuuaauuucagcacuugggaggcagaggcaggcggauuucugaguucgaggccagccuggucuacagagugaguuccaggagugccagggcuacacagagaaacccugucuugaaaacaacaaaccaacaaaacaaaacagaaugucuuugucaggguuucuauuccugcacaaacaucaugaccaagaagcaaguuggagaggaaaggguuuauucagcuuacauuuccacauugcuguucaucacugaaagaagucaggacuggaacucaagcaggucaggaagcaggagcugaugcagaggccacggagggauauucuuuacuggcuugcuucuccuggcuugcucagccugcucucuuauagaacccaagacuaccagcccagagauggucccacccacaaggggccuuucccccuugaucacuaauugagaaaaugccuuacaguuggaucucauggaggcauuuccccaacugaagcuccuuucucugugauaacuccagcugugucaaguugacacaaaacuauccaguacacagaacaaaacagaauucaaacuuggacuagagagauggcuccaagguuaagagcucucgugguccuuacacaggaccuaaguuuaguuccuagaacccacauggugggccacaacccucuauaagcacauguaugaugcacaaacacauacgcaggcaaaauacucauccauauaaagucaucuuuuaaaauauacuuuuuuaauaaaagaaaaagucuagccaggugauuaguggugcacuccuuuaaucucagcacucagaaggcagagacagaucuggaacucugugaguuccagaauagccagggcuacauagagaaagaaacugucucaaaaaaaaauuuugggauuugggagggggcggcuagaaagaugacucagagguuaagagcacuagcugcucuuccugagguccagaguucaauuccuagcaaccacauggugguucacaaccaucuauaaugugaucugaugcccucuuuggcaugcagauagaacauuuauauacauaaaauaaauuaaucuuugaaaaaaaauguuuggaggcuggggagauggcucagcagauaagagagcuuacagcucucaaagaggacccaaauuugauucccaguaccagcaucaggauaccacucuaagauaccuguugcccuguucugguguucuggcuccccaggcaccugcacacauguggcaaacacacacacacacacacacacacacacacacacacacacacgacuuuaaaaaaauucuuuuuuuuuuaaaaagaauucuuuguuuggaaagauggcacagugaguagagcacugugauacaagccuagcaauccgaauuugauccucuggaaccacauaaacauuaagggagaaaacgaacuccacaaaauuguccucugaucuucacaguuaugccaucacuugcaguuuucuaccaucaggcacauaagcauguacaaacauacacacacuuuuaaaagaauccuccuuucaaaggcaaaguguccuauuugggcucaagaguugcagcugaaaggccagacuacaccucugacauucacauacaacacagcauucuggccuccuuggcggccacacaucuucaaaggcagguacugggugcacaagucugccuaccaccccaaguacuaucagcacuacagagaaauggcuagucaacuacucagccacaacucauaaaguuuuaccacaacucaugaagaugcaacugcaugggcucucagaccugagacuggaaggaagcuuagacagcacagguucacuucauucaggaaaugagccccacuucauaagacccuacacuagggaauacuugugcccugagaaugaaaggagugcagacuuagcaaggccaccagagaacacacugccugcuugcugcuuaaugaaccucaaacucagcugcccauucucacaaccaacuacagagccaggcucaggacagcacacucccaggaaaugaaaaggagcagcccucagaagcggcuucagaaggagucugucaugagaagcagaaagccuuccagcaaacucaggcuggggucaguuuggguucaaguacuacugaggauugcaggaguaggauaccccuucauccagcucugauccuggcaccuugagaugucugucugccacaaccagaaacaucauuaaucaagggauaauacaugcuccaucugaccaguaacagggucucuacauagccuuggcuguccuggaacucaagcaauccaccugcuucugccuccugagugcuaggauaaaggcuacuuacuacaagccucuuuuagauuuauguccaggacaaaaguccccuccuacagacuaguguugggacgguucuccaggucucaagaacaaacccccagcuuugaggaccaucuaaaaauucaccgaagacaaagucuaccuuccucagggagacaaaacaucaaacaaaaccugacucccaaguuagaacugccacucugcucuucuccugaacuguggucacagcagagaacaacagggacaucacuguacaggaccuagcagugcuaacauguauccucuuucugacaggaucaguggcauuuuaaguuaguguuaaaagagcugucaccuuucagcagaaagcaaagcuggaacacaagacacaggcaaaguuccacacccauugucacagagacagagccccugcaaugcuaacagguaacucucacccaguucugaucacauaggacuagcaggccaagccuucccuacucagguagaguguguaucagcucaugacacccuuccacaaggcugaaaccacuagcauuauguccuagccuagccacagcugacaccacuagcauuaugcugucugcauaaagggggcuagcuucaucccaccuuccuuuauggggcuacugggaagaacagaacacacugucaggguaccucaaaaauuaauuaggguuguacaucucuccuuauuaaccagggguguagauagcugaaaaaguucacacaauccacccugcaugaauuccugaagcaaguaaauagaagaagcccuuccagaacaguucguguaggccacugcagcacuuccaggucugaauccgggucugaauccgggucugaauccgggucuggaagguaugcuuccaggacgggccaccacuuccuuugcugcaaggaacuugcaagccagcagaggcaagugauuccaaguaggaaaugauggccauggugccugcuucuggaagagugagaggaagacagcagcuccugagaucugcuccagaguccagcagugguugaguccuccuucaccaagccuucuuccguccucccacugcuuugcaaccagggcuacaaagcugccuuuggcaaacuccaucuuggaccaccacuucacuauuuagcuuuucaugggacuguguauagucuuuccacuuuuuugaaaaaugaaaucuguuaacuuuaagguuacauucacauuccccacagacacaucucaagccaccugugauuuucucagucaccaaugcucccauuaggccauuccacagcuggccuucaggacuggagcacagggcuucuugagaaaaugggggcguggaggcaacuccugaaucacaggcccaagaguugaaacaaaaugcaaaaagggaggacucuucucuaggaaagaggucaagacauggaacauguaugagaagcugaucucucaggaaaacaugguccagacuuucuucaaacagcaagggcaccacaggacuaaaaacucuaucacuggcuaaaggggaacucaguaugauuucugugcaaguguaagucauacccuucaccuuuauucauacgacuacaagcagauguacaguauacgucagagacugucaacacccuaagcaaacacacauugaggugagugaagcuuccacaguucuggaagucuauuagcugccuuuuggaagggagauggggacuuucugaaguacaggccuggcaggucagugcuugcugcugcugaggcuagagcagggauggcuaucuuacugagaccuccuuggucaaggagcuggucagucagaggcuguggacuuuaggucagcuaccuggcacugauuuuuuuuuuaagccaacagcuaaauuuguuagccauaauugcacacucauaaagguaagcauuacaugacaccauucucugucacuucucucugaagaggguuaauuuuaguguucacucuucaacucuguccucguuuuguauuuuuuccaugaacauccuaaauaugugucaauuagcaagugguggagcuuauaacugggcagagcaaagcacagaucccugcacaaacaugcagcucuuaccugggcccugagcaaucacggaaacagugcaaauguccagggacccuucaauaccacagcaagaaauggaggacagugcuccaggcugauucuacaaagagauucugcaaagccagccccuggcacauauaccuaguuguuuuuguggguggucacugacagugcauuuugggaaacacuucccuccucacucagagacaaguucucaacuccauccaccacaauaaggucucccuuugagauauacacuccaagcaacuuacccacaggccaaagagcauaguaauacuuaugaccaagggaaaauucaagaaacuaauguuugggccaggcaugguggcauauaccuuuaauuccagcauuugggagguagaagcagacagauucucugugagacuacacugguuuacauacauagugacuuccagugacugucucagaaaaaaacaaaacaaaaaccuaaaauuugggcugucuaccuuccuucuuuuacccacaaagggucuucuagucagaccuuaccuaacacuuggacccaccugaucuauagcaucaugauuaccugucaaagcgcuugcuggucccaacacucucacauacaagcagucaggaucucugauaagaucucaagcaaaggaguuacacaggaguuaaaauuuccacuguggaagagaugagcagugguggugcaaucguuuaaucuggaagaagaggcaggagaaucucugaggccaaccuagucuaaagagcaaguucaaggauagucaaagcuacauagaagaggaauccuucuugaaaaacaacaucaaaaaauuauacuguguacacuauggcuucagcaaagaugcaaaagccaucaaggcuauguuuuccuaucucuuguuuuuaccuuuuaauauccuaauauaucaaucaugugauuacagucaguaauaccaaucacuggcaaacaaaacaacaacaaaaaacccaacaaaaccuuaaaccaaaaaaagaaaaaagaaaaaaauuuaaaaaggcuuucuagaagauuuuuaucuagccugucccuauucuaccucgagaaaaugucuacaguauuuacuaaauuacuaucaaggugaucuuaaagaccaagaagaaaauaauuuuggauccagcaagcagaucucauagaaacuagagcaccucuauuucuaccaagaccacacaaacaaugugaauuauucugaacacaccacaauacaguguacauuguacauugcuaagaguaacuggucaagcauagucaagggaacucaaaagacucaaaccucgguuaccuguccaagcccaagaugauuuuucuuccaucccgagcauauuaaaaagugaucucaaaggccacuuccuggucucccagcaaacaccucauaucugaaugccugugcaucuucccauggcccugcuccuaacagcaacaaggauacccgcccccuacacugccaacaaaccuuugggaaaaauacaagaacaggugaaauuagucuaugcucacacaggaagaaaaagaugucccucugcucacaggacucuuagcagaggaaagugugacauaaaguaaccccuuacaauuaaaucuugacaggcuagggcccaaagcaccucaggaggggcaagagagagauggaaagaggaccggaagguaggaauaagagaacaaucaacuaugacgggcaguaacucaguaccaaaaucccaugcuuuagcuucuggucagaugcgcaauggagcauuuaggccaagaaagaugacaggaaggaucccacucucugcagggucgucuuuucuagaaagaccccaggaaagguuuguccacuaucagaaaaaagaggagacucuccaggcaucacagguagacagacugggggcagaacgggccuaggguucccuccuagccaagaaggagguucagccaggagaccgaaggggaguaaaggccaagacuccggagacgcgggcuacucuagucaucgcggagacacuaguugcuucccaccuugcccccggcagggagaccuucccgggggguucucaguucccaggguugaggugaggcaaggaggcacgguggggaccaccaagggcggucgggcugggacaacggagaagaacuagcucugaucaaagcuccaaacgcucccucaguccaggccgcgugaagccucggccucagguacccucagcugccgggcaauccgccuugccugcgguccccggacccaggagaaagagagaccgagauggcaguggcuguggcgggcagaucaccgccuggagagagccccuagccgggggcgcgucggagggggagggucucgacacaugcggccucgguccccgaucgcgaggcagucacuuacguugcucugggagucgauggccuguagcagccggucccucaucugcugcggagacgccggagccgcugucauugccugggcgaagcgggggggagcggccgggccggcgggcgggcaggcugaggagggggaacgcgggucagucacucgccggccuccgggaacggagccgcauguuccccgcggcgccggaggaggucaaggcgcucggggagauggcgaggacggagggaagcggaggggaccggagcucaggccccggaccaccgccgccaccgccgagcgaggaggaggagccgacggaggagccuccgccaccaccgccgccgccgccucgagaaccaaacuccagugagcugccccccgcgcugagcacucuggguaacccgcgccgcacgcagcgucggcgccacgcugaggagguugggagauggggcggguggagacgccggguuugggaggguccggcucgugagccccuccuauugauugugcgcacgcgcgcgcaggcgcaauuagcagguccugccgccugguuccgagguccgacacagagggccguugggaggcaguugggcguggcaacggacgcuaucugaaggccacgcccacucgggacuggagggaugggcuuccuaacggaagcgcacccuucaaguccuggaacaccgacucuaucuucugacugcuuugggguugcggaauggaaagacccucccccggaugagggccuccugcguuuagaaaccagaggauuggagcggccauagguaaucugaggaaggcagcgguucccugcguuuagacucgugccucgaggagcucggaggagcuccgcacagccuucuccgcugcagaggccccaggcgcgggucugcagggcagugcguguccccaugugacccgcgugcugcggggaccuaaggucacgucugggagcugccaccucugcagaggacgcaagucugcaaggccugcgcgacgcugacaccucgggucugcauccgugcggggcuggaacucaagaggaagcaccgcuuuugucgccuuccuagaggcggggggggggcggggggggcuggagguggccagccugugucugaacagcaggaugcggaaccgucgcccagcaucuuccccuuggcguuccgaggggacggagcgaccccgccuuugcaucucaggugauggaaaacaggaacgccucacgggggaggaagggaagcaccaaggucaccuggaguuuuaagucaaaccaagaaacgaaggaagucaaguauaaaggcugcgguccuccguccuucggugaccccuacaacuggacagauggagggcgggcuccgaguuuagugcacuauacgaaaguggccucgggagaaauaacuucguguaguguuguaaccuuaaaaauccagacaugaaacggaagggaaacagguaaugaaaaccacauguacuucugagagcugcucaacaccuguuaauuuuaaauuugucauacuucgggggggggguacugggggaggugaggaaccaggcauuuaauuccaacgcuugggaggcaggaggcucacuggaguuccaggccagcuuggucugcacagugaguuccagauuagcaaggacuacguaaguaagacccugcccuuuucucccacccacccagaaaauaaauuuaucauggcugguuucuugauucugcacaugacagaaggcuuugcauuacaccaauagaaugaacacgaacaaauacuucucaaauacacucucuuccuggcauguguuuggagcucagguuccaaguuggaaagcagcccauuuugaagauacacuuaaucucaccagauaagcaaaauaaacaagguccuccaucaacauuggcucuuaguuugguguuuuuuggcagaguuuaugaagccugagcuggucucaaacauuuuauuccuuccagugucuccuggugcauuacauuuaugccaaucuucugucuuuuauuauuaucuaauaguugauuuuuauuuuucuccccuuauacaggcucucacuacaaagcccuggcuggccuggaucucacuaugcaauucugacuaguuugaaacucacuguggagaccaggcuagccucaaacucacagauauccgccugaguucugcugcccaagagcuggaauuaagugcaucauccuacccugcagaccugcuaucuuguuuauucagugguauaguaugccuuuuuuuuuuuuuucaaaacaagcuauaaauuaagcaggcaauuaguuuugcauggaucaagucaugaaaacaucuuggacagcauucaauguaccugcugaccuugcuauuuuagauuccuccccagguuuugagaccacauguagccuaggcuggccuugaaccuuuuucuuuucuuuauuuuuuauuuuauuugccugguauggugguacucaaggggaggcaggaggaucuccgugaauccagucuaguuuacauagugaguuccaggauagacagccauauguagagagacccugucucuaaauuugauauuaauguuuugccuguaguauauaugcaccuauaugugccuggugucuacagaggccagaaguaguugucagaucccuagaacuagaauuacauggaguugugaguacauacugcgaauugaauccugguccuucuuugagaacagugcucuuaacugcugcauugucucacaggccuggccuugagcucuucauguugccuccaccuccucaagcgcuagaauuauagggcauguaccacccaccaucauaccuggugcuucugauugcauuuucuaugccuagccuuuaaucucagcacucaaagagguagaaacaggaggaucucuugaguucaaggucaucauauagguauggggaauugaacucuggacgagcagcaagcauucauaauggcugagccaucucuccaacccauuuucuuguuuuguuuuuucaagaaaggguuucuugggcuggugagauggcucaguggguaagagcaccugacugcucuuccaaagguccagaguucaaaucccagcaaccacauggugguucacaaucauucguaaugagaucugacucccucuucuggagugucugaagacagcuacaguguacuuacauauaauaaauaaauuaauuuaaaaaaaaaaaggguuucuuuguguaguucuggcuggcugaccugaaacucauuuuauagaccaggccgaccucaaacucauagagauccaccuuccucugccuucagagugcaugacuacaauauuguggaguccuaugcacacaacuuuauucuacuuguucauuuaccuaaguuugauuguuuguguguguguguguguguauauauauauauauauauauaacuguuuguguuguacagaggaccacugccaagaguuaguucucuucuaccauccuggggaucaucuuaggcuuggcuggguuaguggcuauaccugcuaagcaaucuggccacucugguuuuuccuuuuuugagacggggucucccucuguaucccaggcuaggcuugaacuucuaaucuuccugcgugagacccaaguguaguccuguuuaaaagugacaccaggggcuggaaagaugucucaguaguuaagagcacugacugcucuuccagagguccugaguucaauucccagcaaccacauguuggcucacaacuaucugaugcccucuucuggugugucugaagacagcaacaguguacucacauacacaaaauaaauaaaucuuuaaaaaaaaaaagugacacuagcuggaucugguaacucacuccuaugauuccaacagucagaaaauggaggcaagagccgggcgugguggcucaugccuuuaaucccagcacuugggaggcagaggcagguggauuucugaguucgaggcuagccuggucuacaaagugauuuucaggacagccagggcuauacagagaaacccugucucgaaaaaccaaaaacaaacaaaaaaaccccaacaaaaaccacguaaauacuguaagaagaugcuuucguuuuaaucagaggugugggauugcuucagauuaugcgucagguguuguguuucagauuguccacagcagcuaagucugauuugccucacucucuagaagaagcaugauuugccagcuacagaugguuucugcguuugugugguauuuugaauucugggggcuuuucagaggguguauaaaugcuaggaccccaagaaggguagguuguugguugguagguuggugcuuuuugguugcuguugguugugguuuguuaaguaguuguauguaaagaagaagaaauuagauauccugaccgugaagaucaaacuugccccuaaucagcaggaaguggugacauagucuuccacaaagacagccuccuuagccuacccaaacagcaucaggaucagggaccaaugcucaaacaucuuuuaggaagccauugucauucaaaucaccacauuccauuugacuacauagacucauagccuuaccaaacugcaaaauauuucagaucaaaaguuccccuagucuuucacagucucaacacugcuuaaaagcccauagaugcuucuaagacucaaaacaauuucuuaauuguaaucuccugcaaaaucaaaaggcaaauuauacaauuguuacauacaauggcacagaauacauauuaccuuuccaaaaggaggauugggugcuuggugaaaaauuacuaaaagaccaaaagcuaccagggcgaacucuaaagccuguauguagcucugugucugaugucagagggcugagauggcucuguguccagccuugcugccugcaacacaucucucugucaggaugguuccacuuccugugugcacacuccuugccagacaacucaugaaucuggcaucuccaauaucuugggguuuucagugcaaccccagacuucacuuucacagcuucacacaguggcuucuuaaggacuuccaacugggauuccccugccauaggcuaccuuugccuugcagaaagaaagcuuagcuggguggaguccugcucugagggcaucauucucuuuguucccuuaggcagagcaagccugucuuuacugaugcugaucucaaguguaauacuaagccuccaggguauuuucccacaauucaguauauaccugucauguuucguucugccccauugccccuuuucauaagcauuugcauaagcauuggcaaccauaaccacagacucaacauauguuuggaauuccuuccaccaaagaaauaagaccacugcuuuuaaauuuaaucucaggcaaguucuccagacaaggcagaaggcuaccacauccucugccaaaacaguucagggacggcuccugcccaguuacuaaugcuguucccucugaaaccucuugagcugggccuuuacaguccacauugcucgcucucaggaugacugucuuccaggcuccuacugcgacuaagaugaucuguauacuuucuuacaggggucaacugcuaucuuuaguccaaaauuccuaagucuuccauguccuuccaaaaaacaugguuaagucuguuagagcuacagcccacucuauaauaccaacuucuuuuuugugguuguuuuguuuuuucaagacaggguuucucuuuguagccaugacuguccuggaauuuguucuauagaccaggcuggccucaaacucagagaucucagagagcugccugccucugccucccucucaaguacugggauuaaaagcaugcacugccaccaccaaccuccuaguuacuuuucuguugcuaugauaaaacaacaugacuaagccaugugguguguggcacaugauguuaaucacaacacucaguaggcaagcagacuaaugaguucaaggccagccuggucuacagagcaaguugcaagacagcuggaacuggguucucuagggucacagggcuuauggaaugaauacauauauaaagggaauuuauuggaaugacuuagagucugcauucuagcuaguccaacaguagcuagcuguggauggaaagucuaagaaucaaguuguuauacagucccacacggccggauauuucaucuggucuucuguaucugcuggaaucauggagaaguaggcuucaauguuaguaaaggaauugaugcgcuaauaaggcaagagcaagcaggcaaagagcaaaagcuuccuucugugucccuauaugagcuuccagcagaagguauagcccauguuaaaggugugucuucucccuucaaagguccagacuagaaguggauucaucuacuuuaaaccaagcagaauaucuuucauaggugugccuuccauuucugaugucauguugacaaccaagaauagccaucacaacuaagacuacauggagaaacc

SEQ ID NO: 4536 - RNA, 975 nt, Mus musculus
agguggccagccugugucugaacagcaggaugcggaaccgucgcccagcaucuuccccuuggcguuccgaggggacggagcgaccccgccuuugcaucucaggugauggaaaacaggaacgccucacgggggaggaagggaagcaccaaggucaccuggaguuuuaagucaaaccaagaaacgaaggaagucaaguauaaaggcugcgguccuccguccuucggugaccccuacaacuggacagauggagggcgggcuccgaguuuagugcacuauacgaaaguggccucgggagaaauaacuucguguaguguuguaaccuuaaaaauccagacaugaaacggaagggaaacagguaaugaaaaccacauguacuucugagagcugcucaacaccuguuaauuuuaaauuugucauacuucgggggggggguacugggggaggugaggaaccaggcauuuaauuccaacgcuugggaggcaggaggcucacuggaguuccaggccagcuuggucugcacagugaguuccagauuagcaaggacuacguaaguaagacccugcccuuuucucccacccacccagaaaauaaauuuaucauggcugguuucuugauucugcacaugacagaaggcuuugcauuacaccaauagaaugaacacgaacaaauacuucucaaauacacucucuuccuggcauguguuuggagcucagguuccaaguuggaaagcagcccauuuugaagauacacuuaaucucaccagauaagcaaaauaaacaagguccuccaucaacauuggcucuuaguuugguguuuuuuggcagaguuuaugaagccugagcuggucucaaacauuuuauuccuuccagugucuccuggugcauuacauuuaugccaaucuucugucuuuuauuauuaucuaauaguugauuuuuauuuuucuccccuuauacaggcucucacuacaaagcccug

SEQ ID NO: 4537 - RNA, 5901 nt, Mus musculus
guuugucaugguaacucuuuuguuuuuuauuugcacacagcauaugcuuguggcuguaugugcgacacuauaaucagguagacccaguacaacacaguccuccgcucugcagcaucccagcaugaucacuuguggacaacuugaccuguguguuugucaguguuguaaagaagggauaaaaagagggcuuauuuguucaggcuggguggugggaggcagaagacagcacuucauaucuuguagcucuuaagcgugagagacaauuuaacugaaacuccauaucccagugguaacguugggauaacagguuuaaccuucaggagcacaaaguggguugucacuucagguuacauauaucugguuauagcaagggaaagagcuauugcuuaacagcuucuagaacaucugacuugagagucucaaaugguucugaaagggaccccaucccugagccacacaccccagccccucacugggaaauucuaggcaggaacuccaccccugagccagacucucaguccuuuccuguaaaauuauacuaugucacucuacaugaacuacaucuccagccacgagaaguuucugaacaacauuccaaacagacacacauauagagcuggugauaugguucaguggcaucaaaaggcccuagcccagaaccaaaaauaaauaaauaaauaauaauaaaaaccaagaagauucauggguuucaauuuuucacacacacaguaaguaguccaaaaacacuuuaucagaacucaaaugagauaauaagugcaaacccuaugacagcauucuuuuucagcacaauuccucuucagaaugaauggaaccuuuuuuuccugaaacuacaguccuaagcugagaaaggcagaaagccaucccaacuauccaaggcuggggaucagccaacagaguggcauguuacaaugcuaggcaaguggguaggcucaggcaugcugcgggugugaaggacacaaucaacaaugucugcagcagcugugcagccugaacuuagacuugacccaguucccacauuaccagaguuuuccccauaguucccggggaagccugggguaaaaugcuauuaugacuaggguugguaguacacacuugggauucuagcacuaaagaggcugaggcaggagaauggaaaguucucaaucagcacagauuccaucaagauggucucaaagacuaaccaaccagccaauaaaaaaaccugguaugguaguacucaauugggaucuugucucacuacugaaaagauaaggaguucaaggucaucugccacaguuuggggcugucuuuaaaaaaaagccaaaaugaggggcucaggacacaggucacucucaaaagacccagcacucacaugacaguucacaacuggcuguaacucuagcugcagauuagaggacuucuggccucugcaagcccugcauccacaugugugcagacaugcaugcaggcagaauaccauacauauaaaacagaacaaucuuuaaaaagaaaagaaagaaaccaauccaaaaagagagccccaaagcaagccagcugcuacagcuuucaaaugcugauuaaagucccucagcacugccggcauggccaucucuagauggaacgcaucucagagcugauggcguagucgccucugaaccucaugcaccucaagcuugagcuccccuccuucaaagagagacccagaaacccaaaccuucagaguacgcugccaacaucacaagcaacaauaaaggaguggccccaaagucacuuuauuaacaaguggcuugaaagcacagagaggugucugcuaacaucaccacuagcaccucuuccacaggccucuucuggagaagcugaguauguuauggcuaacagcuuagugucuaaagaagaggcuggugucccaagggaggaggaccggcuccuccaaauguuggagcaaucuuuggcugccccagguagacccaguuauggggugaggaggaaacguuuggaaguaagaccucacuggccccagacuguuggguccaccagcauagaccugguagugcaaaagagacugcuagacugucauagcuggcccggcaagcaggugccugagucacaucaauuaaggacaaucugugcaaggccaggagugguggcauacaccuuuaaucccagcacuugagaggcagagacaggcggaucucuaugaguuugaggcccgucuggugugugaguuccagaauagccagggcuaaccagaaaaacccugucucaaaaaaacaaaaaaacagacaaagacacccaaaucaaaccaaaacaaucaccaucaauucaaccaagaaauagcccaggucagguuucuggagaagcugggccaggagaagauagaaugccagcacaagguaaagaccuaggucuuucuccuaauaaagucugacuuugucacuguggcugacgagggucagggagcugggaaauggacauucuccacccaaaugagcuugggccuucugggaaggucccugguuuuccauugagaagauucuugaagucaucagaaacagaaauagagccuugauguccagcaggugaucucuggguuccacgcaggacucaagagccgaacagucuggaaaagucagaaggugaaaugaccaugaggacaggaaggggcugugguaaaaacucuggcacacagcugggcguggugaugcacaucagcuaucccagcaccauugaggccaagcaggaggacuacacaguuaaaaccagcgugggcuacacaacaaacuacuaucucgaacacacuguuggggauuauuuuucaugaaagugcuucaugguucugcacuuaaacauaacuauuggcuaggcaaggugacacagugaauaaaggagcuugcugccaaacuuaauggucucaguuugauccacaggaucaacaagguggaaggagagaaccaacuccugaaaauuguucccugccuuccacaagcauacuuuaucacaugugugcaccccuagguaaacauauaaaauaauaccacaaaaaacaaaaacccuguuggcuggacacugagguauaugccuguaaucccaagaggcaugcuaacacugaugccugacugccaagguaugaacucagaucccuacuucacacuauaaaagccauuucaguggucacacuugugugucucaggacucacaggucuggggcagaggcaucagaagucugagggcagccugaccuacaaucagacucugccaaacaaacaaacaaacaaacaaacaccaaaacaaucaaagagaauggcuguaaaaaacagaagccaguaguaaauccuaccugcuggcuucuacuaaggcuuugaaggcaggaacaugcagucuguuggacuuugaagccauccaguacagguuaacacaacaucaggggugggagacacauggccagauuggacuuagagaccacccuccaauguaaccagaguucuuauuuuggaagaagggauagcccuugagcuucaacuaggggcugauaggauggcucaguaggugccccaugccaagccugauaaccugaguuugauuccccaggacccacauuauaaacagacaaacugugaaaagggcaggagcagguaaugaaugugagcaccaagcaagguaaacuuacacgaucaugcagagcaucaugaacacauuccacagugcgaugaagauccggaaauaccucaggcuuaguaaaaacucucggauguugucuccugcaaagccagaaaguaugguucaugaggcuguaacccaaccuacuaccaaacaucuguggcagccccugaugcauccuuguggagcaccaauucccaaugccucugaauggugcaagaaugggcacguggcucaagucuguccaauuagaguucuuccugagccguggguccuaguuaccaggcccagguuggcuagacugagaauuugccaucuccacacuuuguggccgaacuuagagcacugcaugcgcaccagaacacaucaccugccaucgcucugguuuaccuccuuagcuuuuuguuuuuuguuuuuuuuuuuaauaaauguuguugguuuuuuguuuuaaaauagagcagaauauguuuaagucagaggacaaacuaucaauucucuccuacgauguaaaaccuggggaauugaacccagucagucuugguggcaacugccuuugccugaugggccuuuuagcagcuucuguaaauuggauuuugagaccaggucucacucuggggcugaggcuggcucaaaacucuaaucauauccacacuugucauggaaaggaccucugccaugucacaucaacccacgcuggcggcggcagcagcggcagcggcagcagcggcagcagcagcagcagcggcagcggcagcagcaccuuccugacacccacuuucacuaucccuccagaacacccucugaaucgcccugggcugagucccacagggcaggaucacuuucuuuacccacaccccgacagagcagucagcuaaguggcuggcaauaugguacgcacucaauaaagcugaugaacagagcaugguggaguacucuugucauucaaacaccuaggaggcagaggcagaggcagagggagcaggcauucaaggcuagucauggcccucuaauaccacaucucaacaauaaaaaggaaaaagagaggaaagcgcagguuggugagagagaacaggcacccuggaaucgacuuaaaguguugaagguagaaagacaugcuuaccugugcuggguuccuucgauucuuccccaaagccuuguguguccuucuuuuuccuauaaagaacagcagauaacuccagcuuuccgugaaacauaaacaccaucggauuuccugacccugacacucagcuaggaagggcaugaacuucagcucugcccccgacuugcagugugaccuggggcagugauacaacccucugugagacacucucaaccagccuaguccaucacagcugggugugcagccacagacaggauagaguggguccaagagccagaaaggcauucuugagggauaagccugagcaugaggcucuuuggagaugcaagcaaucccagggugcagauuuuuuuuuguuuguuuaauauuaaucugcaaguaagaaugagugugccgggccgggcgugguggcgcacgccuuuaaucccagcacuugggaggcagaggcaggcggauuucugaguucgaggccaaccuggucuacagagugaguuccaggauagccagggcuacacagagaaacccugucucgaaaaaccaaaaaaaaaaaaaaaaaaaaaaaaaagaaugagugugccaucccgcagcaguuguguggagaucaaaaggacaaucaacaggauuucuaccaugggggauccgggaaucggacucaaguagucaggcuuggcagcaagcgccucugcccgcugagccguucccuggucuagagaguacagauuuaaagauccuggagugauacagaacugucagagccuggugaagcagcgcggaggcguggcuagagguaggauuaguggggcguggagcaugcacagggcgggacuggcggugaccaagggugugggcggggacuggcugugggagggccuggcugucugggacaccgccugucgcggccuacucacaguuuaaaguugagcacagccccggcguucaucaguagcguccugcggagggacaguaacggucaguaagggucacccccaccccucugacugccacucuccgaccucuaacaccccucauucauauuacccgaacagcaguaugucuccgaucauccuuacacccaaggcguccgucaaaccggaaacggaagccgugaugaggggcggaaagug
